United States Patent 12,747,451 (RNA ENCODING AN ANTIBODY) - sequence listing, part 9

SEQ ID NO: 46379 - RNA, 1329 nt, synthetic construct
  misc_feature 1..1329: note = derived and/or modified sequence opt6 from Lilotomab_HeavyChain1
  source 1..1329: mol_type = other RNA
gaaatacaactacaacaatcaggacctgaattagtcaaaccaggagcatcagtaaaagtatcatgcaaagcatctggatattcatttacagactacaacatgtactgggtaaaacaaagccatggtaaatctctagaatggatcggttatatagacccctataacggtgacacaacatataaccaaaaatttaaaggaaaagcaacactcacagtagataaatcatcatcaacagcattcatacatctcaattcactcacctctgaagactcagcagtttactactgtgcaagatctccatatggacattacgcaatggactattggggccaaggaacatcagtaaccgtaagcagcgcaaaaacaacaccaccaagcgtatacccattagcaccaggatctgcagcgcaaactaattcaatggtaacactaggctgcctagttaaaggatatttcccagaacctgtcacagtaacatggaactcaggatcattatcatcaggagtacacacatttccagctgtactacaatcagatttatatacactatcatcatctgtaacagtaccatcatcaacatggccatcagaaacagtaacctgcaacgtagcccaccccgcatcatctacaaaagttgacaaaaaaatcgttccaagagattgtggatgcaaaccatgcatatgcacagtacctgaagtaagttccgttttcatattcccaccaaaaccaaaagacgttttaaccattacactaaccccaaaagtaacctgcgtagtagtagatatatcaaaagacgacccagaagtccaattttcatggttcgtagacgacgtagaagtccacacagcacaaacacaacccagagaagaacaattcaacagcacatttcgctcagtaagcgaattaccaataatgcaccaagactggttaaacggaaaagaattcaaatgcagagtaaatagcgcagcattcccagcaccaatagaaaaaacaatatcaaaaactaaaggacgaccaaaagcaccacaagtatacactattcccccaccaaaagaacaaatggcaaaagataaagtttcactaacatgcatgataacagacttcttcccagaagatataaccgtagaatggcaatggaacggacaaccagccgaaaactacaaaaacactcaaccaataatggacacagacggatcatatttcgtatacagcaaactaaatgtacaaaaatcaaactgggaagcaggtaacacattcacatgttcagtcctccacgaaggactacacaaccatcacactgaaaaatctttatctcattctccaggtaaa

SEQ ID NO: 46380 - RNA, 642 nt, synthetic construct
  misc_feature 1..642: note = derived and/or modified sequence opt6 from Lilotomab_LightChain1
  source 1..642: mol_type = other RNA
gacatagtaatgacacaatcacacaaactactatcaacatcagtaggagacagagtatcaataacatgcaaagcatcacaagacgtatcaacagcagtagactggtaccaacaaaaaccaggacaatcaccaaaattattaataaactgggcatcaacacgacacacaggagtaccagacagattcacaggatcaggatcaggaacagactatacactaacaatatcatcaatgcaagcagaagacctagcactatactattgcagacaacattattcaacaccattcacattcggatcaggaaccaaactagaaataaaaagagcagacgcagcaccaacagtaagcatattcccaccctcaagcgaacaactaacatcaggaggagcatcagtagtatgcttcctaaacaacttctacccaaaagacataaacgtaaaatggaaaatcgacggatcagaaagacaaaacggagtactaaactcatggacagaccaagacagtaaagattcaacatactcaatgtcatcaacactaacattaacaaaagacgaatacgaaagacacaactcatacacatgcgaagcaacacacaaaacatcaacatcaccaatagtaaaatcattcaacagaaacgaatgc

SEQ ID NO: 46381 - RNA, 1338 nt, synthetic construct
  misc_feature 1..1338: note = derived and/or modified sequence opt6 from Lintuzumab_HeavyChain1
  source 1..1338: mol_type = other RNA
caagtccaattagtacaatcaggagcagaagtaaaaaaaccaggatcatcagtaaaagtcagctgcaaagcaagtggatatactttcacagattataacatgcactgggtcagacaagcaccaggacaaggactagaatggataggttacatatacccatacaatggaggcacaggatacaaccaaaaatttaaatcaaaagcaacaattaccgcagacgaatcaaccaacactgcatacatggaattatcatcactaagaagcgaagacacagcagtatactactgtgcccgaggacgaccagccatggactattggggacaaggaacactagtaacagtatcatcagcctcaacaaaaggaccaagcgtattccctttagcaccatcatcaaaatctacaagcggtggaactgccgccctcggctgtctagtaaaagactacttcccagaaccagtaacagtctcttggaactcaggagcactcacctcaggagtccacacttttccagctgtcttacaaagctccggattatattctttatcatccgtcgtcacagtaccttcctcttcattaggaacacaaacatatatatgcaacgtaaaccacaaaccctcaaacacaaaagtagacaaaaaagtagaaccaaaatcatgcgacaaaacacatacctgccccccatgtcccgcaccagaactactaggaggcccatcagtattcctattcccacctaaaccaaaagacacactaatgatatcacgaacaccagaagttacttgcgtagtagtcgacgtcagtcacgaagaccccgaagtcaaattcaattggtacgtagacggagtcgaagtacataacgctaaaacaaaaccaagagaagaacaatacaactcaacatatagagtagtatccgtactaacagtcttacatcaagactggctaaacggaaaagaatacaaatgcaaagtatcaaataaagcattacccgctccaatagaaaaaactatatcaaaagccaaaggacaacccagagaaccccaagtttacacattaccacctagtcgagacgaactaactaaaaaccaagtatcactaacctgtctagtaaaaggattctacccatccgatatcgcagtcgaatgggaatcaaatggacaacctgaaaacaattataaaacaactccccccgtcttagattcagatggatccttcttcctatactccaaattaacagttgacaaaagtagatggcaacaaggaaacgtattctcctgttcagtaatgcatgaagcattacataaccactacacacaaaaatctctttcactatcccctggaaaa

SEQ ID NO: 46382 - RNA, 654 nt, synthetic construct
  misc_feature 1..654: note = derived and/or modified sequence opt6 from Lintuzumab_LightChain1
  source 1..654: mol_type = other RNA
gacatacaaatgacacaatcaccatcaagtttaagcgcaagcgtaggagacagagtaacaataacatgcagagcaagcgaatcagtagacaattacggaatatcatttatgaactggttccaacaaaaaccaggaaaagcaccaaaactactaatatacgcagcatcaaaccaaggatcaggagtaccatcaagattctcaggatcaggatcaggaacagacttcacactaaccatatcatcactccaacccgacgactttgcaacatactactgccaacaatcaaaagaagtaccatggacattcggacaaggaaccaaagtcgaaataaaacgaacagtagcagcaccatcagtattcatattcccaccatcagacgaacaactcaaatctggaacagcatcagtagtatgcctactaaacaacttctacccccgagaagccaaagtacaatggaaagtagacaacgcattacaatcaggaaattcacaagaatcagtaacagaacaagacagcaaagactcaacatactcactatcatcaacactaacactatcaaaagcagactacgaaaaacacaaagtatacgcatgcgaagtaacacaccaaggcttaagctcaccagtaacaaaaagcttcaacagaggagaatgc

SEQ ID NO: 46383 - RNA, 1350 nt, synthetic construct
  misc_feature 1..1350: note = derived and/or modified sequence opt6 from Lirilumab_HeavyChain1
  source 1..1350: mol_type = other RNA
caagtacaattagtacaatcaggagcagaagttaaaaaaccaggatctagcgtcaaagtctcatgcaaagcatcaggtggaacattctcattctacgccatatcatgggtgcgtcaagcacctggacaaggactagaatggatgggaggattcattccaatatttggagcagcaaactatgcacaaaaatttcaaggaagagtcacaattaccgcagatgaatcaacatcaaccgcatatatggaactatcatcactaagatctgacgatacagctgtatactattgcgcaagaataccttcaggatcatactattacgactatgacatggacgtatggggacaaggaacaactgtcactgtatcatcagcttctaccaaaggcccaagcgtatttccactagcaccctgctccagatcaacatcagaatcaacagcagcactcggatgtctagttaaagactacttcccagaaccagtaacagtatcttggaattcaggcgctctcacctcaggcgttcacacatttccagctgtattacaatcatcaggtttatattccttatcaagtgtagtaacagtaccctcatcctctctaggaacaaaaacttatacatgtaacgtcgaccataaaccatcaaatacaaaagtcgacaaaagagtagaatcaaaatacggtccaccatgtccaccatgcccagcacctgaattcctcggaggaccatcagtattcctattccctccaaaaccaaaagacactcttatgatatcaagaactccagaagtcacatgtgtagtagtagacgtatctcaagaagaccctgaagtacaattcaactggtacgtagatggagttgaagttcacaatgcaaagaccaaaccaagagaagaacaattcaattcaacataccgagtcgtctctgtactaactgtactccaccaagactggctaaacggaaaagaatacaaatgcaaagtatcaaacaaaggactaccatcctctatagaaaaaactatatcaaaagcaaaaggacaaccaagagaaccacaagtatacacattaccaccaagtcaagaagaaatgacaaaaaaccaagtatcactaacttgcctagtaaaaggattttatccatcagacatagcagtagaatgggaaagcaatggacaaccagaaaacaattacaaaacaaccccaccagtactagactccgacggatcattcttcctatactctcgactaacagtcgataaatccagatggcaagaaggaaatgtattttcttgctcagtaatgcacgaagcactacataaccattatacacaaaaaagcctatccttatcactcggtaaa

SEQ ID NO: 46384 - RNA, 642 nt, synthetic construct
  misc_feature 1..642: note = derived and/or modified sequence opt6 from Lirilumab_LightChain1
  source 1..642: mol_type = other RNA
gaaatagtattaacacaatcacccgttacattatcattaagcccaggcgaaagagcaactttaagctgtcgagcaagtcaaagcgtaagttcatacttagcatggtaccaacaaaaaccaggacaagcaccaagactactaatatatgacgcaagcaatagagcgacaggaataccagcaagattctcaggctcaggatcaggaacagactttacactaacaataagctcattagaaccagaagacttcgcagtatactattgccaacaaagatccaattggatgtacacattcggacaaggaacaaaactagaaataaaaagaacagtagcagcaccaagcgtattcatattcccaccatcagacgaacaattaaaatcaggaacagcatcagtagtgtgcctactaaataacttttacccaagagaagcaaaagtacaatggaaagtagataatgcactccaaagcggaaattcacaagaaagcgtaacagaacaagatagcaaagactcaacatatagcttaagctcaacattaacactaagcaaagcagattacgaaaaacataaagtatacgcatgcgaagtaacacaccaaggattaagctcaccagtaaccaaaagtttcaacagaggcgaatgc

SEQ ID NO: 46385 - RNA, 1344 nt, synthetic construct
  misc_feature 1..1344: note = derived and/or modified sequence opt6 from Lodelcizumab_HeavyChain1
  source 1..1344: mol_type = other RNA
caagttcaattagtccaatcaggagcagaagtaaaaaaacctggagcctcagtaaaagtatcatgcaaagcatcaggctacacattctcaactatgtacatgtcatgggtaagacaagcaccaggacaaggactagaatggatgggacgaatagaccccgccaatgaacacacaaattacgcacaaaaattccagggtagagtaacaatgacacgagacacatcaatatcaaccgcatacatggaactatccagattaacttccgacgacacagcagtctactactgtgcaagatcctactactactataatatggactactggggacaaggaactttagtaactgtctcctcagcatcaacaaaaggcccatcagtatttccactagcaccatcatctaaatcaacctcaggaggaacagcagcacttggctgcctagtaaaagattacttccccgaacccgtcacagtctcctggaatagtggcgcactaacatccggagtccatacattccctgcagtactacaaagttcaggcctatactccctatcatcagttgtcacagtcccctcatcatcactcggaacacaaacctatatctgtaacgtaaaccacaaaccgtcaaatacaaaagtagataaaagagtagagccaaaatcttgtgacaaaacccatacatgcccaccatgtccagcaccagaagccgctggaggaccatcagtatttttatttcctccaaaaccaaaagacaccctaatgatatcaagaaccccagaagtaacatgcgtagtagtagatgtatcacatgaagacccagaagttaaattcaattggtacgtagacggagttgaagtacataacgcaaaaacaaaaccaagagaagaacaatataactctacatatagagtagtatcagtattaacagttttacatcaagactggctaaacgggaaagaatacaaatgtaaagtttctaacaaagcactaccagccccaatcgaaaaaacaatttccaaagcaaaaggacaaccaagagaacctcaagtatatacactaccaccatccagagaagaaatgacaaaaaaccaagtatcactaacatgcctagtaaaaggattctacccctccgatatagcagtagaatgggaatcaaacggacaaccagaaaacaactacaaaacaacaccacctgtactagactcagacggatcattctttctatactcaaaactaacagtcgacaaaagtcgatggcaacaaggcaacgtattttcatgctccgtaatgcacgaagccttacataaccactacacacaaaaaagtttaagtttatcacccggaaaa

SEQ ID NO: 46386 - RNA, 639 nt, synthetic construct
  misc_feature 1..639: note = derived and/or modified sequence opt6 from Lodelcizumab_LightChain1
  source 1..639: mol_type = other RNA
caaatagtactaacacaatcaccagctacactatccgtttcaccaggagaaagagcaacactatcatgcagagcctcacaatcagtatcatacatgcactggtaccaacaaaaaccaggccaagcaccaagactactaatatacggagtattcagaagagcaacaggaataccagacagattctccggatcaggatccggaaccgactttacattaacaataggaagactagaaccagaagatttcgcagtatactactgcctacaatggtcatcagacccaccaacattcggacaaggaacaaaactagaaataaaaagaacagtagcagcaccaagcgtattcatattcccaccatcagacgaacaactaaaatcaggaacagcatcagtagtatgcttactaaacaacttctacccaagagaagcaaaagtacaatggaaagtagataacgcactccaatcaggaaactcacaagaaagcgtaacagaacaagactcaaaagactcaacatacagtttatcatctacattaacactatcaaaagcagactacgaaaaacacaaagtatatgcatgcgaagtcacacaccaaggactatcatcaccagtaacaaaaagcttcaacagaggagaatgc

SEQ ID NO: 46387 - RNA, 1356 nt, synthetic construct
  misc_feature 1..1356: note = derived and/or modified sequence opt6 from Lokivetmab_HeavyChain1
  source 1..1356: mol_type = other RNA
gaagtacaattagtagaatctggaggtgatttagtcaaacctggaggatcactacgtttatcctgtgtagcaagcggatttacattttctaattatggtatgtcatgggttagacaagcacctggaaaaggcctacaatgggtagcaacaatatcgtacggaggatcatacacatattacccagacaatataaaaggaagattcacaataagtagagacaacgctaaaaacacattatatttacaaatgaattccttaagagcagaagacacagcaatgtactattgtgtaagaggatacggatacgacacaatggactattggggacaaggaacacttgtaacagtatcaagtgcatcaacaaccgctccaagcgtatttccattagcaccctcatgtggctccacttccggatctacagttgcattagcttgtctagtttcaggatactttccagaaccagtaacagtctcatggaactcaggatcactaacatcaggagttcatacatttcctagcgtcctccaaagttccggtttatattccctatcctcaatggtaacagtaccatcctcgagatggccatcagaaactttcacctgtaatgtagcacatcccgcatcaaaaacaaaagtcgacaaaccagtacctaaaagagaaaacggacgagtaccacgaccaccagattgccctaaatgtccagcacctgaaatgctcggaggtccatcagtatttatattcccaccaaaacctaaagatactctcctaattgcaagaaccccagaagtaacctgtgtagtcgtagatctagatccagaagacccagaagtacaaatatcatggttcgtcgacggaaagcaaatgcaaactgctaaaacacaaccaagagaagaacaattcaatggaacttacagagtagtttcagtattaccaataggacatcaagattggctaaaagggaaacaattcacttgcaaagtcaataataaagcattaccatcacccatcgaaagaactatatcaaaggcacgaggtcaagcccaccaaccaagcgtatacgtattacccccaagcagagaagaactaagcaaaaatacagtatcattaacctgcctaataaaagacttctttccaccagacattgacgtagaatggcaatcaaacggacaacaagaacctgaatcaaaatacagaacaacacctccacaactagatgaagacggatcttactttttatattcaaaactatctgtagataaatcaagatggcaaagaggagatacatttatatgtgcagtaatgcacgaagcacttcataatcattacacccaagaatcattaagccattctcccgga

SEQ ID NO: 46388 - RNA, 651 nt, synthetic construct
  misc_feature 1..651: note = derived and/or modified sequence opt6 from Lokivetmab_LightChain1
  source 1..651: mol_type = other RNA
gaaatagtaatgacacaatcaccagcaagcttaagcctaagccaagaagaaaaagtaacaataacatgcaaagcatcccaatcagtatcattcgcaggaacaggactaatgcactggtaccaacaaaaaccaggacaagcaccaaaattactaatctacagagcatcaaatttagaagcaggagtaccatcaagattctcaggatcaggatcaggcacagacttctcattcacaatatcatcactagaaccagaagacgtagcagtatactactgccaacaatcaagagaatacccatggacatttggacaaggaacaaaactagaaataaaacgaaacgacgcacaaccagccgtatacctattccaaccatcaccagatcaattacacacaggttcagcctcagtagtatgcctactaaactcattctacccaaaagacataaacgtaaaatggaaagtcgacggagtaatacaagacacaggaatacaagaatcagtaacagaacaagacaaagacagcacatattcactatcatcaacactaacaatgtcatcaacagaatatctatcacacgaactatactcatgcgaaataacacacaaatcactaccatcaacactaataaaatcattccaaagatcagaatgc

SEQ ID NO: 46389 - RNA, 1344 nt, synthetic construct
  misc_feature 1..1344: note = derived and/or modified sequence opt6 from Lorvotuzumab_mertansine_HeavyChain1
  source 1..1344: mol_type = other RNA
caagtacaactagtagaatcaggaggaggagtagttcaaccaggaagatctttaagactctcatgcgccgcctcaggattcacatttagttcattcggaatgcactgggtccgccaagcaccaggaaaaggactcgaatgggtcgcttacatctcatccggatcatttacaatatactatgcagattcagtaaaaggacgattcacaatatcaagagacaactcaaaaaatactctttacttacaaatgaactcactaagagctgaagacacagcagtctactactgtgctagaatgagaaagggttacgccatggactattggggccaaggaacattagttaccgtatcatctgcatcaacaaaaggaccatccgtatttcccttagcaccatcctcaaaatcaacatccggtggaacagcagcattaggttgcttagtcaaagactactttccagaaccagtaacagtaagctggaattcaggagcactaacaagtggagtacacaccttcccagcagttctacaatcatccggtttatactccctatcatccgtagtaacagtacccagctcatcattaggtactcaaacctacatatgtaacgtaaaccacaaaccatccaataccaaagtagacaaaaaagtagaaccaaaaagttgcgacaaaacacatacatgtccaccatgcccagcacctgaactattaggtggaccttccgtatttttattcccacctaaacctaaagacacattaatgatatcaagaactccagaagtcacttgcgtagtagtagacgtatcccatgaagaccctgaagtaaaattcaactggtatgtagatggagtagaagtacacaacgcaaaaacaaaaccaagagaagaacagtacaattcaacatatcgtgtagtatcagttctcacagtacttcatcaagactggttaaacggaaaagaatacaaatgcaaagtctccaacaaagcactacccgcacccatagaaaaaacaatatctaaagcaaaaggacaaccaagagaaccccaagtctatacattaccaccatcacgagatgaattaacaaaaaatcaagtttcacttacttgcctagttaaaggattttatccatctgacatagcagtagaatgggaatcaaacggacaacctgaaaacaattataaaacaacaccaccagtactagattctgacggctcattttttttatactctaaactaacagtcgacaagtcaagatggcaacaaggtaatgttttctcctgttcagtaatgcacgaagcattacacaaccactatacccaaaaatcattatcattatccccaggcaaa

SEQ ID NO: 46390 - RNA, 657 nt, synthetic construct
  misc_feature 1..657: note = derived and/or modified sequence opt6 from Lorvotuzumab_mertansine_LightChain1
  source 1..657: mol_type = other RNA
gacgtagtaatgacccaatcaccactatcacttccagtaacactaggacaacccgcatcaatatcatgcagatcatcacaaataataatacactcagacggaaacacatacctagaatggttccaacaaagaccaggacaatcaccacgaagactaatatacaaagtatcaaacagattctcaggagtaccagacagattctcaggctccggctcaggaacagactttacactaaaaatatcaagagtagaagcagaagacgtaggagtatactactgcttccaaggaagccacgtaccacacacattcggacaaggaacaaaagtagaaatcaaacgaacagtagcagcaccaagcgtattcatattcccaccatcagacgaacaattaaaatcaggaacagcatcagtagtatgcctactaaacaacttctacccacgagaagcaaaagtacaatggaaagtagacaacgccctccaatcaggaaattcacaagaatcagtaacagaacaagacagcaaagactcaacatattcactatcatcaacattaacattatcaaaagcagactacgaaaaacacaaagtatacgcatgcgaagtaacacaccaaggactatcatcaccagtaacaaaatcattcaacagaggcgaatgc

SEQ ID NO: 46391 - RNA, 336 nt, synthetic construct
  misc_feature 1..336: note = derived and/or modified sequence opt6 from Lpathomab_VL
  source 1..336: mol_type = other RNA
gacgtagtaatgacacaaacaccactatcactaccagtatcactaggagaccaagcatcaatatcatgcacatcaggacaatcactagtacacataaacggaaacacatacctacactggtacctacaaaaaccaggacaatcaccaaaactactaatatacaaagtatcaaacctattctcaggagtaccagacagattctcaggatcaggatcaggaacagacttcacactaaaaatatcaagagtagaagcagaagacctaggagtatacttctgctcacaatcaacacacttcccattcacattcggaacaggaacaaaactagaaataaaa

SEQ ID NO: 46392 - RNA, 366 nt, synthetic construct
  misc_feature 1..366: note = derived and/or modified sequence opt6 from Lpathomab_gamma1-Chain_VDJ-Region
  source 1..366: mol_type = other RNA
caagtacaattacaacaaagcggagcagaactagtaagaccaggaacaagcgtaaaagtaagctgtaaagcaagcggatacggattcataaactatctaatagaatggataaaacaaagaccaggacaaggactagaatggataggattaataaatccaggaagcgattacacaaactataacgaaaactttaaaggaaaagcaacattaacagcagacaaaagctcaagtacagcatatatgcatctatcaagcttaacatcagaagatagcgcagtatatttctgtgcaagaagatttggatattacggaagcggaaactatttcgattactggggacaaggaacaacattaacagtaagctca

SEQ ID NO: 46393 - RNA, 1350 nt, synthetic construct
  misc_feature 1..1350: note = derived and/or modified sequence opt6 from Lucatumumab_HeavyChain1
  source 1..1350: mol_type = other RNA
caagtccaactagtagaatctggaggaggagtagtacaaccaggacgatcattaagactatcatgcgctgcatccggttttaccttctcctcatacggaatgcattgggtacgacaagcacccggaaaaggattagaatgggtagcagtaatatcatacgaagaatccaacagataccacgccgattcagtaaaaggaagatttacaatatccagagataattccaaaataacactatacttacaaatgaattcattaagaacagaagacactgcagtatactattgtgcaagagatggaggaatagcagcaccaggaccagattattggggacaaggtaccctagtaacagtctcatcagcatcaacaaaaggaccatcagtatttccactagcaccagcatcaaaatccacctcaggcggaaccgcagcattaggttgcctagttaaagactacttccccgaaccagtaaccgtatcatggaactcaggagcactaacatctggagtccatacattccccgccgtactacaatcatccggactatactccctcagctcagtagtaacagtaccatcatcatcattaggaacacaaacttatatatgtaacgtaaatcacaaaccaagcaacacaaaagtagacaaacgagttgaaccaaaatcatgtgataaaactcacacttgtcccccatgtcccgctcccgaactactaggaggaccaagtgtattcctctttccacccaaacccaaagacaccctcatgatctcaagaacaccagaagtaacatgtgtagtagtagatgtatcccacgaagacccagaagtaaaatttaactggtatgtagacggagtagaagtacataacgcaaaaactaaaccacgagaagaacaatacaattcaacgtatagagtagtctcagtcctaaccgtattacatcaagactggctaaacggaaaagaatacaaatgcaaagtatcaaacaaagcactaccagcacccatagaaaaaacaatatcgaaagcaaaaggccaaccaagagaaccacaagtatatacattaccaccctcaagagaagaaatgacaaaaaaccaagtttctttaacctgtttagtcaaaggattctacccatctgacattgcagttgaatgggaaagcaacggacaaccagaaaacaattacaaaaccacaccaccagtactagactccgacggatcattctttctatactcaaaactaactgttgataaatcaagatggcaacaagggaacgttttctcatgctcagtaatgcacgaagcactacacaaccattacacccaaaaatcactatcactctccccaggaaaa

SEQ ID NO: 46394 - RNA, 657 nt, synthetic construct
  misc_feature 1..657: note = derived and/or modified sequence opt6 from Lucatumumab_LightChain1
  source 1..657: mol_type = other RNA
gacatagtaatgacacaatcaccattatccctaacagtcaccccaggagaaccagcatcaatatcatgcagatcatcacaatcactattatactcaaacggatataactacttagattggtacctacaaaaaccaggacaatcaccccaagtactaatatcactcggatccaacagagcctcaggagtaccagacagattttcaggctctggatcaggaacagacttcacactaaaaatatcaagagtagaagcagaagacgtaggagtatactactgcatgcaagcaagacaaacaccattcacattcggaccaggaacaaaagtagacataagaagaacagtagcagcaccatcagtattcatattccccccaagcgacgaacaactaaaatcaggaacagcctccgtagtatgcctactaaacaacttctacccaagagaagcaaaagtacaatggaaagtagataacgcattacaaagcggaaactcacaagaatcagtaacagaacaagactcaaaagactcaacatactcattatcatcaacattaacactatccaaagcagactatgaaaaacacaaagtatacgcatgcgaagtaacacaccaaggactatcatcaccagtaacaaaatcattcaaccgaggagaatgc

SEQ ID NO: 46395 - RNA, 324 nt, synthetic construct
  misc_feature 1..324: note = derived and/or modified sequence opt6 from Lulizumab_pegol_LightChain1
  source 1..324: mol_type = other RNA
gacatacaaatgacacaatcaccatcatccctatcagcatcagtaggagacagagtaacaataacatgcagagcatcaagaccaatatggccattcctagaatggtaccaacaaaaaccaggaaaagcaccaaaattactaatatacttcacatcaagactaagacacggagtaccatcaagattctcaggatcaggatcaggaacatgcttcacactaacaatatcatcactacaaccagaagacttcgcaacatactactgcctacaaaacgtagcaaacccagcaacattctcacaaggaacaaaagtagaaataaaaaga

SEQ ID NO: 46396 - RNA, 324 nt, synthetic construct
  misc_feature 1..324: note = derived and/or modified sequence opt6 from Lulizumab_pegol_LightChain
  source 1..324: mol_type = other RNA
gacatacaaatgacacaatcaccatcatcactatcagcatccgtaggagacagagtaacaataacatgcagagcatcaagaccaatatggccattcctagaatggtaccaacaaaaaccaggaaaagcaccaaaactactaatatacttcacatcaagactaagacacggagtaccatcaagattctcaggatcaggatcaggaacatgcttcacactaacaatatcatcactacaaccagaagacttcgcaacatactactgcctacaaaacgtagcaaacccagcaacattctcacaaggaacaaaagtagaaataaaaaga

SEQ ID NO: 46397 - RNA, 1194 nt, synthetic construct
  misc_feature 1..1194: note = derived and/or modified sequence opt6 from Lumiliximab_HeavyChain1
  source 1..1194: mol_type = other RNA
gaagtacaattagtagaatcaggcggaggactcgcaaaaccaggaggatctctacgcctatcttgcgcagcatcaggcttcagatttacatttaacaactactacatggactgggtaagacaagcaccaggacaaggtttagaatgggtattaacaacaggatctgattcctggggacaaggagtactagttacagtatcatccgcatctaccaaaggaccatcagtatttccactagcaccaagttccaaatctacatcaggaggcaccgccgcactaggatgcctcgtaaaagactacttcccagaaccagtaacagtctcatggaactcaggagcactcacatcaggagtacacacatttccagcagtactccaatcatcaggactatacagtctatcatcagtagtaaccgtaccatcatcatcactaggaacacaaacttatatatgtaacgtaaaccataaaccaagcaacacaaaagtagataaaaaagtcgaaccaaaatcttgcgacaaaacacatacctgtccaccatgtccagccccagaactactaggaggcccatcagtattcctattccctccaaaaccaaaagacacactaatgatatcaagaacaccagaagtaacctgtgtagtagtagacgtaagccacgaagatccagaagtaaaattcaactggtatgtagatggcgtagaagtacataatgccaaaacaaaacctagagaagaacaatacaattcaacctaccgagtagtatcagtattaacagtactacatcaagactggctcaacggaaaagaatataaatgcaaagtttcaaacaaagcactaccagcacctatagaaaaaacaatatcaaaagcaaaaggacaaccaagagaaccacaagtatacacactacccccatctagagacgaactcacaaaaaatcaagtatcccttacatgcttagttaaaggattctatccatcagacatagccgtagaatgggaatcaaatggacaaccagaaaacaattacaaaactacaccaccagtactagactcagacggatcattcttcctatattctaaactaacagtcgacaaatcaagatggcaacaaggaaatgttttttcatgctcagtaatgcacgaagcactacataaccattatacacaaaaatcactatcactatcaccaggaaaa

SEQ ID NO: 46398 - RNA, 642 nt, synthetic construct
  misc_feature 1..642: note = derived and/or modified sequence opt6 from Lumiliximab_LightChain1
  source 1..642: mol_type = other RNA
gacatacaaatgacacaatcaccctcaagcctaagcgcaagcgtaggagacagagtaacaataacatgtagagcatcacaagacataagatactatctaaactggtaccaacaaaaaccaggaaaagcaccaaaactattaatatacgtcgcatcatcactacaaagtggagtcccatcaagattctcaggatcaggatcaggaacagaatttacactaacagtaagctcactacaaccagaagacttcgcaacatactattgcctacaagtatactcaacaccaagaacattcggacaaggaaccaaagtagaaataaaacgaacagtagcagcaccaagcgtattcatatttccaccatcagacgaacaactaaaatcaggaacagcatcagtagtatgcctactaaacaacttctacccaagagaagcaaaagtccaatggaaagtagacaacgcactccaaagcggaaactcacaagaatcagtaacagaacaagactcaaaagactcaacatacagcttaagttcaacactaacactaagcaaagcagattacgaaaaacacaaagtatatgcatgcgaagtaacacaccaaggactaagctcaccagtaacaaaaagcttcaacagaggagaatgt

SEQ ID NO: 46399 - RNA, 1347 nt, synthetic construct
  misc_feature 1..1347: note = derived and/or modified sequence opt6 from Lumretuzumab_HeavyChain1
  source 1..1347: mol_type = other RNA
caagtacaattagtccaatcaggagcagaagtaaaaaaaccaggagcctccgtaaaagtatcatgcaaagcatctggctacactttcagatcatcatatatatcatgggtaagacaagcaccaggacaaggtttagaatggatgggatggatatacgccggcaccggatccccctcctacaatcaaaaactacaaggcagagtcaccatgacaacagacacctcaacttcaacagcatacatggaactccgttcactacgctcagatgacacagcagtatactactgtgcaagacaccgagactactactcaaactctctaacatattggggacaaggaacactagttacagtatcatctgcttccacaaaaggaccaagtgtattccccctagcaccaagttcaaaatccacatccggcggaacagcagcactaggatgcctagtaaaagactatttccctgaaccagtaacagtatcatggaattcaggagctctaacctcaggagtccacacattcccagcagtattacaatcttcaggattatactccttaagttccgtagttacagtaccatcatcatcattaggaacacaaacatacatatgcaatgtaaaccacaaaccttcaaataccaaagtagacaaaaaagtcgaaccaaaatcatgtgacaaaactcacacatgtcctccatgcccagcaccagaactacttggaggtccatccgtattcctattcccaccaaaaccaaaagataccctaatgatctcaagaacaccagaagtaacctgcgtagtagttgacgtaagccacgaagacccagaagttaaattcaattggtacgtagacggcgtagaagtgcacaacgcaaaaacaaaacccagagaagaacaatataatagcacatacagagtagtatccgtattaactgtactacatcaagactggttaaacggaaaagaatataaatgcaaagtctcaaataaagctctaccagcccctatagaaaaaacaatatccaaagctaaaggacaaccaagagaaccacaagtctacacattaccaccatcacgcgacgaactaacaaaaaaccaagtctcattaacctgtctagtaaaaggattttacccttccgatatcgcagtagaatgggaatccaacgggcaaccagaaaataattataaaacaacaccaccagtattagactcagacggatcattcttcttatattcaaaactaacagtcgacaaatcaagatggcaacaaggtaatgtattctcctgttcagtaatgcacgaagcccttcacaaccactacacacaaaaatcattatctctatcaccaggt

SEQ ID NO: 46400 - RNA, 660 nt, synthetic construct
  misc_feature 1..660: note = derived and/or modified sequence opt6 from Lumretuzumab_LightChain1
  source 1..660: mol_type = other RNA
gatatcgtaatgacacaatcacctgacagcctagcagtatcactaggagaaagagcaacaataaactgcaaatcaagccaaagcgtcctcaactcaggaaaccaaaaaaactatttaacatggtaccaacaaaaaccaggacaaccaccaaaactattaatatattgggcatcaacaagagaaagcggagtaccagacagattctcaggatctggatcaggaacagacttcaccctaacaatatcatcactacaagccgaagacgtagccgtatattactgccaatcagactactcctacccatacacattcggacaaggaacaaaattagaaataaaaagaacagtagcagccccatcagtattcatattcccaccatcagacgaacaattaaaatcaggcacagcatcagtcgtatgcctacttaacaacttctacccaagagaagcaaaagtacaatggaaagtagacaacgcactacaatcaggaaactcacaagaatccgtaacagaacaagactcaaaagactcaacatacagcttaagttcaacactaaccttatcaaaagcagactacgaaaaacacaaagtatacgcatgcgaagtaacacaccaaggcctatcatcaccagtaacaaaatcattcaacaggggagaatgc

SEQ ID NO: 46401 - RNA, 1329 nt, synthetic construct
  misc_feature 1..1329: note = derived and/or modified sequence opt6 from Lutetium_(177Lu)_lilotomab_satetraxetan_HeavyChain1
  source 1..1329: mol_type = other RNA
gaaatacaattacaacaatcaggaccagaattagtcaaaccaggtgcatcagtaaaagtatcatgcaaagcatcaggatattcattcacagactacaacatgtactgggtaaaacaatcacacggaaaatcattagaatggataggatacattgatccatacaacggagacactacctacaatcaaaaattcaaaggaaaagccaccttaacagtagacaaatcatcatcaacagcatttatacacctaaactcattaacatccgaagatagtgccgtctattattgcgcaagatcaccctacggacattatgcaatggactactggggtcaaggaacttcagttacagtttcatcagcaaaaacaacaccaccatcagtctatccactagccccaggatcagcagcacaaaccaattcaatggtaacactaggttgcctcgtaaaaggctactttccagaacccgtaacagtcacatggaactccggatcactttcatcaggagtacatacatttccagcagtactacaatcagatctctacacactttcatcctctgtcacagtaccatcctcaacatggccatcagaaacagtaacctgcaacgtagcacatccagcatcatcaaccaaagttgacaaaaaaatcgtcccacgagattgcggatgtaaaccctgtatttgtacagtaccagaagtatcatcagtattcatattcccaccaaaaccaaaagacgtattaacaataaccctaacaccaaaagtaacatgcgtagttgtcgatatatccaaagatgaccccgaagtacaattctcatggtttgtagacgacgtagaagtccatacagcacaaacacaaccaagagaagaacaatttaactcaacattcagaagcgtatccgaacttccaataatgcaccaagactggttaaatggaaaagaattcaaatgccgagtcaattctgcagctttccccgcacccatagaaaaaacaatctcaaaaacaaaaggaagacccaaagcaccacaagtatacacaataccaccaccaaaagaacaaatggcaaaagacaaagtatccctcacatgcatgataaccgactttttccctgaagatataaccgtagaatggcaatggaatggccaaccagccgaaaactataaaaacacacaacccataatggatacagacggctcatacttcgtttactccaaactaaacgtccaaaaaagcaattgggaagcaggaaacacattcacctgctcagtactacatgaaggacttcataatcaccacaccgaaaaaagtctatcacattcccctggaaaa

SEQ ID NO: 46402 - RNA, 642 nt, synthetic construct
  misc_feature 1..642: note = derived and/or modified sequence opt6 from Lutetium_(177Lu)_lilotomab_satetraxetan_LightChain1
  source 1..642: mol_type = other RNA
gacatagtaatgacacaatcacacaaattattatcaacatcagtaggagaccgagtatcaataacatgcaaagcatcacaagatgtatcaacagccgtagactggtaccaacaaaaaccaggacaatcaccaaaactattaataaactgggcatcaacacgacatacaggagtcccagacagattcacaggatcaggatccggaacagactatacactaacaatatcatcaatgcaagcagaagacctagcactatactactgccgacaacactactcaacacccttcacattcggatcaggaacaaaactagaaataaaaagagccgacgcagcaccaacagtatccatattcccaccatcatccgaacaactaacatcaggaggagcatcagtagtatgcttcttaaataacttctacccaaaagacataaacgtaaaatggaaaatagacggatcagaaagacaaaacggagtactaaactcatggaccgaccaagactcaaaagactcaacatactccatgtcctcaacactaaccttaacaaaagacgaatatgaaagacacaactcatacacctgcgaagccacccataaaacatcaacatcaccaatagtaaaatcattcaacagaaacgaatgt

SEQ ID NO: 46403 - RNA, 1350 nt, synthetic construct
  misc_feature 1..1350: note = derived and/or modified sequence opt6 from Margetuximab_HeavyChain1
  source 1..1350: mol_type = other RNA
caagtacaactacaacaatcaggaccagaactagtaaaacctggtgcatcacttaaattatcatgcacagcatcaggattcaacataaaagacacctatatacactgggtaaaacaacgtccagaacaaggactagaatggataggacgcatttaccccacaaacggatatactagatatgacccaaaattccaagacaaagcaacaataaccgcagacacatcctcaaacaccgcctaccttcaagtatcaagattaacatcagaagatacagcagtatattactgctcacgatggggtggcgacggcttctatgcaatggactactggggccaaggagcttcagtaacagtatcatcagcatcaacaaaaggaccaagtgtattccccttagcaccatcatcaaaatcaacctctggaggtacagctgcactaggatgcctagtaaaagactatttcccagagccagtcacagtatcctggaactcaggagctctaacatcaggcgtacataccttccccgccgttctacaatcctcaggactatactccttatcatcagttgtaaccgtaccatcatcatcacttggaactcaaacatatatctgcaacgtaaaccacaaaccatcaaatacaaaagtagacaaacgagtagaacccaaatcatgcgacaaaacacacacctgccctccatgtccagcacccgaattagtaggaggcccatcagtatttctactcccaccaaaacccaaagataccctaatgatatcaagaacacccgaagtcacctgcgttgtagtagatgtatcacacgaagacccagaagtaaaattcaattggtatgtcgacggagtagaagtacacaacgctaaaactaaaccaccagaagaacaatacaattcaacactcagagtcgtctcagtattaacagtactacatcaagactggctaaacggtaaagaatacaaatgcaaagtatcaaataaagccctaccagccccaatagaaaaaaccatatcaaaagcaaaaggacaacccagagaacctcaagtttatacacttccaccatcaagagatgaattaacaaaaaaccaagtctccttaacatgcctagtaaaaggtttctatccatctgatattgcagtagaatgggaatcaaatggacaaccagaaaacaactataaaacaacaccattagtactagactccgacggatcattcttcttatactctaaactaacagtagataaatcacgatggcaacaaggtaacgtattctcatgctcagtaatgcacgaagcactacataaccactacacacaaaaatcactatcactaagcccaggaaaa

SEQ ID NO: 46404 - RNA, 642 nt, synthetic construct
  misc_feature 1..642: note = derived and/or modified sequence opt6 from Margetuximab_LightChain1
  source 1..642: mol_type = other RNA
gacatagtaatgacacaatcacacaaattcatgtccacatcagtaggagacagagtatcaataacctgcaaagcatcacaagacgtaaatacagccgtagcatggtaccaacaaaaacccggacactcaccaaaactattaatatactcagcatcattcagatatactggagtaccagacagattcacaggatcaagatcaggaacagactttacattcacaatatcatcagtacaagcagaagacttagcagtatactactgccaacaacactacacaacaccaccaacattcggaggtggaacaaaagttgaaataaaacgaacagtagcagcaccatcagtattcatattcccaccatcagacgaacaactaaaatcaggcacagcatcagtagtatgcctattaaataacttctacccaagagaagcaaaagtacaatggaaagtagacaacgcacttcaatcaggaaactcacaagaatcagtaacagaacaagactcaaaagactcaacatactcactatcatcaaccctaacactatccaaagcagattacgaaaaacacaaagtatacgcatgcgaagtaacacaccaaggattatcatcaccagtaacaaaatcattcaacagaggcgaatgc

SEQ ID NO: 46405 - RNA, 762 nt, synthetic construct
  misc_feature 1..762: note = derived and/or modified sequence opt6 from Marzeptacog_alfa_HeavyChain1
  source 1..762: mol_type = other RNA
atagtaggaggaaaagtatgtccaaaaggagaatgtccatggcaagtactactactagtaaatggagcacaattgtgtggaggaacattaataaatacaatatgggtagtaagtgcagcacattgttttgataaaataaaaaactggcgtaacttaatagcagtattaggagagcatgatttaagtgaacatgatggagatgaacaatcaagaagagtagcacaagtaataataccatcaacatatgtaccaggaaccacaaatcacgatatagcactactaagactacatcaaccagtagtattaacagatcatgtagtaccattatgcctaccagaaagaacatttagtgaaagaacactagcatttgtaagatttagcttagtatcaggttggggaagattattagatcgaggagcaacagcactagaactacaagtattaaacgtaccaagattaatgacccaagattgtttacaacaatcaagaaaagttggtgattcaccaaatataacagaatatatgttttgtgctggatatagcgatggaagtaaagatagttgtaaaggagattcaggaggaccacatgcaacacattatagaggaacatggtacctaacaggaatagtctcatggggacaaggatgtgcaacagtaggacattttggagtatatacaagagtatctcaatatatagaatggttacaaaaactaatgagaagtgaaccacgaccaggcgtacttttaagagcaccatttcca

SEQ ID NO: 46406 - RNA, 456 nt, synthetic construct
  misc_feature 1..456: note = derived and/or modified sequence opt6 from Marzeptacog_alfa_LightChain1
  source 1..456: mol_type = other RNA
gcaaacgcattcttagaagaactaagaccaggaagcttagaaagagaatgtaaagaagaacaatgctcattcgaagaagcaagagaaatatttaaagatgcagaaagaacaaaattattctggatatcatactcagacggagaccaatgcgcaagctcaccctgtcaaaatggaggaagctgtaaagatcaattacaatcatacatatgcttttgcttaccagcattcgaaggaagaaactgtgaaacacacaaagacgatcaattaatatgtgtaaatgaaaatggaggatgcgaacaatattgctcagaccatacaggaacaaaaagatcatgcagatgccatgaaggatactcactattagcagacggagtaagctgtaacgcaacagtagaatatccatgtggaaaaataccgatattagaaaaaagaaatgcatcaaaaccacaaggaaga

SEQ ID NO: 46407 - RNA, 669 nt, synthetic construct
  misc_feature 1..669: note = derived and/or modified sequence opt6 from Matuzumab_HeavyChain1_variant_3c08_H
  source 1..669: mol_type = other RNA
caagtacaattagtacaatcaggagcagaagtaaaaaaaccaggcgcttcagtaaaagtaagctgtaaagcatcaggatacacattcacatcacattggatgcactgggtaagacaagcaccaggacaaggactcgaatggataggagaattcaatccatcaaatggaagaacaaactataacgaaaaattcaaatcaaaagcaaccatgacagtagacacatcaacaaacacagcatatatggaactatcatcattaagatcagaagatacagcagtatattactgtgcatcaagagattacgattacgatggaagatactttgactattggggacaaggaacattagtaacagtatcaagcgctagcacaaaaggaccatcagtatttccattagcaccatcatcaaaatcaacatcaggaggaacagctgccttaggatgtctcgtaaaagattactttccagaacccgtaacagtaagctggaactcaggagctctaacaagcggagtacatacatttccagcagtattacaatcaagcggattatatagcttatcatctgtagtaacagtaccatcaagctcactaggaacccaaacctacatatgtaacgtaaaccataaaccatcaaatacaaaagtagataaaaaagtagaaccaaaatca

SEQ ID NO: 46408 - RNA, 669 nt, synthetic construct
  misc_feature 1..669: note = derived and/or modified sequence opt6 from Matuzumab_HeavyChain1_variant_3c09_C
  source 1..669: mol_type = other RNA
caagtacaattagtacaaagcggagcagaagtaaaaaaaccaggagcaagcgtaaaagtaagctgtaaagcatcaggttacacattcacaagtcattggatgcactgggtaagacaagcacccggacaaggactagaatggataggagaattcaatccatcaaacggaagaacaaactataacgaaaaattcaaatcaaaagcaacaatgacagtcgacacatcaacaaacacagcatatatggaactatcatcactaagatcagaagatacagcagtatattattgcgcatcaagagactacgattatgctggaagatactttgactattggggacaaggcacattagtcacagtatcaagcgcaagcacaaaaggaccatcagtatttccattagcaccatcatctaaatcaacatcaggaggaacagcagcattaggatgtttagtaaaagattactttccagaacccgttacagtaagttggaactcaggagcactaacttcaggagtacacacttttccagcagtattacaatcatcaggactatatagcttatcatcagtagtcaccgtaccatcaagctcattaggaacacaaacatatatatgtaacgtaaaccataaaccaagcaatacaaaagtagataaaaaagtcgaaccaaaatca

SEQ ID NO: 46409 - RNA, 636 nt, synthetic construct
  misc_feature 1..636: note = derived and/or modified sequence opt6 from Matuzumab_LightChain1_variant_3c08_L
  source 1..636: mol_type = other RNA
gacatacaaatgacccaatcaccatcatccttatcagcatcagtaggagacagagtaacaataacatgttccgcatcatcatcagtcacatacatgtactggtaccaacaaaaaccaggaaaagcaccaaaacttctaatatacgacacaagcaacctagcatcaggagtaccatcaagattttcaggatcaggatcaggaacagactacaccttcacaatatcctcactacaaccagaagacatagcaacatactactgccaacaatggtcatcacacatattcacattcggacaaggaacaaaagtagaaataaaaagaacagtagcagcaccatcagtattcatattcccaccatcagacgaacaactaaaatccggaacagcatcagtagtatgcctactcaacaacttctacccaagagaagcaaaagtacaatggaaagtagacaacgcattacaatcaggaaactcacaagaatcagtaacagaacaagactctaaagactcaacatactcactatcatcaacattaacattatcaaaagcagactacgaaaaacacaaagtatacgcatgcgaagtcacacaccaaggactatcatcacccgtaacaaaatcattcaacagaggagaa

SEQ ID NO: 46410 - RNA, 636 nt, synthetic construct
  misc_feature 1..636: note = derived and/or modified sequence opt6 from Matuzumab_LightChain1_variant_3c09_B
  source 1..636: mol_type = other RNA
gacatacaaatgacacaatccccatcatcactctcagcatcagtaggagacagagtaacaataacatgctcagcatcatcatcagtaacatatatgtactggtaccaacaaaaacccggaaaagcacccaaattactaatatacgacacatcaaacttagcatctggagtcccatcaagattctcaggatcaggctcaggaacagactacacattcacaatatcctcactacaaccagaagacatagcaacatactactgccaacaatggtcctcacacatattcacattcggacaaggcacaaaagtagaaataaaaagaacagtagcagcaccatcagtattcatattcccaccatccgacgaacaactaaaatcaggaacagcatcagtagtatgcctattaaacaacttctacccaagagaagccaaagtacaatggaaagtcgacaacgcactacaatcaggcaactcacaagaatccgtaacagaacaagactcaaaagactccacatactcattatcttcaaccctaacattatcaaaagcagactacgaaaaacacaaagtatacgcatgcgaagtaacacaccaaggactatcatcacccgtaacaaaatcattcaacagaggagaa

SEQ ID NO: 46411 - RNA, 1341 nt, synthetic construct
  misc_feature 1..1341: note = derived and/or modified sequence opt6 from Mavrilimumab_HeavyChain1
  source 1..1341: mol_type = other RNA
caagtacaactagtacaatcaggagctgaagtcaaaaaaccaggagcaagtgtaaaagtatcatgcaaagtatccggctatacattaacagaactctcaattcattgggttcgacaagccccaggaaaaggcctagaatggatgggcggatttgaccccgaagaaaacgaaatcgtatacgcacaaagatttcaaggcagagtcacaatgacagaagatacctctactgatacagcatatatggaattatcttcactaagatcagaagatacagcagtatattattgtgcaatagtaggatctttctcaccactcacactcggtttatggggacaaggaacaatggtaaccgtatcctcagcttctacaaaaggtccctcagtattcccattagcaccatgttcacgatcaacatctgaaagcacagctgcattaggatgtttagtaaaagactattttccagaaccagtaacagtatcatggaattcaggtgcacttacatccggagtacatacatttccagctgtattacaatcatcaggactatattcactttcatcagttgtcacagtaccctcaagctcattaggtacaaaaacatatacatgtaatgtagatcataaaccatcaaatactaaagtagataaaagagtagaatcaaaatacggtccaccatgcccatcatgtcccgcaccagaatttttaggaggtccatcagtatttttatttccaccaaaaccaaaagatacactcatgatatctagaactccagaagtaacatgtgtcgtcgtagatgtttctcaagaagaccctgaagtacaatttaactggtatgtagacggcgtagaagtacacaacgccaaaactaaacccagagaagaacaatttaattcaacatatagagtagtatcagtattaactgttctacaccaagattggctaaatggcaaggaatataaatgtaaagtttctaataaaggattaccatcctccatagaaaaaactatttcaaaagcaaaaggacaaccaagagaacctcaagtatatactttaccaccatctcaagaagaaatgactaaaaatcaagtatcacttacttgtttagtaaaaggattctatccatccgacatagccgtagaatgggagtccaacggtcaaccagaaaacaattataaaactacaccccctgtcttagattctgatggatcattctttctatattcaagattaacagtagataaatcaagatggcaagaaggcaatgtattttcatgttcagtcatgcatgaagccttacataaccattacacacaaaaatcattatcactaagcctcggaaaa

SEQ ID NO: 46412 - RNA, 651 nt, synthetic construct
  misc_feature 1..651: note = derived and/or modified sequence opt6 from Mavrilimumab_LightChain1
  source 1..651: mol_type = other RNA
caatcagtactaacacaaccaccatcagtatcaggagcaccaggacaacgtgtaaccatatcatgcacaggatccggatcaaacataggagcaccatacgacgtatcatggtaccaacaactaccaggaacagctccaaaactactaatataccacaacaacaaaagaccatcaggcgtaccagacagattctcaggatcaaaatcaggtacctcagcatctctagcaataacaggattacaagcagaagacgaagcagattactactgcgcaacagtagaagcaggcctatcaggatcagtattcggaggaggcacaaaactaacagtactaggacaaccaaaagcagcaccatccgtaacattattcccaccatcatctgaagaactacaagcaaataaagcaacactagtctgcctaatatcagacttctacccaggagcagtaacagtcgcatggaaagcagactcatcaccagtaaaagcaggagtagaaacaacaacaccatcaaaacaatcaaacaacaaatacgcagcctcctcatacttatcattaacaccagaacaatggaaatcacacagatcatactcatgccaagtaacacacgaaggatcaaccgtagaaaaaacagtagcaccaacagaatgttca

SEQ ID NO: 46413 - RNA, 1359 nt, synthetic construct
  misc_feature 1..1359: note = derived and/or modified sequence opt6 from MDX-1303_HeavyChain1
  source 1..1359: mol_type = other RNA
caagtacaactcgttgaatcaggaggcggagtagtacaacccggacgatccctaagattatcatgcgcagcatcaggcttcacattctcatattacggaatgcactgggtaagacaagcacccggaaaaggattagaatgggttgcagtaatatggcacgatgaaagcatagtctattacgcagatagtgttaaaggaagattcacaatatccagagacaactcaaaaaacacactctatctacaaatgaattcactaagagccgaagacacagcagtatattactgtacccgtgatccaggagacccatactattactattatggactagacgtctggggacaaggaactacagttacagtatcatcagcatccactaaaggaccatcagtttttccattagcaccctcatcaaaatcaacttcaggaggcactgctgcactaggctgcctagtaaaagactattttcctgaaccagtaacagtctcatggaactcaggcgcacttacctcaggagtacatacatttccagcagttttacaatcctcaggactatactcattatcaagtgttgtaacagtaccaagctcttctctaggcacccaaacatacatatgcaatgtaaatcacaaaccctcaaacacaaaagtagataaacgagtagaaccaaaatcatgcgacaaaacacatacatgccccccgtgtccagcaccagaactattaggcggaccatcagtattcctatttccaccaaaaccaaaagatacattaatgatatcacgtacacccgaagtcacatgcgttgtagtcgatgtatcacacgaagatccagaagtaaaattcaattggtacgtggacggagttgaagtacacaacgctaaaacaaaaccaagagaagaacaatacaactcaacatacagagtagtatctgtattaaccgtactacaccaagattggttaaatggtaaagaatacaaatgcaaagtatcaaataaagcattacccgcaccaatagaaaaaacaatatcaaaagcaaaaggacaaccacgtgaaccacaagtatacacacttcccccatcacgcgaagagatgaccaaaaaccaagtatcattaacttgcttagtaaaaggcttctacccttcagatattgcagtagaatgggaatcaaacggtcaaccagaaaacaattacaaaacaacaccaccagtattagattctgatggaagttttttcctatactcaaaattaacagttgacaaatcacgatggcaacaaggaaacgtattttcatgttcagtaatgcacgaagcccttcacaatcactacacacaaaaatctctctcactatcaccaggtaaa

SEQ ID NO: 46414 - RNA, 645 nt, synthetic construct
  misc_feature 1..645: note = derived and/or modified sequence opt6 from MDX-1303_LightChain1
  source 1..645: mol_type = other RNA
gaaatagtactaacacaatcaccaggaacactctcactatctccaggagaaagagcaacactatcatgcagagcatcacaatcagtatcatcatcatacctagcatggtatcaacaaaaaccaggacaagcaccaagactactaatatacggagcatcatcaagagcaacaggaataccagacagattctcaggatcaggatcaggaacagactttaccctaacaatatcacgactagaaccagaagactttgcagtatactactgccaacaatacggatcatcaatgtatacattcggacaaggaacaaaactagaaataaaaagaacagtagcagcaccatcagtattcatattcccaccctctgacgaacaactaaaatcaggcacagcatcagtagtctgtctactaaacaacttctacccaagagaagcaaaagtacaatggaaagtcgacaatgcattacaatccggaaactcccaagaatcagtaacagaacaagattcaaaagactcaacatactcactatcctcaacattaacactatcaaaagcagactacgaaaaacacaaagtatacgcatgcgaagtaacacaccaaggactctcatcaccagtaacaaaatccttcaacagaggagaatgc

SEQ ID NO: 46415 - RNA, 1347 nt, synthetic construct
  misc_feature 1..1347: note = derived and/or modified sequence opt6 from Mepolizumab_HeavyChain1
  source 1..1347: mol_type = other RNA
caagtaacattaagagaatcaggaccagcactcgtaaaacccactcaaacattaacacttacatgcacagtatccggattttcactaacatcatactcagtacactgggtaagacaaccaccaggaaaaggccttgaatggctaggagtaatctgggcatcaggaggaacagactacaactccgcactcatgtctagactttcaatatctaaagatacctcaagaaaccaagtagttttaacaatgactaacatggacccagtcgacacagctacatattattgtgcaagagatccaccatcatcactactaagattagattactggggacgaggaaccccagtaacagtaagttcagcatcaacaaaaggaccatcagtcttccccctcgccccctcttcaaaatccacatccggaggaactgccgcactcggatgcctcgtaaaagattacttcccagaaccagtaacagtatcatggaattcaggcgcactcacatctggagtacacacattcccagctgttctccaatcatcaggcctatatagcctctcatccgtagtaacagtaccatcctcatcccttggcacccaaacatacatatgtaatgtaaaccacaaaccatccaatacaaaagttgataaaagagtagaacccaaatcatgcgacaaaactcacacctgcccaccatgcccagccccagaattactaggaggcccatctgtattcttattcccaccaaaacccaaagacaccctaatgatatcacgcacaccagaagttacttgtgtagtagttgacgtatcacatgaagatccagaagttaaattcaactggtacgtagatggagtagaagtacacaatgccaaaactaaaccacgagaggaacaatacaactccacatatagagtagtatcagtcctaacagtattacatcaagattggctaaatggaaaagaatacaaatgcaaagtctccaacaaagctctacctgcaccaatagaaaaaactatatcaaaagccaaaggtcaacctagagaaccacaagtttacacattaccaccctcaagagaagaaatgacaaaaaaccaagtatcattaacatgcctagtaaaagggttctatccaagcgacatcgccgtcgaatgggaatcaaacggacaaccagaaaataactacaaaacaacaccaccagtactagactccgacggtagcttttttttatactcaaaactaacagtagataaatcacgatggcaacaaggcaatgtattcagttgtagcgtcatgcacgaagcattacataaccactacacacaaaaatcattatccttatctccaggaaaa

SEQ ID NO: 46416 - RNA, 660 nt, synthetic construct
  misc_feature 1..660: note = derived and/or modified sequence opt6 from Mepolizumab_LightChain1
  source 1..660: mol_type = other RNA
gacatagtaatgacacaatcaccagatagcctagcagtatcactaggagaaagagcaacaataaactgcaaatcatcacaatcactactaaactcaggaaatcaaaaaaactacttagcatggtaccaacaaaaaccaggacaaccaccaaaactactaatatacggagcatcaaccagagaaagcggagtaccagacagattctcaggatcaggatcaggaaccgattttacactaacaataagctcattacaagcagaagacgtagccgtatactactgccaaaacgtacactcattcccattcacattcggaggaggaacaaaactagaaataaaaagaacagtagcagcaccatccgtattcatattccccccatcagatgaacaactaaaatcaggaacagcctcagtcgtctgcttactaaacaacttctacccaagagaagcaaaagtacaatggaaagtagacaacgcattacaatcaggaaactcacaagaatcagtaaccgaacaagatagcaaagactcaacatactcactaagctcaacactaacattatcaaaagcagactacgaaaaacacaaagtatacgcatgcgaagtaacacaccaaggcttatcatcaccagtaacaaaatcattcaacagaggtgaatgt

SEQ ID NO: 46417 - RNA, 1350 nt, synthetic construct
  misc_feature 1..1350: note = derived and/or modified sequence opt6 from Metelimumab_HeavyChain1
  source 1..1350: mol_type = other RNA
gaagtacaacttgttgaaagtggaggaggagtagtacaaccaggaagatctttaagactatcctgtgccgcaagcggattcacattctcatcatacggaatgcactgggtaagacaagcccccggcaaagaactcgaatgggtagcagtaatatcatacgacggttcaataaaatattacgcagattcagttaaaggaagatttacaatatctagagacaactcaaaaaacacattatacctacaaatgaactcattaagagccgaagacacagcagtgtattactgtgcaagaacaggagaatactcaggatacgacacagacccgcaatattcctggggacaaggaacaacagttacagtttcatcagcatcaaccaagggaccatccgtattcccattagcaccatgctcaagatcaacatcagaatcaacagctgcactaggctgccttgtaaaagattacttcccagaaccagtaacagtatcttggaactccggtgcactaacatcaggtgtacacacatttccagccgtattacaatcctcaggattatactctctatcaagcgtagtaacagtaccatcatcttcactaggcacaaaaacatatacatgtaacgtagaccataaaccttcaaacacaaaagtcgacaaaagagtagaaagcaaatacggcccaccatgcccatcatgcccagcaccagaatttcttggaggaccctcagtcttcctattccctccaaaaccaaaacctacactaatgatatcacgaacacctgaagtaacttgtgtagtagtagatgtatctcaagaagacccagaagtacaatttaactggtacgttgacggtgtagaagtacacaacgcaaaaactaaaccaagggaagaacaatttaactcaacataccgcgtagtatccgttttaacagtccttcaccaagactggttaaacggcaaagaatataaatgcaaagtatcaaacaaaggtctcccatcatcaattgaaaaaacaatatcaaaagcaaaaggacaaccaagagaaccacaagtatatacactaccaccatcacaagaagaaatgacaaaaaaccaagtatcactaacttgcctagtcaaaggattctacccctctgatatagcagtagaatgggaatccaacggacaaccagaaaataactacaaaacaacacctccagttctagactctgacggctcattttttctatattcccgactaactgtagataaatcaagatggcaagaaggcaacgtattctcatgttcagtaatgcatgaagctctacataatcactacacacaaaaatccttaagcttatcactcggcaaa

SEQ ID NO: 46418 - RNA, 639 nt, synthetic construct
  misc_feature 1..639: note = derived and/or modified sequence opt6 from Metelimumab_LightChain1
  source 1..639: mol_type = other RNA
gaaatagtactaacacaatcaccatcaagtttaagtgcaagcgtaggagatagagtaacaataacatgtagagcaagccaaggcataggagacgacctaggatggtaccaacaaaaaccaggaaaagcaccaatattattaatatacggaacaagcacactacaaagcggagtaccaagtagattctcaggatcaggatcaggaacagactttacactaacaataaactcattacaaccagaagactttgcaacatactattgcttacaagatagcaattacccactaacattcggaggaggaacaagactagaaataaaaagaacagtagcagcaccaagcgtattcatattcccaccatcagacgaacaattaaaatcaggaacagcatcagtagtatgcttattaaataacttttacccaagagaggcaaaagtacaatggaaagtagacaacgcattacaaagcggaaactcacaagaaagcgtgacagaacaagacagtaaagactcaacatatagcttaagctcgacacttacattaagtaaagcagattacgaaaaacataaagtatacgcatgcgaagtcacacaccaaggtttatcaccagtaacaaaatcattcaatagaggagaatgc

SEQ ID NO: 46419 - RNA, 1350 nt, synthetic construct
  misc_feature 1..1350: note = derived and/or modified sequence opt6 from Milatuzumab_HeavyChain1
  source 1..1350: mol_type = other RNA
caagtccaattacaacaatcaggttccgaattaaaaaaacctggagcctcagtaaaagtatcatgcaaagcatccggatacactttcacaaattacggagtaaactggataaaacaagcacccggacaaggcctacaatggatgggatggatcaatccaaataccggcgaaccaacattcgatgacgactttaaaggccgattcgccttctcactagacacatccgtatcaacagcatacttacaaatatccagccttaaagcagacgataccgcagtttacttctgctctagatctcgaggaaaaaatgaagcctggttcgcttactggggacaaggaacactagtaacagtatcatcagcatccaccaaaggaccaagcgtatttccactagcaccaagcagtaaatccacaagcggaggcacagcagctctcggctgtttagtcaaagactacttcccagaaccagtaacagtctcttggaacagcggagcactaacatcaggtgtacacacattcccagcagtacttcaaagtagtggtctatattccctttcatcagtagtaacagtaccctcctcatcactagggacacaaacctacatctgcaacgtcaaccacaaaccatcaaacacaaaagtagacaaaagagttgaaccaaaatcttgcgacaaaacacacacatgcccaccatgtccagcaccagaattactaggtggtccatcagtatttctatttccacctaaaccaaaagacacattaatgatatctagaacaccagaagtaacatgcgtagtagtagacgtatctcacgaagatccagaagtaaaattcaattggtacgtcgatggagtcgaagtacataacgctaaaaccaaacccagagaagaacaatacaactccacatatagagtagtatcagtattaacagttctacaccaagactggttaaacggcaaagaatataaatgtaaagtatctaacaaagcactacctgcaccaatagaaaaaacaatttcaaaagcaaaaggccaaccaagagaacctcaagtatatacactaccaccatcaagagaagaaatgacaaaaaatcaagtatccttaacatgcctagtaaaaggtttctacccctcagacatcgctgtagaatgggaatcaaacggccaaccagaaaataactataaaacaactccaccagtattagattccgacggttcattcttcctatactcaaaattaactgtagacaaatctagatggcaacaaggaaacgtattctcatgtagcgtaatgcacgaagctctccacaaccattacacacaaaaatcactatcattatcacccggaaaa

SEQ ID NO: 46420 - RNA, 657 nt, synthetic construct
  misc_feature 1..657: note = derived and/or modified sequence opt6 from Milatuzumab_LightChain1
  source 1..657: mol_type = other RNA
gacatacaattaacacaatcaccactatcactacccgtaactttaggacaaccagcatcaatatcatgcagatcatcacaatcactagtacacagaaacggaaacacatacctacactggttccaacaaagaccaggacaatcaccaagactactaatatacacagtatcaaacagattctccggagtaccagacagattctcaggatcaggatcaggaacagacttcacactaaaaatatccagagtagaagcagaagacgtaggagtatacttttgctcacaatcatcacacgttccaccaacattcggagcaggaacaagattagaaataaaaagaacagtagcagcaccatcagtattcatattcccaccatcagacgaacaactaaaatcaggaacagcctcagtagtatgtctactaaacaacttctacccaagagaagcaaaagtacaatggaaagtagacaacgcactacaatcaggaaactcacaagaatccgtaacagaacaagactcaaaagactcaacatactccctatcatcaacactaacactatcaaaagcagattacgaaaaacacaaagtatacgcatgcgaagtcacacatcaaggcctaagctcaccagtaacaaaatcattcaacagaggagaatgt

SEQ ID NO: 46421 - RNA, 1341 nt, synthetic construct
  misc_feature 1..1341: note = derived and/or modified sequence opt6 from Mirvetuximab_HeavyChain1
  source 1..1341: mol_type = other RNA
caagtacaactagtacaatctggagccgaagtagttaaaccaggcgcatcagttaaaatatcatgcaaagcttctggatacacattcacaggatatttcatgaattgggttaaacaatcaccaggacaatcactagaatggatcggcagaatacacccatacgacggagacaccttctacaatcaaaaattccagggaaaagctacactaaccgttgataaaagttcaaacacagcacacatggaactactaagcctaacatccgaagacttcgcagtctactattgcacaagatacgacggatcaagagcaatggactactggggtcaaggaacaaccgtcaccgtctcatccgcttccaccaaaggaccctcagttttcccattagcaccatcaagtaaatcaacaagcggtggcacagcagcattaggatgccttgtaaaagactacttcccagaaccagttacagtatcatggaactcaggagcactaacatctggagtccatacattcccagcagtactacaaagttccggattatactcactatcatcagtagtcacagtaccatcatcctctttaggaacacaaacatatatatgcaatgtaaaccataaaccatcaaacaccaaagtcgacaaaaaagtagaacccaaatcatgtgataaaacacacacatgtccaccatgcccagcaccagaattactaggaggcccatcagtatttctattcccccccaaaccaaaagacacattaatgatctcaagaacccctgaagtaacatgcgtagtagttgacgtatcacacgaagacccagaagtaaaatttaactggtacgtagatggagtagaagttcacaacgcaaaaacaaaacctagagaagaacaatacaattccacgtaccgagttgtatctgtactcacagtattacatcaagattggctaaatggaaaagaatataaatgcaaagtatcaaataaagccctacccgcaccaatagaaaaaaccatatctaaagcaaaaggacaaccacgagaaccacaagtatacacactaccaccatcccgagatgaacttacaaaaaatcaagtatcactaacctgtctagtaaaaggattctacccttcagacatcgccgttgaatgggaatcaaatggccaaccagaaaacaactacaaaacaacaccaccagtcttagactcagacggatcattcttcctatactcaaaactcacagtagacaaatccagatggcaacaaggaaacgtattttcttgctcagtaatgcacgaagctcttcacaaccattacacacaaaaatcattatcactatcaccagga

SEQ ID NO: 46422 - RNA, 654 nt, synthetic construct
  misc_feature 1..654: note = derived and/or modified sequence opt6 from Mirvetuximab_LightChain1
  source 1..654: mol_type = other RNA
gacatcgtactaacacaatcaccattatcactagcagtatcactaggacaaccagcaataatatcatgcaaagcatcacaatcagtaagcttcgccggaacatcattaatgcactggtaccaccaaaaaccaggacaacaaccaagactattaatatacagagcatcaaacctagaagccggagtaccagacagattctcaggatcaggatcaaaaaccgacttcacattaacaatatcaccagtagaagcagaagacgcagcaacatactattgccaacaatcaagagaatatccatacacattcggaggcggaaccaaattagaaataaaacgcacagtagcagccccatcagtattcatcttcccaccatcagacgaacaattaaaatccggcacagcatcagtcgtctgcttattaaacaacttctacccaagagaagcaaaagtacaatggaaagtagataacgcactccaatcaggaaactcacaagaatcagtaacagaacaagacagcaaagactcaacatactcactatcctcaacactaacattatcaaaagctgactatgaaaaacataaagtatacgcatgcgaagtaacacaccaaggattatcatcaccagtaaccaaatcattcaacagaggagaatgc

SEQ ID NO: 46423 - RNA, 1344 nt, synthetic construct
  misc_feature 1..1344: note = derived and/or modified sequence opt6 from Modotuximab_HeavyChain1
  source 1..1344: mol_type = other RNA
caagtacaactacaacaacccggcgccgaactagtcgaacccggaggctccgtaaaattaagctgcaaagcatcaggctacacattcacctcccactggatgcattgggtaaaacaaagaccaggacaaggcctcgaatggataggagaaataaatccatcatcaggacgtaacaactacaatgaaaaattcaaatcaaaagcaacactaaccgtcgacaaatcatcttcaacagcatatatgcaattctcctccctaacatcagaagactcagcagtatattattgcgtacgctactatggatacgacgaagcaatggactactggggacaaggaacatctgttacagttagcagtgcatcaaccaaaggaccatcagtatttccactagcaccatcatcaaaatcaacatcaggtggaacagcagcactaggatgcctagtaaaagactacttcccagaaccagtaacagtatcatggaattctggagcactcacctctggcgtacacacattcccagcagtattacaatcatccggactttactcactatcatcagttgtaacagttccctcctcttccttaggaacacaaacatatatctgcaacgtaaaccacaaaccatcaaacacaaaagtcgacaaaagagtagaaccaaaatcttgcgataaaacacacacttgtccaccatgccccgcccctgaattactaggcggtccatcagtatttttattcccaccaaaacccaaagacacattaatgatttctcgaacacccgaagtaacatgcgtagtcgtagacgtatcccatgaagacccagaagtcaaatttaattggtatgtagacggagtagaagtacacaatgcaaaaacaaaaccaagagaagaacaatataactcaacatacagagtagtaagtgtattaacagtactccatcaagactggctaaatggaaaagaatataaatgcaaagtatcaaacaaagctttacccgcacccatagaaaaaacaatatcaaaagccaaaggacaaccacgagaaccccaagtatacacactaccaccctcaagagaagaaatgacaaaaaatcaagtatctctcacatgcttagtaaaaggattttatccatcagatatagctgtcgaatgggaatcaaatggacaacctgaaaataactataaaacaactcccccagtactcgactcagatggttccttcttcttatactcaaaactaacagtagacaaatcacgatggcaacaaggcaatgtctttagttgttcagtaatgcatgaagcgcttcataaccattatacacaaaaatcattatcactctcacctgga

SEQ ID NO: 46424 - RNA, 657 nt, synthetic construct
  misc_feature 1..657: note = derived and/or modified sequence opt6 from Modotuximab_LightChain1
  source 1..657: mol_type = other RNA
gacatagtaatgacacaagcagcattctcaaacccagtaacactaggaacatcagcatcaatatcatgcagatcatcaaaatcgctattacattcaaatggaataacatacttatactggtacctacaaaaacccggacaatcaccacaactattaatataccaaatgagcaatttagcatcaggagtaccagatagattctcatcatcaggatcaggaacagacttcaccctacgaatatcaagagtagaagcagaagacgtaggagtatactactgcgcacaaaacctagaattaccatacaccttcggaggaggcacaaaactagaaataaaacgaacggtcgcagcaccaagcgtattcatattcccaccatcagacgaacaactaaaatccggaacagcatcagtagtatgcttactaaacaatttctatccaagagaagccaaagtacaatggaaagtagacaacgcactacaatcaggaaactcacaagaatcagtaacagaacaagactcaaaagactcaacatactccctatcatctacactaacattaagcaaagcagactacgaaaaacacaaagtatacgcatgcgaagtaacacaccaaggattatcatcaccagtaacaaaatcattcaacagaggagaatgc

SEQ ID NO: 46425 - RNA, 1347 nt, synthetic construct
  misc_feature 1..1347: note = derived and/or modified sequence opt6 from Mogamulizumab_HeavyChain1
  source 1..1347: mol_type = other RNA
gaagtacaattagtagaatcaggcggagatctagtccaacccggtagatctctaagactatcctgcgcagcttcaggattcatattctcaaactacggaatgtcatgggtaagacaagccccaggtaaaggcctagaatgggtagcaacaatatcctctgcatcaacctattcctactaccccgattcagtaaaaggacgattcacaatatcacgcgacaacgcaaaaaactccttatatctacaaatgaactccctccgagtagaagacacagcattgtactactgtggacgtcattccgacggaaactttgcattcggatactggggacaaggaacattagtaaccgtttcttcagcatctacaaaaggaccgtcagtctttccactagcaccatcctcaaaatcaacatcaggaggcacagcagcacttggatgcttagtaaaagattattttccagaaccagtcacagtatcatggaattctggcgcactgacctcaggcgtacatacattccccgcagtactacaatcttcaggtttatatagcttatcttcagtagtaacagtaccatcatcaagtctaggcacacaaacctatatatgtaacgtaaaccataaaccatcaaacaccaaagtagataaaaaagtagaaccaaaatcctgcgacaaaacacatacatgtccaccatgcccagcacctgaactcctaggaggaccatccgtattcctatttccacccaaacctaaagataccttaatgatatctagaacaccagaagtcacatgcgtagtagtagacgtctctcacgaagacccagaagtaaaattcaactggtatgtagacggagtagaagtacacaacgccaaaaccaaaccaagagaagaacaatataactcaacatacagagtagtatccgttctaacagttctacatcaagattggctaaacggtaaagaatataaatgcaaagtttccaataaagcactacccgccccaatagaaaaaacaatatcaaaagcaaaaggacaacctagagaaccccaagtatatacattacccccctcaagagatgaattaacaaaaaaccaagtctccctcacctgcttagtaaaaggattttacccctccgacatagcagtcgaatgggaatctaatggacaacctgaaaataactataaaacaacaccacccgtcttagacagtgatggatcattctttttatactcaaaacttacagtagataaatcaagatggcaacaaggaaatgtattctcctgctctgttatgcacgaagcattacacaatcactacacccaaaaatccttatcactaagtccaggaaaa

SEQ ID NO: 46426 - RNA, 657 nt, synthetic construct
  misc_feature 1..657: note = derived and/or modified sequence opt6 from Mogamulizumab_LightChain1
  source 1..657: mol_type = other RNA
gacgtactaatgacacaatcaccactctcactaccagtaacaccaggagaaccagcatcaatatcatgcagatcatcaagaaacatagtacacataaacggagacacatacctagaatggtacctacaaaaaccaggacaatcaccacaactactaatctacaaagtatcaaacagattctcaggagtaccagacagattctcaggatcaggatcaggaacagactttacattaaaaatatcaagagtagaagcagaagacgtaggagtatactactgcttccaaggaagcctactaccatggacattcggacaaggaacaaaagtagaaataaaaagaacagtagcagcaccatcagtattcatcttccccccatcagacgaacaactaaaatcaggcacagcatcagtcgtatgcctattaaacaacttctacccaagagaagcaaaagtacaatggaaagtagacaacgcattacaatccggaaattcacaagaatcagtaacagaacaagacagcaaagactcaacatacagcctttcatctacactaacattatcaaaagcagactacgaaaaacacaaagtctacgcatgcgaagtaacacaccaaggactatcatcaccagtaacaaaatcattcaacagaggcgaatgc

SEQ ID NO: 46427 - RNA, 1356 nt, synthetic construct
  misc_feature 1..1356: note = derived and/or modified sequence opt6 from Monalizumab_HeavyChain1
  source 1..1356: mol_type = other RNA
caagtacaactcgtacaatcaggagctgaagtaaaaaaaccaggagcctcagtaaaagtatcatgtaaagcatcaggctatacattcacaagttattggatgaattgggtaagacaagcaccaggacaaggactcgaatggatgggtagaattgacccttacgattcagaaacacactatgcgcaaaaacttcaaggaagagtaacaatgaccactgacacatcaacaagcacagcatacatggaactaagatccttaagatccgacgacacagcagtatattactgtgccagaggcggatatgatttcgacgtaggcaccttatactggttcttcgatgtatggggacaaggaacaacagtcactgtctcatccgcatccacaaaaggcccatccgtatttccactagcaccatgttcacgatctacatcagaatccactgcagcactcggatgcctcgtcaaagactacttcccagaaccagtaacagtatcatggaactcaggagcactcacttctggagtacatacatttcctgcagtgctccaatcatctggactatactcactctcaagcgtagttacagtaccatcatcatccctaggaacaaaaacctatacatgtaacgtagaccataaaccttcaaatacaaaagtagacaaaagagtagaatccaaatacggaccaccatgccctccttgccctgcaccagaattccttggcggaccatcagtatttttatttcccccaaaacctaaagatacattaatgatatcaagaacaccagaagtaacatgcgtagtcgtcgatgtctctcaagaagacccagaagtacaattcaactggtatgtagacggagttgaagtacacaatgcaaaaactaaaccaagagaagaacaatttaatagtacataccgtgtcgtatcagtcctcactgtattacatcaagattggttaaacggaaaagaatataaatgtaaagtaagtaataagggactaccctcatcaatagaaaaaacaataagtaaagctaaaggacaaccaagagaaccacaagtatacacattaccaccatcacaagaagaaatgacaaaaaatcaagtatcattaacatgtcttgtaaaaggattttacccatcagatatagcagtagaatgggaatctaacggacaaccagaaaataactataaaactacaccaccagtcttagatagcgatggctccttttttctatactcacgactaacagtagataaatcaagatggcaagaaggaaacgtattttcatgtagcgtcatgcacgaagcactacataaccattacacacaaaaatcattatcactatcattaggaaaa

SEQ ID NO: 46428 - RNA, 642 nt, synthetic construct
  misc_feature 1..642: note = derived and/or modified sequence opt6 from Monalizumab_LightChain1
  source 1..642: mol_type = other RNA
gacatacaaatgacacaatcaccatcatcactatcagcatcagtaggagatcgagtaacaatcacatgcagagcatcagaaaacatatactcatacctagcatggtaccaacaaaaaccaggcaaagcacccaaactcctaatatacaacgcaaaaacactagcagaaggagtaccatcaagattctcaggatcaggatcaggaacagacttcacactaacaatatcatcactacaaccagaagacttcgcaacatactactgccaacaccactatggaacaccaagaacattcggaggaggaacaaaagtagaaataaaaagaacagtagcagcaccatcagtattcatattcccaccatcagacgaacaactaaaatccggaaccgcatcagtagtatgcctactcaacaacttctacccaagagaagcaaaagtacaatggaaagtagacaacgcactacaaagcggaaactcccaagaaagcgtaacagaacaagacagcaaagactcaacatactcactatcatcaacactaacactatcaaaagcagactacgaaaaacacaaagtatatgcatgcgaagtaacacaccaaggcctatcatcaccagtaacaaaatcctttaacagaggagaatgc

SEQ ID NO: 46429 - RNA, 1350 nt, synthetic construct
  misc_feature 1..1350: note = derived and/or modified sequence opt6 from Motavizumab_HeavyChain
  source 1..1350: mol_type = other RNA
caagtcacattacgagaatcaggccctgcattagtcaaacccacacaaacattaacactaacatgcacattcagcggattctctctatcaacagcaggaatgtcagtaggatggataagacaaccacctggtaaagcattagaatggctagcagacatatggtgggacgacaaaaaacactataacccttcactaaaagatagactaacaatatcaaaagacacatcaaaaaatcaagttgtactaaaagtaacaaacatggaccccgcagacacagcaacatactactgtgcacgagacatgatattcaacttctacttcgatgtatggggccaaggcacaacagtaacagtctcatcagcatccaccaagggaccgagcgtattcccacttgcaccaagcagtaaatcaacttcaggaggcacagcagcattaggctgcctagtaaaagactacttcccagaacctgtaacagtctcatggaactcaggcgccctaacatcaggagtacacacatttccagccgtactacaatcatcaggattatactcattatcctccgtagtaacagtaccatcctcctctctaggaacacaaacctatatatgcaatgttaatcacaaaccatcaaatacaaaagtcgataaaagagtagaaccaaaaagttgtgacaaaacacatacatgcccaccatgccccgcaccagaattactaggcggaccttcggtattcctcttcccaccaaaaccaaaagatacacttatgataagccgtacaccagaagtcacatgtgtagtagtagacgtctcacacgaagatcccgaagtaaaattcaactggtacgtagatggagtcgaagtacataatgctaaaactaaaccaagagaagaacaatacaactccacatacagagtagtatccgtactaacagtactccatcaagactggctaaacggaaaagaatataaatgcaaagtatcaaacaaagcactacccgcaccaatagaaaaaactatatctaaagcaaaaggacagccaagagaaccacaagtatacacactacccccatcaagagaagaaatgacaaaaaaccaagtatcactcacctgcctagtaaaaggcttctacccatcagatattgcagtcgaatgggaaagtaacggacaaccagaaaacaactacaaaaccacaccaccagtactagacagcgacggatcattcttcctatactcaaaactaactgtagacaaatctagatggcaacaaggcaatgtcttctcatgttcagtaatgcacgaagccttacataatcactacacacaaaaatccttatcactatcaccaggaaaa

SEQ ID NO: 46430 - RNA, 1350 nt, synthetic construct
  misc_feature 1..1350: note = derived and/or modified sequence opt6 from Motavizumab_HeavyChain_variant
  source 1..1350: mol_type = other RNA
caagtaacattaagagaaagcggacccgcattagtaaaaccaacacaaactctaacactaacatgcacattctcaggcttttcattatccactgcaggaatgtcagtaggatggatccgacaaccaccaggtaaagcactcgaatggttagcagacatatggtgggatgacaaaaaacattataacccatcactaaaagaccgattaactataagcaaagatacatccaaaaaccaagtagtcttaaaagtcaccaacatggacccagccgacacagcaacatattactgtgcaagagatatgatattcaatttctacttcgatgtctggggacaaggcacaacagtcaccgtatcatccgcatcaaccaaaggacccagtgtcttccctctagcaccatcatctaaaagtacatcaggaggtacagccgcacttggatgtttagtaaaagactatttcccagaaccagtaacagtatcatggaactcaggagcactaacatcaggagttcatacatttcctgcagtactccaaagctcaggcctttactcactatccagtgtagtaacagtaccatcaagctcactaggaacccaaacatacatctgtaacgtcaaccacaaaccatcaaatacaaaagttgacaaaagagtagaaccaaaatcatgcgacaaaactcacacatgccctccatgccctgctcctgaactattaggcggtccatccgtatttctcttcccacccaaaccaaaagatacactaatgatatcaagaacaccagaagtaacatgcgtagtagtagacgtatcacacgaagatccggaagtaaaattcaactggtatgtagatggagttgaagtccacaacgcaaaaacaaaaccacgcgaagaacaatacaactcaacatatagagtagtttcagtattaactgtactacatcaagattggctaaacggaaaagaatataaatgcaaagtttcaaacaaagcactaccagcaccaatagaaaaaacaatatcaaaagcaaaaggacaaccaagagaaccccaagtatacactctaccaccaagtcgagaagaaatgactaaaaaccaagtttcattaacctgcctagtaaaaggattctacccctctgacattgctgtagaatgggaaagcaacggacaaccagaaaacaactacaaaacaacacccccagtcctcgactcagatggatcattcttcttatactcaaaactaacagtagataaatcaagatggcaacaaggtaacgtattctcatgctctgtaatgcacgaagcattacacaatcattacacacaaaaaagtttatccttaagcccaggtaaa

SEQ ID NO: 46431 - RNA, 639 nt, synthetic construct
  misc_feature 1..639: note = derived and/or modified sequence opt6 from Motavizumab_LightChain
  source 1..639: mol_type = other RNA
gacatacaaatgacccaatccccatcaacattatcagcatcagtaggagacagagtaacaataacatgctccgcatcatcaagagtcggatacatgcactggtaccaacaaaaaccaggaaaagcaccaaaattactaatctacgatacatcaaaattagcatccggagtaccatcaagattctcaggatcaggatcaggaacagaattcacactaacaataagctcactacaaccagacgatttcgcaacatactactgcttccaaggatccggatacccattcacattcggaggaggaacaaaagtagaaataaaacgaacagtagcagcaccatcagtattcatattcccaccatccgacgaacaactaaaatcaggaaccgcctcagtagtatgcctactaaataacttctacccaagagaagcaaaagtacaatggaaagtagacaacgcattacaatcaggaaattcacaagaatccgtaacagaacaagactcaaaagactcaacatacagcttatcctcaaccttaacactatcaaaagcagactacgaaaaacacaaagtatacgcatgcgaagtaacacaccaaggcttatcatcaccagtaacaaaatcattcaacagaggagaatgc

SEQ ID NO: 46432 - RNA, 639 nt, synthetic construct
  misc_feature 1..639: note = derived and/or modified sequence opt6 from Motavizumab_LightChain_variant
  source 1..639: mol_type = other RNA
gacatacaaatgacacaatcaccatccacactatcagcatcagtaggagacagagtaacaataacatgctcagcatcatcaagagtaggatacatgcactggtaccaacaaaaaccaggaaaagcccccaaactactaatatacgacacatcaaaactagcatctggagtaccatcaagattctcaggatcaggatcaggaacagaattcacactaacaatatcctcattacaaccagacgacttcgcaacatactactgcttccaaggatccggatacccattcacattcggaggaggaaccaaagtagaaataaaaagaacagtagcagctccatctgtattcatattcccaccatcagacgaacaactaaaatcaggaacagcatcagtagtatgcctattaaacaacttctacccacgcgaagcaaaagtacaatggaaagtagataacgccttacaatcaggaaactcacaagaatcagtaaccgaacaagactccaaagattctacatactcattatcatcaacactaacactatcaaaagcagactacgaaaaacacaaagtatacgcatgtgaagtaacacaccaaggcctatcatcacctgtaacaaaatcattcaaccgaggagaatgt

SEQ ID NO: 46433 - RNA, 1428 nt, synthetic construct
  misc_feature 1..1428: note = derived and/or modified sequence opt6 from Moxetumomab_pasudotox_HeavyChain1
  source 1..1428: mol_type = other RNA
atggaagttcagttagtagaatcaggaggaggattagtaaaaccaggaggtagtctaaaattaagctgtgccgcatcgggttttgcattttcaatttatgatatgtcatgggtaagacaaacacccgaaaaatgtttagaatgggtagcatatataagttcaggtggaggaacgacttactacccagacactgtaaaaggtagatttacaatatctcgagataatgcaaaaaatacattatacttacaaatgtcaagtttaaaatccgaagatacagcaatgtactattgcgcaagacattcaggatatggaacacattggggagttttatttgcatattggggacaaggaacgctagtaactgttagtgcaaaagcaagtggtggaccagaaggtggatcattagcagcattgactgcacaccaagcatgtcacttaccacttgaaacatttacaagacatcgacaaccacgaggatgggaacaactagagcaatgtggatatcctgtacaaagattagtagcattatacttagcagcaagactaagttggaatcaagtcgatcaagtaattaggaatgcactagcaagtccaggatcaggtggcgacctaggagaagctataagagaacaaccagaacaagcacgactagcactaacattagctgcggcagaatcagaaagatttgttagacaaggaacaggaaacgatgaagccggggcagcaaacggacctgcagacagtggagacgcattactagaaagaaattatccaacaggagcagaatttttaggagatggaggagatgtaagtttttcaacaagaggaactcagaattggacagtagaaagactactacaagcacatagacaattagaagaaagaggttatgtattcgtaggatatcatggaacatttctcgaagctgcacaaagtatagtatttggcggagtaagagctagaagtcaagatttagatgcaatatggaggggattttatatcgcaggagatccagcattagcatatggatatgcacaagatcaagaaccagacgctagaggtagaataagaaatggagcacttttaagagtatatgtaccaagaagttcacttccaggtttttatagaacatcgttaactttagcagcaccagaagcagcaggagaagtagaacgactaattggacatccactacctctcagattagatgcgataacaggcccagaagaagaaggaggaagactagaaactatcttaggatggccacttgcggaaagaactgtagtaataccttcagcaatacctacagatccaagaaatgtaggaggtgacttagatccaagctcaatacccgataaagagcaagcaatatcagcattaccagattatgcaagtcaacctggaaaacctccaagagaagatttaaaa

SEQ ID NO: 46434 - RNA, 324 nt, synthetic construct
  misc_feature 1..324: note = derived and/or modified sequence opt6 from Moxetumomab_pasudotox_LightChain1
  source 1..324: mol_type = other RNA
atggacatacaaatgacacaaacaacatcatcactatcagcatcactaggagacagagtaacaatatcatgcagagcatcacaagacatatcaaactacctaaactggtaccaacaaaaaccagacggaacagtaaaactactaatatactacacatcaatactacactcaggagtaccatcaagattctcaggatcaggatcaggaacagactactcactaacaatatcaaacctagaacaagaagacttcgcaacatacttctgccaacaaggaaacacactaccatggacattcggatgcggaacaaaactagaaataaaa

SEQ ID NO: 46435 - RNA, 1350 nt, synthetic construct
  misc_feature 1..1350: note = derived and/or modified sequence opt6 from Muromonab-CD3_HeavyChain
  source 1..1350: mol_type = other RNA
caagtacaactacaacaatcaggtgctgaactagcaagaccaggagcatcagtaaaaatgtcatgcaaagccagcggatacacattcacaagatatacaatgcactgggtaaaacaaagaccaggacaaggcctagaatggatcggatacataaacccatctagaggatacacaaattacaaccaaaaattcaaagacaaagcaacacttactaccgacaaatcatcaagtaccgcatacatgcaactatcctcactaacatcagaagactcagctgtatattactgcgcaagatactacgatgatcactactgtctagactactggggacaaggaaccaccctaacagtatcctcagctaaaacaactgcaccaagtgtatatccactagcaccagtatgcggaggaacaacaggatcctctgtaactctaggctgcctagtaaaaggatatttccctgaaccagtaacactaacttggaactcaggatcactatcctcaggagtacacacattcccagctgtactccaatctgacttatacacactatcatcatcagtaacagtaacttcatcaacatggccatctcaatcaatcacctgcaacgtagcccatcctgcatcatcaacaaaagtagacaaaaaaatagaaccaagaccaaaatcatgtgacaaaacacacacatgtcccccttgtcccgcaccagaactactaggaggaccatcagtattcttattccccccaaaaccaaaggacactttaatgataagccgtaccccagaagtaacatgcgtagtagtggacgtatcccacgaagaccctgaagtaaaattcaattggtacgtcgatggagtagaagttcacaacgcaaaaactaaaccaagagaagaacaatataattccacataccgagtagtatcagtactaactgtcctacaccaagactggctaaatggaaaagaatataaatgcaaagtctcaaacaaagcattaccagccccaatagaaaaaacaataagcaaagcaaaaggacaacccagagaaccccaagtatatacattaccaccatccagagatgaactaacaaaaaaccaagtatcactaacctgcctagtaaaaggcttctacccaagcgacatagcagtagaatgggaatctaacggacaaccagaaaataattataaaacaacacccccagtactagactccgacggatctttctttctttattcaaaactaaccgttgacaaatcaagatggcaacaaggtaatgtattctcatgctctgtaatgcatgaagccctccacaaccactacacccaaaaatcattatcattatcaccaggaaaa

SEQ ID NO: 46436 - RNA, 639 nt, synthetic construct
  misc_feature 1..639: note = derived and/or modified sequence opt6 from Muromonab-CD3_LightChain
  source 1..639: mol_type = other RNA
caaatagtcctcacacaatcaccagcaatcatgtcagcatcaccaggagaaaaagtaacaatgacatgttcagcatcatcatcagtatcatacatgaactggtaccaacaaaaatcaggaacttcaccaaaaagatggatatacgacacatcaaaattagcatcaggagtaccagcacacttcagaggatcaggatcaggaacatcatattccctaacaatatcaggaatggaagcagaagatgcagcaacatactactgtcaacaatggtcatcaaacccatttacattcggatcaggaacaaaactagaaataaacagagccgacacagcaccaacagtatccatattcccaccctcatcagaacaattaacatcaggaggagcatctgtagtatgcttcctaaacaacttctacccaaaagacataaacgtaaaatggaaaatagacggatcagaaagacaaaacggagtactaaactcatggacagaccaagactcaaaagactcaacatactcaatgtcatcaacactaacactaacaaaagacgaatacgaaagacataactcatacacatgcgaagcaactcacaaaacatcaacaagcccaatagtaaaatcattcaacagaaatgaatgt

SEQ ID NO: 46437 - RNA, 1347 nt, synthetic construct
  misc_feature 1..1347: note = derived and/or modified sequence opt6 from Namilumab_HeavyChain1
  source 1..1347: mol_type = other RNA
caagtccaactagtacaatcaggagctgaagttaaaaaacccggtgcatccgtaaaagtatcttgcaaagcatttggctacccatttacagactatctacttcattgggtacgccaagcaccaggacaaggattagaatgggtaggatggctaaacccttatagcggagataccaactacgctcaaaaattccaaggaagagtaacaatgacaagagatacatcaatctccacagcatacatggaactttctagattacgctctgacgacacagccgtctattactgtacaagaacaacactaatatcagtatacttcgattactggggacaaggaaccatggtcacagtatcatcagcatcaaccaaaggtccatcagtcttcccacttgccccatcttcaaaatcaacttctggaggaacagcagccctaggatgcttagtaaaagattacttccccgaaccagtcaccgtatcatggaacagcggtgcactaacttcaggagtacacacattcccagcagtcttacaatcttcaggattatactctctatcatcagtagtcaccgtaccatcatcctcactaggaacacaaacctacatatgcaatgtaaaccataaaccatccaatacaaaagtagataaaaaagttgaaccaaaaagttgcgacaaaacacatacttgtccaccttgtccagccccagaattattaggcggaccttcagtattcctatttccacctaaaccaaaagacacccttatgatatcaagaacccctgaagtaacatgcgttgtagtcgacgtttctcacgaagacccagaagtcaaattcaactggtacgtagacggagtagaagtacacaacgcaaaaacaaaacccagagaagaacaatacaactcaacatatagagtagtctctgtattaaccgtactccaccaagactggctaaatggtaaagaatacaaatgcaaagtatccaataaagcactaccagcaccaatcgaaaaaactatttcaaaagccaaaggtcaacctagagaacctcaagtatacacactacccccctcacgtgacgaattaacaaaaaaccaagtatctctaacgtgtctggtaaaaggattctacccatctgatattgcagtagaatgggaatcaaacggccaaccagaaaataactataaaacaactccacctgtattagactctgacggctcattcttcttatattcaaaactaacagtagacaaatcaagatggcaacaaggaaacgtattctcttgctcagtaatgcacgaagcattacacaatcattacacacaaaaatccttatcactcagcccaggaaaa

SEQ ID NO: 46438 - RNA, 642 nt, synthetic construct
  misc_feature 1..642: note = derived and/or modified sequence opt6 from Namilumab_LightChain1
  source 1..642: mol_type = other RNA
gacatacaaatgacacaatcaccatcatcagtatcagcatcagtaggagacagagtaacaatagcctgcagagcctcacaaaacataagaaatatattaaactggtaccaacaaagaccaggaaaagcaccccaactattaatatatgccgcatcaaacctacaatcaggagtaccatccagattctcaggatcaggatcaggaacagacttcacattaacaataaactcactacaaccagaagacttcgccacatattactgccaacaatcatactcaatgccaagaacattcggtggaggaacaaaactagaaataaaaagaacagtcgcagcaccatcagtattcatattcccaccatcagacgaacaactaaaatcaggaacagcctcagtagtatgcctactaaacaacttttacccaagagaagcaaaagtacaatggaaagtagacaacgcactccaatcaggaaattcacaagaatcagtaacagaacaagactcaaaagactcaacatactcactatcatctacactaacactatcaaaagcagactacgaaaaacacaaagtatacgcatgcgaagtaacacaccaaggattaagttcaccagtaaccaaatcatttaacagaggcgaatgt

SEQ ID NO: 46439 - RNA, 1374 nt, synthetic construct
  misc_feature 1..1374: note = derived and/or modified sequence opt6 from Naptumomab_estafenatox_HeavyChain
  source 1..1374: mol_type = other RNA
gaagtccaactacaacaatcaggaccagatcttgtaaaaccaggtgcatcagttaaaatatcatgtaaagcctccggatactcatttactggatactatatgcattgggtcaaacaatcgcccggaaaaggactagaatggataggtagaatcaatcccaataacggagtcactctttataaccaaaaatttaaagacaaagcaacactaacagtagacaaatcatcaacaacagcatacatggaactacgttctctaacatcagaagatagcgcagtctattactgcgcaagatcaacaatgataactaactacgtaatggattactggggacaaggaacaagcgtaacagtttcatcagcaaaaacaacacccccatcagtatacccactcgcacctggatcagcagcccaaacaaactcaatggtaacactaggttgcctagtaaaaggatacttcccagaaccagtcactgtcacctggaacagtggatcattatcatcaggagtacacacatttccagcagtactacaatcagacctctataccctatcctcttccgtaacagtaccatcatccacatggccctcagaaaccgtaacatgcaacgtcgcacacccagcttcatcaacaaaagtcgacaaaaaaatagtacctagagactctggaggaccctctgaaaaatccgaagaaataaatgaaaaagacttacgcaaaaaatcagaactacaaggtactgcactaggtaacctaaaacaaatatactactataattcaaaagcaataacctcatctgaaaaatcagctgaccaatttctaactaacacattattatttaaaggattcttcacaggacatccatggtacaatgacctactagtagacctaggatcaacggcagccacatcagaatacgagggatcctcagtagacttatatggagcctattatggataccaatgcgcaggcggcacaccaaataaaacagcatgcatgtacggaggagtcacacttcacgacaataaccgattaacagaagaaaaaaaagtacccataaacctatggattgatggaaaacaaacaacagtaccaattgacaaagtaaaaacatccaaaaaagaagtcacagtacaagaactagacttgcaagcacgacactacttacacggaaaattcggtctatataattcagattcatttggaggaaaagtccaaagaggattaatagtatttcactcatcagaaggatcaacagtatcatatgatctatttgacgcacaaggacaatatccagacactctactcagaatctaccgagataacaccacaatatcatccacatcactatcaataagtctatatctctacacaact

SEQ ID NO: 46440 - RNA, 642 nt, synthetic construct
  misc_feature 1..642: note = derived and/or modified sequence opt6 from Naptumomab_estafenatox_LightChain
  source 1..642: mol_type = other RNA
tccatagtaatgacacaaacaccaacatcactattagtatcagcaggagacagagtaacaataacatgcaaagcatcacaatccgtatcaaacgacgtagcctggtaccaacaaaaacccggacaatcacccaaattactaatatcctacacaagctcaagatacgcaggagtaccagacagattctcaggatcaggatatggaacagacttcacactaacaatatcatcagtacaagcagaagacgcagccgtatacttctgccaacaagattataactcaccaccaacattcggaggaggaacaaaactagaaataaaaagagcagacgcagcaccaacagtaagcatattcccaccatcatcagaacaattaacatcaggaggagcatcagtagtatgcttcctaaacaacttttacccaaaagacataaacgtaaaatggaaaatcgacggatcagaaagacaaaatggagtactaaactcatggacagatcaagactcaaaagactcaacatactcaatgtcatcaacactaaccctaaccaaagacgaatacgaaagacacaactcatacacatgcgaagcaacacataaaacatcaacatcacctatagtaaaatcatttaacagaaatgaaagc

SEQ ID NO: 46441 - RNA, 1356 nt, synthetic construct
  misc_feature 1..1356: note = derived and/or modified sequence opt6 from Narnatumab_HeavyChain1
  source 1..1356: mol_type = other RNA
gaagtacaacttgtagaatcaggcggaggccttgtccaacctggcggatcactaagattatcatgtgcagcttcaggattcactttttcatcatatctaatgacatgggtacgacaagcacctggaaaaggtctagaatgggttgctaacatcaaacaagatggctcagaaaaatactatgtagactctgtcaaaggaagattcaccatatcccgcgataacgcaaaaaactctttaaaccttcagatgaactcattaagagcagaagacacagcagtatactactgcacaagagatggttactcatcaggaagacattacggaatggatgtctggggacaagggacaacagtaatagtatcctcagcatcaacaaaaggaccatcagtatttccattagcaccatcttcaaaatcgacatctggaggtacagctgcactaggatgcttagtaaaagactatttcccagaaccagtaactgtatcatggaactcaggcgctctcacatcaggtgtacacaccttccctgcagtattacaatcctcaggactatattcactctcatcagtagtaacagtcccatcatcatccctaggaacccaaacatatatatgtaacgtaaaccacaaaccatcaaacaccaaagtagacaaaagagttgaaccaaaatcctgcgacaaaactcacacttgtccaccttgtcctgccccagaattactaggaggaccatccgtatttctattcccaccaaaaccaaaagatacattaatgatatctagaacaccagaagtaacctgcgtagtcgtagacgtatcacacgaagacccagaagtaaaattcaattggtacgtagacggcgtagaagtccacaatgcaaaaacaaaaccacgagaagaacaatacaacagtacatacagagtagtatcagtcctaacagtactacaccaagactggttaaacggcaaagaatataaatgcaaagtatcaaataaagcactcccagcaccaattgaaaaaactatatcaaaagctaaaggccaacctcgagaaccacaagtatatacccttccaccctccagagaagaaatgaccaaaaatcaagtatcattaacatgtttagttaaaggcttctacccatcagatatcgcagttgaatgggaatcaaatggacaaccagaaaataattacaaaactacaccaccagtactcgactcagatggatcattcttcttatactcaaaattaacagtagacaaatcaagatggcaacaaggcaacgttttctcatgtagcgttatgcatgaagcattacacaaccattatacccaaaaatcactatctctatccccgggaaaa

SEQ ID NO: 46442 - RNA, 642 nt, synthetic construct
  misc_feature 1..642: note = derived and/or modified sequence opt6 from Narnatumab_LightChain1
  source 1..642: mol_type = other RNA
gaaatagtactaacacaatcacccgcaacattatcattatcaccaggagaaagagcaacattatcatgcagagcaagccaatcagtatcaagatacttagcatggtaccaacaaaaaccaggacaagcaccaagactattaatatacgacgcatcaaacagagcaacaggaataccagcaagattctcaggatcaggatcaggcacagatttcaccctaacaatatcatcactagaaccagaagacttcgcagtatactactgccaacaaagatcaaactggccaagaacattcggacaaggaacaaaagtagaaataaaacgcacagtagcagcacccagcgtattcatatttccaccctcagacgaacaattaaaatcaggaacagcatcagtagtatgcctactaaacaacttctacccacgagaagcaaaagtccaatggaaagtagacaatgcactacaatcaggtaattcacaagaatcagtaacagaacaagactcaaaagactcaacatattcactatcctcaacattaacattatcaaaagcagactacgaaaaacacaaagtatacgcatgcgaagtaacacaccaaggattatcatcaccagtaacaaaaagcttcaacagaggagaatgc

SEQ ID NO: 46443 - RNA, 1350 nt, synthetic construct
  misc_feature 1..1350: note = derived and/or modified sequence opt6 from Natalizumab_HeavyChain1
  source 1..1350: mol_type = other RNA
caagtccaattagtacaatcaggagccgaagtcaaaaaacctggagcatcagtaaaagtttcatgcaaagcatcaggcttcaatataaaagacacatacatacactgggtacgtcaagcaccaggacaaagattagaatggatgggccgtatagatccagccaacggatacacaaaatatgatccaaaatttcaaggcagagtaacaattacagctgatacttccgcatcaacagcatacatggaattatcctcactaagatcagaagacacagcagtctattattgcgcaagagaaggatactatggtaattacggagtatacgcaatggattactggggccaaggaacactagtaacagtttcatccgcatcaacaaaaggaccatccgtattcccactagccccatgctccagatcaacatcagaatcaacagcagcacttggttgcctagtcaaagactactttccagaaccagtaaccgtcagctggaattcaggagcactaacatcaggagtccacacattcccagcagtattacaatcatcaggattatactcactatcatcagtagtaacagtaccttcatcatctctaggcacaaaaacctatacatgtaacgtagaccacaaaccaagtaatacaaaagtagataaacgagtcgaatccaaatacggccccccatgcccatcctgcccagctccagaatttttaggcggcccatctgtatttctatttcctcccaaaccaaaagatacattaatgatatccagaacaccagaagtaacatgcgtagtcgttgacgtatcacaagaagacccagaagtacaatttaactggtacgttgacggcgtagaagtacacaatgcaaaaacaaaacccagagaagaacaattcaactcaacatacagagtagtttcagtactaacagtcttacatcaagactggttaaacggaaaagaatataaatgcaaagttagtaataaaggactcccatcatccatagaaaaaacaatatcaaaagctaaaggtcaaccaagagaaccacaagtctacacactccccccttcacaagaagaaatgaccaaaaatcaagtatccctaacatgtttagtaaaaggattctacccatcagatatcgcagttgaatgggaaagcaacggacaaccagaaaacaactataaaacaacacccccagtactagactcagatggatcattttttctatattcaagactaacagtagacaaatccagatggcaagaaggaaacgtattctcatgtagcgtaatgcacgaagcactacataaccactatacacaaaaaagcttatcactctcactaggaaaa

SEQ ID NO: 46444 - RNA, 639 nt, synthetic construct
  misc_feature 1..639: note = derived and/or modified sequence opt6 from Natalizumab_LightChain1
  source 1..639: mol_type = other RNA
gacatacaaatgacacaatcaccatcatcactctcagcatcagtaggagacagagtaacaataacatgcaaaacatcccaagacataaacaaatacatggcatggtaccaacaaacaccaggaaaagcaccaagactactaatacactacacatcagcactacaaccaggaataccatcaagattctcaggatccggaagcggacgagactacaccttcacaatatcatcactacaaccagaagacatagcaacctactactgcctacaatatgacaacctatggacattcggacaaggaacaaaagtagaaataaaaagaacagtagcagccccatcagtattcatattcccaccatccgacgaacaattaaaatccggcacagcatccgtagtatgcctactcaataacttctacccaagagaagcaaaagtacaatggaaagtagacaacgcattacaatcaggaaactcccaagaatccgtaacagaacaagattcaaaagactcaacatactcactatcatctacactaacactatcaaaagcagactacgaaaaacataaagtatacgcatgcgaagtaacacaccaaggactatcatcaccagtaacaaaatcattcaacagaggagaatgc

SEQ ID NO: 46445 - RNA, 1335 nt, synthetic construct
  misc_feature 1..1335: note = derived and/or modified sequence opt6 from Navicixizumab_HeavyChain1
  source 1..1335: mol_type = other RNA
caagtacaattagtacaatccggagcagaagtaaaaaaaccaggagcatcagtaaaaatatcatgtaaagcatcaggatactccttcacagcatactacatacactgggtaaaacaagcaccaggacaaggactcgaatggattggatacatatcaaattacaaccgagcaaccaattacaatcaaaaatttaaaggaagagtaacttttaccacagacacatcaacttcaacagcatatatggaacttcgatcactaagaagtgatgatacagcagtatattactgtgcgagagactatgactatgatgtaggaatggattactggggacaaggaacactagtaacagtatcaagtgcctcaactaaaggtccttctgtattccctctagcaccttgttccagatcaacttcagaatcaacagccgcattaggatgcctagtaaaagactactttccagaaccagtaacagttagttggaactcaggagccctaacatcaggagtacatacatttcctgccgttctacaatcatcaggattatattccctctcctctgtagtaactgtaccatcctcaaatttcggcacacaaacctacacatgtaacgtagaccacaaacctagtaatacaaaagtagacaaaaccgtagaaagaaaatgctgcgtagaatgcccaccatgtccagcaccaccagtagcaggaccctcagtattccttttcccaccaaaacccaaagacacactaatgatatcaagaacaccagaagtaacatgcgtagtcgtagacgtatctcacgaagaccccgaagtacaattcaattggtacgttgacggcgtagaagtccataatgctaaaacaaaaccacgagaagaacaattcaactcaacctttcgcgtagtctcagtactaactgtcgtacaccaagattggttaaacggaaaagaatataaatgcaaagtatccaacaaaggactacccgcaccaatcgaaaaaacaatatcaaaaacaaaaggacaaccacgagaaccacaagtatacacactaccaccctcaagagaagaaatgacaaaaaaccaagtctctctaacatgcttagtagaaggcttttacccatcagacatagccgtagaatgggaatcaaatggacaaccagaaaataactacaaaacaacaccaccgatgttagactccgacggttctttcttcctatactcagaattaacagtcgacaaaagtcgttggcaacaaggaaacgtattttcatgttcagtaatgcatgaagccctacacaaccactatacacaaaaatctctttcattatcacccggaaaa

SEQ ID NO: 46446 - RNA, 1341 nt, synthetic construct
  misc_feature 1..1341: note = derived and/or modified sequence opt6 from Navicixizumab_HeavyChain2
  source 1..1341: mol_type = other RNA
caagtacaactcgtacagtcaggagcagaagtcaaaaaaccaggagcatcagtcaaagtatcatgcaaagcctccggatacacattcacaaattactggatgcattgggtacgacaagcaccaggacaaggactagaatggatgggagatatcaacccatcaaacggtagaacatcttataaagaaaaattcaaaagacgagtaactctatccgtagacaaatcatcttcaacagcatacatggaactatcatccttacgctcagaagataccgcagtttatttctgtacaatccactacgacgataaatattatccattaatggattattggggacaaggaacacttgtaacagtatcctcagcttcaacaaaaggtccatctgtatttccactcgcaccatgctcaagaagcacaagtgaatctaccgccgccctcggatgccttgtaaaagattacttcccagaaccagtaacagtatcttggaactcaggcgctctaacatcaggagtacacacattccccgcagtattacaatcatcaggactatattccctatcctcagtagtaacagtaccatcatccaattttggaactcaaacatacacctgcaacgtagaccataaaccctcaaacacaaaagttgataaaacagtagaaagaaaatgctgcgtagaatgcccaccatgtccagctccacccgtagcaggcccatcagtctttctcttcccacccaaacccaaagacacacttatgatatctagaacacccgaagtaacatgcgtagtagtagatgtatcccacgaagacccagaagtacaattcaactggtacgtcgatggagtagaagtacataatgcaaaaaccaaacccagagaagaacaattcaactcaaccttccgcgtagttagcgttctaacagtagtacatcaagactggctaaacggaaaagaatataaatgtaaagtatccaacaaaggcttaccagctccaatagaaaaaacaatatctaaaacaaagggacaaccaagagagccccaagtatatacactaccacccagccgcgaaaaaatgaccaaaaaccaagtatcattaacatgtttagtaaaaggattctatccatcagatatagcagtcgaatgggaatccaatggacaaccagaaaacaactacaaaacaacaccacctatgttaaaatctgacggatccttctttttatattcaaaattaaccgtagataaatcccgatggcaacaaggaaatgtattttcatgttcagtcatgcatgaagccctacataatcactatacacaaaaatcactatcactatcccctggaaaa

SEQ ID NO: 46447 - RNA, 654 nt, synthetic construct
  misc_feature 1..654: note = derived and/or modified sequence opt6 from Navicixizumab_LightChain1
  source 1..654: mol_type = other RNA
gatatcgtaatgacacaatcaccagacagcttagcagtatcattaggagaaagagcaacaatatcatgtcgagcaagcgaaagcgtagacaattacggaatatcattcatgaaatggttccaacaaaaaccaggacaaccaccaaaattattaatatatgcagcaagcaatcaaggaagcggtgtacctgacagattctcaggatcaggatcaggaacagactttacattaaccataagctcactacaagcagaagacgtagccgtatactattgccaacaatcaaaagaagtaccatggacattcggaggaggaacaaaagtagaaataaaacgaacagtagcagcaccaagcgtattcatattcccaccttcagacgaacaattaaaatcaggaacagcatcagtagtatgcctactaaataacttctacccaagagaagcaaaagtacaatggaaagtcgataacgcactacaaagcggaaactcacaagaatcagtaacagaacaagatagcaaagactcaacctatagcctaagttcgacactaacattaagcaaagcagattatgaaaaacataaagtctacgcatgcgaagtaacacaccaaggcttaagctcaccagtaacaaaaagctttaacagaggagaatgt

SEQ ID NO: 46448 - RNA, 1368 nt, synthetic construct
  misc_feature 1..1368: note = derived and/or modified sequence opt6 from Navivumab_HeavyChain1
  source 1..1368: mol_type = other RNA
caagtccaactcgtacaatctggagcagaagtcaaaaaaccaggagcctcagtaaaagttagttgcaaaacatcaggctactcattttcaacatacggagtttcatgggtaagacaagcaccaggccaaggcccagaatgggtcggatggatttcagcatacacaggaattacagactacgcacaaaaattccaaggaagagtaacactaacaacagatgcaaccacagcaacagcctttttagatctaagaagtttaagaccagacgatacagcaacatacttttgtgcaagagataaagtccaaggtcgagtagaagtaggatcaggaggacgccacgattactggggtcaaggaacattagtaatagtatcatctgcttctacaaaaggcccctcagtctttcccttagctccatcatccaaatcaacatcaggaggaacagccgctctaggttgcctagtaaaagactacttcccagaaccagtaacagtaagttggaactcaggagcattaacatcaggtgtacacacttttccagctgtcctacaatcttcaggcctatattctctaagctcggttgtaactgtaccctcatcatcactcggcacacaaacatacatatgtaacgttaatcataaaccttcaaacacaaaagtagacaaaaaagtagaaccaaaatcatgcgacaaaacacatacttgtccaccatgcccagctcctgaattactaggcggaccctccgtcttcttattcccaccaaaacccaaagacacactaatgatatcaagaacacccgaagtaacatgcgtagtagtagacgtctcacacgaagatccagaagttaaattcaattggtatgttgatggagtagaagtacataatgcaaaaacaaaacccagagaagaacaatacaactctacataccgagtcgtatcagtacttacagtactacatcaagactggttaaatggcaaagaatataaatgcaaagtatcaaacaaagctctaccagctccaatagaaaaaacaatatcaaaagcaaaaggccaaccaagagaaccacaagtatacactttaccaccatcaagagacgaacttaccaaaaaccaagtaagtctaacatgcttagtcaaaggattctatccatcagatatagcagtagaatgggaatcaaatggacaaccagaaaacaattacaaaacaacaccaccagtattagattcagacggttctttcttcctatactctaaattaacagtagacaaaagtagatggcagcagggtaatgtattctcatgctctgtaatgcatgaaggcttacataatcattatacacaaaaatcactatcactatcaccaggtaaa

SEQ ID NO: 46449 - RNA, 645 nt, synthetic construct
  misc_feature 1..645: note = derived and/or modified sequence opt6 from Navivumab_LightChain1
  source 1..645: mol_type = other RNA
gaagtagtattaacacaaagcccaggaacattagcattaccaccaggagaaagagcaacactatcatgcagagcatcacaccgagtaggatcaacatacatagcatggtaccaacaaaaaagcggacaagcaccaagaagactaatatacggcgcatcaaaccgagcaacagacataccagacagattctcaggatcaggatcaggaactgacttcacattaacaataagaagactcgaacctgaagactcagcagtatactactgccaacaattcagcgtaagcccatggacattcggacaaggaacaagagtagaaataaaaagaacagtagcagcaccatccgtattcatattcccaccatctgacgagcaactaaaatcaggaacagcatcagtcgtatgcctactaaataacttctacccaagagaagcaaaagtacaatggaaagtagacaacgcattacaaagtggaaactcacaagaaagtgtaacagaacaagactcaaaagattcaacatacagcctatcatcaacattaacattaagcaaagcagactacgaaaaacacaaagtatacgcatgcgaagtaacacaccaaggattaagttcaccagtaacaaaatcattcaacagaggagaatgc

SEQ ID NO: 46450 - RNA, 2172 nt, synthetic construct
  misc_feature 1..2172: note = derived and/or modified sequence opt6 from Ndimab-varB_HeavyChain
  source 1..2172: mol_type = other RNA
caagtacaactagtagaaagtggaggaggcgttgttcaacccggcagaagcttacgtttaagttgtgctgcttctggttttatatttagtagctatgccatgcattgggtcagacaagcaccaggtaatggcttagagtgggtagcttttatgtcgtacgacggatccaataaaaaatacgcagattcagtaaaaggaagattcactatatctagagacaacagcaaaaacacactctacctacaaatgaactcacttcgagcagaggatacagctgtttactattgtgcaagagatagaggcatctcagcaggaggtaattactattactatggaatggatgtatggggacaaggaacaacagtaacagtttcatcagcatcaacaaaaggcccaagtgtattcccactagccccatcatcaaaaagtacaagtggaggaacagctgcactaggatgtctggttaaagattatttccccgaaccagtaacagtaagttggaattcaggagctttaacatcaggcgtacacactttcccagcagtactacaaagttcaggtctatactccctaagcagtgtagtaactgtacctagttcaagtctaggaacacagacatatatatgcaacgtaaatcataaacctagtaatacaaaagtagataaaagagttgaaccaaaaagctgtgacaaaacgcatacatgccctccatgcccagcaccagagttactaggaggaccatcagtattcttatttcctccaaaacctaaggacacattaatgataagcagaacaccggaagtcacatgtgtagtagtagatgtatctcatgaagatccggaagtgaaattcaactggtacgtagatggagtcgaagtacataatgcaaaaactaaacccagagaagaacaatacaattcaacttacagagtagtatcagtacttacagtacttcatcaagattggctcaatggtaaggaatataaatgcaaagtgagtaacaaagctctacctgcaccaatagaaaaaacaataagtaaagcaaaaggacaaccaagggaaccacaagtatatacactaccaccatctcgagaagaaatgaccaaaaatcaagtctctttaacttgtctggtaaaaggattttatccatcagatatagcagttgaatgggaaagcaatggacaaccagaaaataattataagaccacaccacccgtacttgatagcgatggatcctttttcttatattctaaactaactgtagataaatcaagatggcaacaaggaaatgtgtttagctgttctgtgatgcatgaagcattgcataaccattacacacaaaaatcattatcactaagtccaggtaaaggcggaggaggaagcggaggaggcggctctcaagtacaattagtacaatcaggagccgaagtcaaaaaacccggttcaagtgttaaagtatcatgcaaagcatcaggcggaactttttcaacatatggtataagttgggtaagacaagcaccaggacaatgtctagaatggatgggtggtatcataccaatattcgatacaggtaactccgcacagtcatttcaaggaagagtcacaataactgcagatgaatcaacatccacagcatatatggaattgagtagtttaagaagcgaagataccgctgtatattattgtgcacgaagcagtagaatatatgatcttaatccaagtttaacggcctactatgacatggatgtttggggtcaaggcacaatggtaacagtttcatcaggaggtggaggatcaggaggaggcggatctggaggcggaggaagcggcggcggaggtagtcaaagcgtattaacacaacctccatcggtaagcgcagctcctggtcagaaagtaacgatatcatgtagtggcagctcgagtaatattggaaataattacgtatcatggtaccaacaactaccaggaacagcacccaaactattaatatatgataacaataaaagaccatcaggaataccagatcgattttctggcagtaaaagcggaacatccgcaacattaggaataaccggattacaaacaggagatgaagcagattattattgcggaacatgggattcatcacttagcgcatgggtatttggctgtggaacaaaactaaccgtatta

SEQ ID NO: 46451 - RNA, 645 nt, synthetic construct
  misc_feature 1..645: note = derived and/or modified sequence opt6 from Ndimab-varB_LightChain
  source 1..645: mol_type = other RNA
gaaatagtacttacacaatcaccagcaacactaagcctatcaccaggagaaagagcaacactatcatgcagagcatcccaatcagtatactcatacctagcatggtaccaacaaaaaccaggacaagcaccaagactattaatatacgacgcatctaacagagccataggaataccagcaagattttcaggatcaggatccggaacagacttcacactcacaatatcatcactagaaccagaagacttcgcagtatactactgccaacaaagatcaaactggccaccattcacattcggaccaggaacaaaagtagatataaaaagaacagtcgcagcaccatcagtattcatattccccccatcagacgaacaactaaaatcaggtactgcatcagtagtatgcctattaaacaacttctacccaagagaagcaaaagtacaatggaaagtagacaacgcactacaatcaggaaactcacaagaatcagtaacagaacaagattcaaaagactcaacatactcattatcatcaacattaactctatcaaaagcagactacgaaaaacacaaagtatacgcatgcgaagtcacccaccaaggactatcatcaccagtaaccaaatcattcaacagaggagaatgt

SEQ ID NO: 46452 - RNA, 1353 nt, synthetic construct
  misc_feature 1..1353: note = derived and/or modified sequence opt6 from Necitumumab_HeavyChain1
  source 1..1353: mol_type = other RNA
caagtacaactacaagaatctggaccaggtttagtcaaaccctctcaaacattatcattaacatgcaccgtatcaggcggcagcatatcatcaggtgactactactggagttggataagacaaccaccgggaaaaggactagaatggataggctacatttactactcaggatccacagattataatccaagtttaaaatcaagagtaacaatgtccgtagacacatcaaaaaaccaattctcattaaaagtaaactcagtaacagctgcagatacagcggtatactattgcgccagagtatcaatattcggagtaggaacattcgactattggggccaaggaacacttgtcactgtatcttctgcatccacaaaaggaccatctgtcctaccactagcaccatcctctaaaagtacaagtggaggaaccgcagcactcggctgcttagtaaaagactactttcctgaaccagtaacagttagttggaacagtggcgcactaacatcaggagtacacacattcccagccgtactacaatcctccggactatactcattatcatcagtagtaaccgtaccatcatcctcactcggcacacaaacatacatatgcaacgtcaaccacaaaccatctaacacaaaagtagacaaacgcgtagaaccaaaatcatgtgacaaaacacacacctgcccaccatgcccagcaccagaactattaggtggaccatcagtctttttattccctccaaaaccaaaagacactctaatgatatcacgcacccctgaagttacatgcgtagtagtagacgtatcacacgaagacccagaagtaaaattcaactggtacgtcgacggcgtcgaagtacataatgcaaaaacaaaaccaagagaagaacaatataacagcacctaccgcgtagtatcagtacttacagtactacaccaagactggctaaatggtaaagaatacaaatgtaaagtatctaacaaagcactaccagctccaatagaaaaaacaatctcaaaagcaaaaggacaaccaagagaaccacaagtctacacactaccaccttcaagagaagaaatgactaaaaaccaagtatcacttacatgccttgtaaaaggattctacccatccgatatagcagtagaatgggaatcaaacggacaacccgaaaacaattacaaaaccacacctcccgtattagactcagatggatcatttttcctatactctaaacttacagtagataaatcaagatggcaacaaggaaacgttttctcctgctccgtaatgcacgaagcactacataaccattatacacaaaaatcactttcactatctccaggaaaa

SEQ ID NO: 46453 - RNA, 642 nt, synthetic construct
  misc_feature 1..642: note = derived and/or modified sequence opt6 from Necitumumab_LightChain1
  source 1..642: mol_type = other RNA
gaaatagtaatgacacaatcaccagcaacattatcactatcaccaggagaaagagcaacactatcatgccgagcatcacaatcagtatcatcatacctagcatggtaccaacaaaaaccaggacaagcacccagactactaatatacgacgcatcaaacagagcaacaggaataccagccagattctcaggatcaggatcaggaacagacttcacactaacaatatcaagcctagaaccagaagacttcgcagtatactactgccaccaatacggatcaacaccattaacattcggaggaggaacaaaagcagaaatcaaaagaacagtagcagcaccatcagtattcatattcccaccatcagacgaacaacttaaatcaggaacagcctccgtagtatgcctattaaacaacttttacccaagagaagcaaaagtacaatggaaagtagataacgcactacaaagtggaaactcacaagaaagtgtcacagaacaagactcaaaagactcaacatactcactatcatcaacactaacattatccaaagcagattacgaaaaacacaaagtatacgcatgcgaagtaacacaccaaggactatcatcaccagtaacaaaatcatttaacagaggagaatgc

SEQ ID NO: 46454 - RNA, 396 nt, synthetic construct
  misc_feature 1..396: note = derived and/or modified sequence opt6 from Neliximab_HeavyChain_VH-Region
  source 1..396: mol_type = other RNA
gaagtacaattacaacaaagcggaccagaactagtaaaaccaggagcaagtgtaaaaatgagctgtaaagcaagcggatacacattcacaacatatgtaatgcactgggtaaaacaaaaaccaggacaaggactagaatggataggatatataaatccatataacgatggaacaaactataacgaaaaatttaaaggaaaagcaacattaacatcagacaaaagttcaagcacagcatatatggaactatcaacattaacatcagaagatagcgcagtatattactgtgcagaattcataacaaaaacagtaggaggaagcaattggtatttagatgtatggggagcaggaacaacagtaacagtatcatcagcaaaaacaacacccccaaaatta

SEQ ID NO: 46455 - RNA, 372 nt, synthetic construct
  misc_feature 1..372: note = derived and/or modified sequence opt6 from Neliximab_HeavyChain_VH-Region_variant1
  source 1..372: mol_type = other RNA
caagtacaattaaaacaaagtggaccagaactagtaaaaccaggagcaagtgtaaaaatgagctgtaaagcaagcggatacacattcacaacatatgtaatgcactgggtaaaacaaaaaccaggacaaggactagaatggataggatatataaatccatataacgatggaacaaactataacgaaaaatttaaaggaaaagcaacattaacatcagacaaaagctcaagcacagcatatatggaactatcaacattaacatcagaagatagcgcagtatattactgtgcagaattcataacaaaaacagtaggaggaagcaattggtatctagatgtatggggagcaggaacaacagtaacagtaagctca

SEQ ID NO: 46456 - RNA, 318 nt, synthetic construct
  misc_feature 1..318: note = derived and/or modified sequence opt6 from Neliximab_LightChain_VL-Region
  source 1..318: mol_type = other RNA
gatatagtactaacacaatcaccagcaataatgagcgcaagcccaggagaaaaagtaacaatgacatgtagcgcaagctcaagcataagctatatacattggtttcaacaaaaaccaggaacaagcccaaaaagatggatatacgatacatcaaaattaccatcaggagtaccagcaagatttagcggaagcggaagcggaacatcatactcactaacaatatcaagcatggaagcagaagatgcagcgacatattactgtcaccaaagatcaagctatacatggacatttggaggaggaacaaaattagaaataaaa

SEQ ID NO: 46457 - RNA, 354 nt, synthetic construct
  misc_feature 1..354: note = derived and/or modified sequence opt6 from Neliximab_LightChain_VL-Region_variant1
  source 1..354: mol_type = other RNA
caaatagtactaacacaatcaccagcaataatgtcagcatcaccaggagaaaaagtaacaatgacatgctcagcatcatcatccatatcatacatacactggttccaacaaaaaccaggaacatcaccaaaaagatggatatacgacacatcaaaactaccatcaggagtaccagcaagattctcaggatcaggatcaggaacatcatactcactaacaatatcatcaatggaagcagaagacgcagcaacatactactgccaccaaagatcatcatacacatggacattcggaggaggaacaaaactagaaataaaaagagcagacgcagcaccaacagtatcagcagcagca

SEQ ID NO: 46458 - RNA, 1335 nt, synthetic construct
  misc_feature 1..1335: note = derived and/or modified sequence opt6 from Nemolizumab_HeavyChain1
  source 1..1335: mol_type = other RNA
caagtacaacttgttcaatcaggagcagaagtaaaaaaacctggagcttcagtaaaagtttcatgcaaagcctcaggttacacattcacaggatacatcatgaactgggtacgtcaagcaccaggacaaggactagaatggatgggattaataaacccatacaacggaggtacagactataacccacaattccaagacagagtaactataacagctgacaaatctacatccacagcatatatggaactctcatcattaagatccgaagatactgcagtatactattgtgcaagagatggatacgatgatggaccttatacattagaaacatggggacaaggcaccctagtaacagtatcaagtgcctcaacaaaaggaccttcagtattccccttagcccctagttcaaaatcaacatcaggaggaacagcagctctaggatgcttagtaaaagactattttccagaaccagttacagtttcatggaattccggcgcactcacatcaggagtacatactttccctgcagtcctacaatcatcaggactctattcactatcatcagtcgtaacagttccatcatctaattttggaacacaaacatacacttgcaatgtagaccataaaccatcaaacacaaaagtcgataaaacagtagaacgcaaaagctgtgtagaatgccccccatgcccagcaccaccagtagccggtccatccgtattcctattccccccaaaaccaaaagacacattaatgatctcaagaactccagaagtaacatgcgtagtagtcgacgtatctcaagaagacccagaagtacaatttaactggtacgtcgacggagtagaagtacacaacgcaaaaaccaaacccagagaagaacaattcaactcaaccttcagagtagtctcagtcctcacagtagtgcaccaagattggttaaatggcaaagaatacaaatgtaaagtaagcaacaaaggattacccgctccaatcgaaaaaacaatatcaaaaactaaaggacaaccaagagaaccacaagtatacaccctaccaccttcacaagaagaaatgacaaaaaaccaagtatctttaacttgtcttgtaaaaggattttatccatcagacatagcagtagaatgggaaagcaacggtcaaccagaaaacaactacaaaacaacaccccctatgttagactcagatggttccttcttcctttactcaaaattaacagtagacaaatcacgctggcaagaaggaaatgtcttttcttgttctgtaatgcacgaagcactacacaaccactacacacaaaaatcactatcactatcacca

SEQ ID NO: 46459 - RNA, 642 nt, synthetic construct
  misc_feature 1..642: note = derived and/or modified sequence opt6 from Nemolizumab_LightChain1
  source 1..642: mol_type = other RNA
gacatacaaatgacacaatcaccatcatcactatcagcatcagtaggagaccgagtaacaataacatgtcaagcatcagaagacatatattcattcgtagcatggtaccaacaaaaaccaggaaaagcaccaaaactactaatatacaacgcacaaacagaagcacaaggagtaccatcaagattctcaggatcaggatcaggaacagacttcacattaacaatatcatcattacaacccgaagacttcgcaacatactactgccaacaccactacgactcaccattaacattcggaggaggaaccaaagtagaaataaaaagaacagtagcagccccaagcgtattcatattcccaccatcagacgaacaactaaaatcaggcacagcatccgtcgtatgcttactaaacaacttctacccaagagaagcaaaagtacaatggaaagtcgacaacgcattacaatcaggaaactcacaagaatcagtaacagaacaagattcaaaagactcaacatactcactatcatcaacattaacactatcaaaagcagattacgaaaaacacaaagtatacgcatgcgaagtaacacaccaaggcctaagctcacccgtaacaaaatcattcaacagaggagaatgc

SEQ ID NO: 46460 - RNA, 1356 nt, synthetic construct
  misc_feature 1..1356: note = derived and/or modified sequence opt6 from Nesvacumab_HeavyChain1
  source 1..1356: mol_type = other RNA
gaagtacaattagtagaaagtggaggaggacttgtccaacctggaggatctctgcgattatcatgcgcagcgtcaggattcactttctcttcatacgacatccattgggttagacaagctacaggaaaaggattagaatgggtaagtgcaatcggaccagcaggtgatacatattacccaggatcagttaaaggcagatttacaataagcagagaaaacgcaaaaaatagtctgtatttacaaatgaattctctcagagctggagacacagcagtatactattgcgcccgcggactcattacctttggaggattaatagcaccatttgactactggggacaaggaacactagtcacagtaagttcagcatcaacaaaaggaccaagcgtatttccacttgcaccatcaagtaaatcaacaagcggaggaacagcagcattaggatgtttagttaaagactactttccagaacctgtcactgtctcatggaactcaggagccttaacatctggcgtacatacattccccgctgtcctacaaagcagcggtctatattcactatcaagcgtagtaacagtcccatcctcctcattaggaacacaaacatacatatgcaatgtaaatcacaaaccatctaacacaaaagtagacaaaaaagtcgaaccaaaatcatgcgataaaacacatacatgtccaccttgtccagcaccagaactcttaggagggccatcagtatttctctttccccctaaacccaaagatacattaatgataagcagaactccagaagtcacatgtgtagtagtagatgtaagtcacgaagacccagaagtaaaatttaattggtacgtagacggtgtagaagttcataacgcaaaaaccaaaccccgagaagaacagtataatagcacatatagagtagtttcagtattaacagtcttacatcaagattggttaaatggaaaagaatataaatgtaaagtatctaataaagcactaccagcacccatagaaaaaacaatatcaaaagcaaaaggacaaccaagagaaccacaagtatatacattaccaccatccagagatgaattaacgaaaaatcaagtctcactaacctgtctagtaaaaggattttatccatcagatatagcagtagaatgggaatctaacggacaaccagaaaataattataaaacaacaccacctgttttagattcagatggctctttctttctatattcaaaactaacagtagacaaatcaagatggcaacaaggaaatgtattctcatgcagcgtaatgcatgaagcgttacacaaccattatacacaaaaatcattaagtttatcaccaggaaaa

SEQ ID NO: 46461 - RNA, 642 nt, synthetic construct
  misc_feature 1..642: note = derived and/or modified sequence opt6 from Nesvacumab_LightChain1
  source 1..642: mol_type = other RNA
gaaatagtactaacacaatcaccaggaaccctatcactatccccaggagaacgagcaacattatcatgcagagcatcacaatcagtatcatcaacatacttagcatggtaccaacaaaaaccaggacaagccccaagactattaatatacggagcctcatcaagagcaacaggaataccagacagattctcaggctccggatcaggaacagacttcacactaacaatatcacgcctagaaccagaagacttcgcagtctactactgccaacactacgacaactcacaaacattcggacaaggaacaaaagtagaaataaaacgaacagtagcagcaccatccgtattcatattcccaccatcagacgaacaattaaaatcaggaacagcttcagtagtatgcttactaaacaacttctacccaagagaagcaaaagtccaatggaaagtagacaacgcattacaatcaggaaactcacaagaatcagtaacagaacaagattcaaaagactcaacctactcactatcatcaacattaacactctcaaaagcagactacgaaaaacacaaagtatacgcatgtgaagtaacacaccaaggactatcctcaccagtaaccaaatccttcaacagaggcgaatgc

SEQ ID NO: 46462 - RNA, 1362 nt, synthetic construct
  misc_feature 1..1362: note = derived and/or modified sequence opt6 from Neuradiab_HeavyChain1
  source 1..1362: mol_type = other RNA
gaagtacaactacaacaatcaggaccagaactagtaaaaccaggtgcctctgtaaaaatgtcatgtaaagcatcaggttacacattcacatcatatgtagttcactgggtaaaacaaaacccaggccaaggactagaatggatcggatacatcaacccattcaacgacggaactaaatacaacgaaaactttaaatgcaaagcaacactaacttcagaccgatcttcctcaacagcctacatggaattatcctcactaacatctgaagaatcagcagtatacttctgtgcacgcgacatgggaagagaaggattcgcatattggggacaaggaacattagttacagtatcagcagcaaaaacaaccccaccttcagtatacccacttgcacccggatgcggtgacacaacaggatcatcagtaacattaggatgtctagtaaaaggatattttccagaatcagtaactgtaacttggaactccggaagtttatcatcatcagttcacacatttcctgccttactccaatcaggtctatatacaatgtcctcatcagttacagtaccatcatcaacttggccatcacaaatagtaatatgtagcgtcgcccatccagcatcctcaacaacagtagacaaaaaactagaaccatcaggcccaatatcaacaataaacccatgtccaccatgcaaagaatgccataaatgcccagcacccaacctagaaggcggacccagcgtatttatatttccaccaaatataaaagacgtactaatgatatcattaaccccaaaagtcacctgtgtagtagtcgacgtctccgaagacgatccagacgttcaaatttcatggttcgtaaacaacgtagaagtacatacagcacaaacacaaacccaccgcgaagactacaattcaacaataagagtagtatcaacattaccaatacaacaccaagactggatgtcaggaaaagaattcaaatgtaaagtaaacaataaagatctaccctcacctatagaaagaacaatatcaaaaatcaaaggattagtaagagccccacaagtatacatactaccacccccagcagaacaactatcaagaaaagacgtatcattaacatgcttagtagtaggattcaacccaggagacatatcagtagaatggacatctaacggccacacagaagaaaactacaaagacacagcgcccgtactagattcagatggatcatacttcatttatagcaaattaaatatgaaaacatcaaaatgggagaaaacagacagcttctcatgtaatgtaagacacgaaggtctaaaaaactattaccttaaaaaaacaatatcaagatccccaggcaaa

SEQ ID NO: 46463 - RNA, 657 nt, synthetic construct
  misc_feature 1..657: note = derived and/or modified sequence opt6 from Neuradiab_LightChain1
  source 1..657: mol_type = other RNA
gacatagtaatgacacaagcagcattctcaaacccagtaacactaggaacatccgcatcaatatcatgccgaagctccaaatcactactacactcaaacggaataacatacctatactggtacttacaaaaaccaggacaatcaccacaactattaatctaccaaatgtcaaatctagcatcaggagtaccagacagattctcaagctcaggatcaggcacagacttcacactaagaatatcaagagtcgaagcagaagacgtaggagtatactattgcgcacaaaacctagaattaccaagaacattcggaggaggaaccaaactagaaataaaaagagcagacgcagcaccaacagtatcaatattcccaccatcaagcgaacaactaacatcaggaggagcatcagtcgtatgcttcctaaacaacttttacccaaaagacataaacgtaaaatggaaaatagacggatcagaaagacaaaacggagtactaaactcttggacagaccaagacagcaaagactcaacatactcaatgtcatcaacactaacactaaccaaagacgaatacgaaagacacaactcatacacatgcgaagcaacacacaaaacatcaacatcaccaatagtaaaaagcttcaatagaaacgaatgc

SEQ ID NO: 46464 - RNA, 369 nt, synthetic construct
  misc_feature 1..369: note = derived and/or modified sequence opt6 from Nimotuzumab_HeavyChain1
  source 1..369: mol_type = other RNA
caagtacaattacaacaaagcggagcagaagtaaaaaaaccaggatcaagcgtaaaagtaagctgtaaagcaagcggatacacattcacaaactattacatatactgggtaagacaagcaccaggacaaggactagaatggataggaggaataaatccaacaagcggaggatcaaactttaacgaaaaatttaaaacaagagtaacaataacagtagacgaaagcacaaacacagcatatatggaactatcaagcctaagatcagaagatacagcattctatttctgtgcaagacaaggactatggttcgatagcgatggaagaggatttgacttttggggacaaggaagcacagtaacagtatcaagc

SEQ ID NO: 46465 - RNA, 342 nt, synthetic construct
  misc_feature 1..342: note = derived and/or modified sequence opt6 from Nimotuzumab_LightChain1
  source 1..342: mol_type = other RNA
gacatacaaatgacacaatcaccatcatcactatcagcatcagtaggagacagagtaacaataacatgcagatcatcacaaaacatagtacactcaaacggaaacacatacctagactggtaccaacaaacaccaggaaaagcaccaaaactactaatatacaaagtatcaaacagattctcaggagtaccatcaagattctcaggatcaggatcaggaacagacttcacattcacaatatcatcactacaaccagaagacatagcaacatactactgcttccaatactcacacgtaccatggacattcggacaaggaacaaaactacaaataacaagagaa

SEQ ID NO: 46466 - RNA, 1320 nt, synthetic construct
  misc_feature 1..1320: note = derived and/or modified sequence opt6 from Nivolumab_HeavyChain1
  source 1..1320: mol_type = other RNA
caagtacaactagtagaatcaggaggaggagtagtacaaccaggaagatcactcagattagattgtaaagcaagtggcatcactttctcaaattcaggaatgcactgggtacgacaagctccaggtaaaggactagaatgggtagcagtcatatggtatgatggctcaaaaagatactatgcagattccgtaaaaggtagatttacaatttctagagacaactcaaaaaacacattattcctacaaatgaattcccttagagctgaagatacagcagtatattattgtgcaacaaatgatgattattggggacaaggtacacttgtaacagtttcatcagcatcaacaaaaggtccatcagtatttcctttagcaccctgctcaagatctacctcagaatcaacagctgcactaggctgtctagtaaaagattactttccagaaccagtaaccgtaagctggaactcaggcgcactaacttcaggagtacatacatttccagctgtacttcaatcttccggtctctactcactatcatcagtcgtaaccgtaccatcatcttcactcggaacaaaaacctatacatgtaatgtagaccataaaccaagcaatacaaaagtagacaaaagagtagaatcaaaatacggcccaccatgtcctccttgtccagccccagaattcctcggaggcccatcagtatttctatttccaccaaaacctaaagatacactaatgatttccagaacaccagaagtcacatgcgtagttgtagatgtatcacaagaagaccccgaagtacaatttaactggtatgtagatggagtagaagttcataacgcaaaaacaaaaccaagagaagaacaatttaattcaacatacagagtagtttcagtactaacagtgttacatcaagactggctaaatggcaaagaatataaatgtaaagtatcaaacaaaggactaccatcatctatagaaaaaacaatatccaaagcaaaaggacaaccaagagaaccacaagtatataccttaccaccatcccaagaagaaatgacaaaaaaccaagtatcactcacatgtctagttaaaggtttctatccaagtgacatagcagtcgaatgggaatctaacggacaaccagaaaacaactataaaacaactccaccagttctagattcagacggatctttttttctatattcaagactaacagtcgataaatcacgatggcaagaaggcaatgtattttcatgttcagtaatgcacgaagccctacacaaccattacacacaaaaatcattatcactaagcctaggaaaa

SEQ ID NO: 46467 - RNA, 642 nt, synthetic construct
  misc_feature 1..642: note = derived and/or modified sequence opt6 from Nivolumab_LightChain1
  source 1..642: mol_type = other RNA
gaaatagtactaacacaatcaccagcaacattaagcctaagcccaggagaaagagcaacattaagctgcagagcaagccaaagtgtatcatcatacctagcatggtaccaacaaaaacccggacaagcaccaagattattaatatatgacgcaagcaatcgagcaaccggaataccagcaagattctcaggatcaggatcaggtacagactttacattaacaataagctcactagaaccagaagactttgcagtatactattgtcaacaatcaagcaattggccaagaacattcggacaagggacaaaagtagaaataaaacgaacagtagcagcaccaagcgtatttatattcccaccatcagacgaacaattaaaatcaggaacagcatctgtagtatgcctactaaataacttttacccaagagaagcaaaagtacaatggaaagtagataacgcactacaatcaggaaactcacaagaaagcgtaacagaacaagatagcaaagactcaacatatagcttaagctcaacattaacactaagcaaagcagattacgaaaaacataaagtatacgcatgcgaagtaacacaccaaggcttaagttcaccagtaacaaaaagctttaacagaggagaatgc

SEQ ID NO: 46468 - RNA, 1347 nt, synthetic construct
  misc_feature 1..1347: note = derived and/or modified sequence opt6 from Obiltoxaximab_HeavyChain1
  source 1..1347: mol_type = other RNA
caagtacaacttcaacaatcaggtccagaattaaaaaaaccaggcgcatccgtcaaagtatcttgtaaagactccggatacgccttcagttcctcctggatgaattgggtacgacaagcaccaggacaaggcctcgaatggataggacgaatatatccaggagacggagatacaaactacaacggaaaatttcaaggtagagtaacaataaccgcagacaaatcatcctcaaccgcatacatggaattatcatcactaagatcagaagacacagcagtatacttctgtgcacgatcaggactattacgatatgccatggattattggggacaaggaacgctagtaacagtatcatcagcatcaacaaaaggaccatcagtatttcccctagcaccttcatctaaatcaacatcaggtggaacagccgcattaggatgcctagtcaaagactatttcccagaacctgtaacagtatcctggaactcaggagcactaacttcaggagtccacacatttccagcagtactccaatcctccggactatactctctttcatcagtagtgacagttccctcatcctctctcggaacccaaacatatatatgtaacgtaaatcacaaaccatcaaatacaaaagtagacaaaaaagtagaacctaaaagctgtgacaaaacacatacctgcccaccatgccctgctcccgaactattaggcggaccctcagtttttcttttcccaccaaaaccaaaagacacactaatgatatcaagaacaccagaagtaacatgcgtagtcgtagatgtatcccatgaagacccagaagtaaaatttaactggtatgtagatggagtagaagtacacaatgcaaaaacaaaaccaagagaagaacaatacaattccacctatcgagtcgtatcagtacttacggtactacaccaagattggctaaacggaaaagaatacaaatgcaaagtatcaaacaaagccttacctgcaccaatagaaaaaaccatctccaaagcaaaaggtcaaccacgtgaaccacaagtatacacacttcctccctcaagagacgaattaaccaaaaaccaagtatcactaacctgcctagtaaaaggtttctatccaagcgacatagctgtagaatgggaatcaaacggacaaccagaaaacaactataaaacaacaccaccagtattagactccgatggctccttcttcttatactcaaaattaactgtcgacaaatcaagatggcaacaaggtaatgtattctcatgctcagttatgcacgaagcattgcataaccactacacacaaaaatcactctcactatcaccaggaaaa

SEQ ID NO: 46469 - RNA, 642 nt, synthetic construct
  misc_feature 1..642: note = derived and/or modified sequence opt6 from Obiltoxaximab_LightChain1
  source 1..642: mol_type = other RNA
gacatacaaatgacacaatcaccatcaagtctatcagcaagcgtaggcgaccgagtaacaataacatgcagagcaagccaagacataagaaactacttaaactggtaccaacaaaaaccaggaaaagcagtaaaactattaatatactacacatcaagactactaccaggagtaccaagcagattctcaggatcaggctcaggtacagactactcactaacaataagctcacaagaacaagaagacataggaacatacttctgccaacaaggaaacacactaccatggacattcggacaaggaacaaaagtagaaatcagacgaacagtcgcagccccatccgtattcatattcccaccatcagatgaacaactaaaatcaggaacagcatcagtagtatgcctattaaacaacttctacccaagagaagcaaaagtacaatggaaagtagataacgcactacaatcaggaaactcacaagaaagcgtaaccgaacaagacagcaaagactcaacatactcactaagctccactttaaccttaagcaaagcagactacgaaaaacacaaagtatacgcatgcgaagtaacacaccaaggactatcatcaccagtaacaaaatcatttaacagaggagaatgc

SEQ ID NO: 46470 - RNA, 1347 nt, synthetic construct
  misc_feature 1..1347: note = derived and/or modified sequence opt6 from Obinutuzumab_HeavyChain1
  source 1..1347: mol_type = other RNA
caagttcaactagtccagtcaggagcagaagttaaaaaaccaggatcctcagtaaaagtatcatgcaaagcctcaggatatgcattctcatactcatggataaattgggtaagacaagcacccggacaaggactagaatggatgggaagaatattcccaggagacggagacacagactataatggaaaattcaaaggaagagtaacaataacagcagataaatccacatcaacagcatatatggaattatcctctttaagatcagaagatacagcagtatactattgtgctcgaaacgtattcgacggatactggctagtttactggggtcaaggaacactagttacagtatcatccgcatcaacaaaaggtccatcagtatttccactagcaccatcatcaaaaagcacaagcggtggcacagcagcacttggatgcttagtaaaagattacttcccagaaccagtaaccgtatcatggaattcaggagcactaacatcaggagttcacacattcccagcagtcttacaatcctcaggtctatactctttatcatcagtagtcacagtaccctcaagttccttaggaacacaaacttatatatgcaacgtaaaccataaaccatcaaacacaaaagttgacaaaaaagtcgaaccaaaatcatgcgacaaaacacacacatgtcccccatgtcccgcaccagaactattaggcggtccatcagtattcttattcccaccaaaaccaaaagatactctcatgatatcacgaacacccgaagtaacctgcgtagtagtagatgtatcccacgaagacccagaagtaaaattcaactggtatgtagacggagtagaagtacacaacgccaaaaccaaaccaagagaagaacaatacaactcaacatatagagtagtatctgtacttaccgtactacatcaagattggttaaacggaaaagaatacaaatgcaaagtttcaaacaaagcactacctgcaccaatagaaaaaacaatatctaaagctaaaggacaaccaagagaaccgcaagtatacacattaccaccctctagagacgaactaacaaaaaaccaagtaagcctaacatgcctcgtaaaaggattctatccatcagacatagccgtagaatgggaatcaaatggacaaccagaaaataattataaaacgacacctccagtcctagactcagatggttctttcttcctatactcaaaactaacagttgataaatcaagatggcaacaaggaaatgttttttcatgttcagtaatgcacgaagcactacataaccattacactcaaaaatcactctccctctctccaggaaaa

SEQ ID NO: 46471 - RNA, 657 nt, synthetic construct
  misc_feature 1..657: note = derived and/or modified sequence opt6 from Obinutuzumab_LightChain1
  source 1..657: mol_type = other RNA
gacatagtaatgacacaaacaccactatcactaccagtcacaccaggagaaccagcctcaatatcatgcaggtcatcaaaatctttactacattcaaacggaataacctacctatactggtacttacaaaaacctggacaatcaccacaactactaatataccaaatgtcaaacttagtatcaggagtaccagacagattctcaggctcaggatcaggcacagacttcacactaaaaatatcaagagtagaagcagaggacgtaggtgtatactactgcgcacaaaacttagaattaccatacacattcggaggaggaaccaaagttgaaataaaacgaacagtagcagcaccatcagtattcatattcccaccatcagacgaacaactaaaatcaggaacagcatcagtcgtatgcttactaaacaacttctacccaagagaagcaaaagtacaatggaaagtagacaacgcattacaatcaggaaactcacaagaatcagtaacagaacaagactccaaagactcaacttacagcctatcctcaactctaacactatcaaaagcagactacgaaaaacataaagtatacgcatgcgaagtaacacatcaaggattatcatcaccagtaactaaatctttcaacagaggtgaatgc

SEQ ID NO: 46472 - RNA, 1350 nt, synthetic construct
  misc_feature 1..1350: note = derived and/or modified sequence opt6 from Ocaratuzumab_HeavyChain1
  source 1..1350: mol_type = other RNA
gaagtacaactagtacaatcaggagctgaagtaaaaaaaccaggagaatcattaaaaatatcttgcaaaggctctggaagaaccttcacatcatataatatgcattgggtaagacaaatgccaggcaaaggattagaatggatgggagcaatataccctttaacaggagatacatcatacaatcaaaaaagtaaactacaagttaccatatctgcagacaaatcaatatccacagcatacttacaatggtcatcactaaaagcatcagacacagcaatgtactactgtgcacgttcaacatatgtaggaggtgactggcaatttgatgtatggggaaaaggaacaacagtaaccgtatcatcagcatctacaaaaggaccatcagtattcccactagcaccttcatccaaatcaacatcaggaggcaccgcagcattaggatgcctagtaaaagactactttcctgaaccagtcacagtttcatggaacagcggagcactgacatcaggagtccacacttttcccgcagtactacaaagctcaggattatactcattaagttcagttgtaacagtaccaagtagcagtttaggaacacaaacatatatatgcaatgttaatcataaaccctccaatacaaaagtagacaagaaagttgaaccaaaatcatgcgataaaacacacacatgccccccgtgtccagcacctgaactattaggaggtccgtcggtatttctcttcccacctaaaataaaagacacactaatgataagcagaacacccgaagtaacctgcgtagtagtagatgtaagccacgaagacccagaagtaaaatttaactggtatgttgacggagtagaagtacacaatgcaaaaacaaaacccagagaagaacaatacaactctacataccgagtagtatcagtcttaacagtactacatcaagactggttaaatggaaaggaatataaatgcaaagtaagtaacaaagcattaccagcccctatagaaaaaactatctcaaaacaaaaaggtcaaccaagagaaccacaagtatacacattaccaccatcaagagatgaactaacaaaaaaccaagtcagcctaacatgcctagtaaaaggattctacccatcagacatcgccgtagaatgggaatcaaatggacaaccagaaaataactacaaaacaacacccccagtcttagatagcgacggttcatttttcctctactcaaaacttacagtagacaaatctagatggcaacaaggaaacgtatttagttgcagcgttatgcacgaagcactacacaatcactatacacaaaaaagcttatcattaagcccagga

SEQ ID NO: 46473 - RNA, 639 nt, synthetic construct
  misc_feature 1..639: note = derived and/or modified sequence opt6 from Ocaratuzumab_LightChain1
  source 1..639: mol_type = other RNA
gaaatagtactaacacaatcaccaggaacactatcactatcacccggagaaagagcaacactatcatgcagagcatcatcatccgtaccatatatacactggtatcaacaaaaaccaggacaagcacccagactactaatatacgcaacatccgcactagcttcaggaataccagacagattttcaggatccggctcaggaacagacttcacactaacaatatccagactagaaccagaagacttcgcagtatattactgccaacaatggctctcaaacccaccaacattcggacaaggaacaaaattagaaataaaaagaacagtagcagcaccatcagtattcatattcccaccatctgacgaacaattaaaatcaggaacagcatcagtagtatgcctactaaacaacttctacccaagagaagcaaaagtacaatggaaagtcgacaacgctctacaaagcggaaactcacaagaatcagtaaccgaacaagactcaaaagactcaacatactcactatcatcaacactaacactatccaaagcagactacgaaaaacacaaagtatatgcatgcgaagtaacacaccaaggactatcttcacccgtaacaaaatcattcaacagaggtgaatgc

SEQ ID NO: 46474 - RNA, 1356 nt, synthetic construct
  misc_feature 1..1356: note = derived and/or modified sequence opt6 from Ocrelizumab_HeavyChain1
  source 1..1356: mol_type = other RNA
gaagtacaactagtagaatcaggaggaggattagtacaacccggcggatcactacgactatcatgtgcagcaagtggatacaccttcacttcatacaatatgcattgggtaagacaagccccaggtaaaggcttagaatgggtcggagcaatatatccaggaaatggcgacacatcttacaatcaaaaattcaaaggaagattcacaatatcagtcgacaaatcaaaaaacactctctacctacaaatgaacagtttaagagctgaagacacagcggtgtactattgtgcacgagtcgtatattactcaaacagctattggtacttcgacgtctggggacaaggaactctcgtaacagtatcttcagcaagcactaaaggaccatcagtctttccactagcaccatcatcaaaatctacatccggaggaactgccgcattaggatgtcttgtaaaagactactttccagaacccgtaacagtatcatggaacagtggagcattaacatccggagtacatacttttccagccgtactacaatcatcaggcctatacagcctatcatcagttgtaacagtaccatcatcatcattaggaacccagacatacatatgcaacgttaaccataaaccttcaaatacaaaagttgacaaaaaagtcgaacccaaaagctgcgataaaacacacacctgtcctccatgcccagccccagaattactaggcggaccatcagtcttcctattcccaccaaaacccaaagacacattaatgatatcaagaacaccagaagtaacctgtgtcgtagtcgacgtatcacacgaagaccccgaagtcaaattcaactggtatgtagacggagtagaagtacacaatgcaaaaacaaaaccaagagaagaacaatacaactcaacatatagagtagtatcagtactaactgtacttcaccaagattggcttaacggaaaagaatataaatgtaaagtatctaacaaagccctaccagccccaatagaaaaaactatatcaaaagcaaaaggtcaacccagagaaccacaagtatatacattaccaccatcacgagaagaaatgacaaaaaatcaagtttccctaacatgcttagtaaaaggattctatccaagtgacatagcagtagaatgggaatccaacggacaaccagaaaacaactacaaaacaacaccaccagtcctagacagcgacggatccttttttttatattcaaaactcacagttgataaatctagatggcaacaaggaaatgtattctcatgctcagtcatgcacgaagccttacataatcattacacacaaaaatcattatccctttcaccaggtaaa

SEQ ID NO: 46475 - RNA, 639 nt, synthetic construct
  misc_feature 1..639: note = derived and/or modified sequence opt6 from Ocrelizumab_LightChain1
  source 1..639: mol_type = other RNA
gacatacaaatgacacaatccccatcatccttatcagcatcagtaggagacagagtaacaataacatgcagagcatcatcctcagtatcctacatgcactggtaccaacaaaaaccaggcaaagcaccaaaaccactaatatacgcaccatcaaacctagcatctggagtaccatccagattctcaggatcaggatccggaacagacttcacactaacaatatcatcattacaaccagaagacttcgctacatactactgccaacaatggtcattcaacccaccaacattcggacaaggcacaaaagtagaaataaaacgaacagtcgcagcaccatcagtcttcatatttccaccatcagacgaacaactaaaatccggcaccgcatcagtagtatgcctactaaacaacttctacccacgagaagccaaagtacaatggaaagtagacaacgccttacaatcaggaaactcacaagaatcagtaactgaacaagactcaaaagattcaacatactcactatcatcaacactaacactatcaaaagcagactacgaaaaacacaaagtatacgcatgcgaagtaacacaccaaggactatcctcaccagtaaccaaatcattcaacagaggagaatgc

SEQ ID NO: 46476 - RNA, 1356 nt, synthetic construct
  misc_feature 1..1356: note = derived and/or modified sequence opt6 from Ofatumumab_HeavyChain1
  source 1..1356: mol_type = other RNA
gaagttcaattagtcgaaagtggaggaggactagtacaaccaggacgttcattacgactatcatgcgcagcatcaggatttacattcaacgactatgcaatgcactgggttagacaagcacctggaaaaggactcgaatgggtaagcactatttcatggaacagcggatcaatcggctacgcagactccgtcaaaggacgcttcacaatatcacgagacaacgccaaaaaatctctatacttacaaatgaattccctaagagctgaagacaccgcactctactactgcgcaaaagacattcaatatggtaattattattacggaatggacgtatggggacaaggaacaacagtaacagtctcctcagcatcaacaaaaggaccttccgtatttcccctagcaccatcatcaaaatcaacatcaggaggaacagcagcattaggatgcctagtaaaagactacttcccagaaccagtaacagtttcatggaactctggcgcattaacatctggcgtccacacattcccagcagtattacaatcatcaggcctctactccttatcatcagtagtaacagtaccctcatcatcattaggaacccaaacctacatctgtaatgtaaatcataaaccatctaacactaaagtagacaaacgagtagaaccaaaatcatgcgacaaaacacacacctgtcctccttgcccagcaccagaattactaggtggaccctcagtattcttattcccacctaaacctaaagatacactaatgatctcaagaacaccagaagtaacctgtgtagttgtagacgtctcccacgaagaccccgaagtaaaatttaattggtacgtagatggtgtagaagtacacaacgcaaaaactaaaccaagagaagaacaatacaattcaacataccgagtagtctcagtattaacagtcctacaccaagactggttaaacggaaaagaatacaaatgcaaagtttcaaacaaagccttaccagcaccaattgaaaaaaccatatccaaagcaaaaggacaaccaagagaaccacaagtatacaccctaccaccctcaagagaagaaatgacaaaaaaccaagtatcattaacatgcttagtaaaaggattttatccatcagacatagcagtagaatgggaatctaacggacaaccagaaaacaattacaaaacaaccccaccagtcttagactcagacggctcctttttcctatactccaaactaacagtagataaaagtagatggcaacaaggtaacgtatttagttgcagtgtaatgcacgaagctctacataatcactatacacaaaaatcactatcactatcaccaggaaaa

SEQ ID NO: 46477 - RNA, 642 nt, synthetic construct
  misc_feature 1..642: note = derived and/or modified sequence opt6 from Ofatumumab_LightChain1
  source 1..642: mol_type = other RNA
gaaatagtcttaacacaatctccagcaacactaagcctatcaccaggcgaaagagcaacactatcctgccgagcatcacaaagcgtatcatcatacttagcatggtaccaacaaaaaccaggacaagcacccagactactaatctacgacgcatcaaacagagcaacaggaataccagcaagattttccggatcaggatcaggaacagacttcacactaacaatatcatcactagaaccagaagacttcgcagtatattactgccaacaaagatcaaactggccaataacattcggacaaggaacaagactagaaataaaaagaacagtagcagcaccatcagtattcatattcccaccatcagacgaacaactaaaatcaggaacagcatcagtagtatgcttactaaacaacttctacccacgagaagctaaagtacaatggaaagtagacaacgcattacaatcaggaaactcacaagaaagtgtaacagaacaagactcaaaagactcaacatacagcctatcatccacactaacattatcaaaagcagactacgaaaaacacaaagtatacgcatgcgaagtcacacaccaaggactatcctcaccagtaacaaaaagcttcaacagaggagaatgc

SEQ ID NO: 46478 - RNA, 1371 nt, synthetic construct
  misc_feature 1..1371: note = derived and/or modified sequence opt6 from Olaratumab_HeavyChain1
  source 1..1371: mol_type = other RNA
caactacaattacaagaatcaggaccaggtctagtcaaaccttccgaaacattatcactaacatgtacagtatcaggaggatctataaactcctcctcatattactggggatggctaagacaatcaccaggtaaaggtttagaatggattggctcatttttctacacaggatcaacatattacaatccatcactaagatcacgcttaacgatttcagtagacacatcaaaaaatcaattctcactaatgctatcttcagtaaccgctgccgacaccgcagtatactactgtgcaagacaatcaacatactactacggatcaggaaattactatggatggttcgacagatgggaccaaggaaccctcgtaacagtttcatcagcatcaacaaaaggcccatcagtattcccactagcaccttcttcaaaatccacatccggaggcaccgctgccctaggatgcctagtcaaagactatttccctgaaccagtaacagtatcatggaattcaggcgctctaacatcaggagtacacactttcccagcagtcttacaaagctcaggtttatactcactatcatcagtagtaacagtaccctcttcatccttaggaacacaaacatacatatgtaatgtcaaccataaaccatcaaatacaaaagtagataaacgagtcgaaccaaaatcatgcgataaaacacacacatgtccaccatgcccagcccctgaactacttggaggaccatcagtcttcctattcccaccaaaaccaaaagataccctaatgatatcccgcacaccagaagtgacatgcgtagtagtagatgtatctcatgaagacccagaagtaaaatttaattggtacgtcgacggagtagaagtacacaatgctaaaacaaaacccagagaagaacaatataactctacatatcgtgtagtctcagtactaacagtcttacaccaagactggctaaacggaaaagaatataaatgcaaagtatccaacaaagcattacccgctccaatagaaaaaactatatctaaagccaaaggacaaccaagagaacctcaagtctacacattacccccttctcgagaagaaatgactaaaaaccaagtatccctaacatgtttagttaaaggcttctatccttcagacatagcagtagaatgggaatcaaacggacaaccagaaaataactacaaaacaacaccccccgtactcgattcagacggatcattctttttatactcaaaactcacagtagacaaatcaagatggcaacaaggcaatgttttttcatgttcagtaatgcacgaagcattacacaaccactatacacaaaaatcattatcactatccccaggaaaa

SEQ ID NO: 46479 - RNA, 642 nt, synthetic construct
  misc_feature 1..642: note = derived and/or modified sequence opt6 from Olaratumab_LightChain1
  source 1..642: mol_type = other RNA
gaaatagtattaacacaatcaccagccacactaagcttaagcccaggagaaagagccacattatcctgtcgagcatcacaatcagtatcatcatacctagcctggtaccaacaaaaaccaggacaagcaccaagactactcatatacgacgcatccaatagagcaaccggaataccagcaagattctcaggctcaggatcaggaacagactttactctaacaataagctcactagaaccagaagactttgcagtatactattgccaacaaagatcaaactggccacccgcattcggccaaggaacaaaagtagaaataaaacgaacagtagcagcaccatcagtattcatattcccaccatcagacgaacaattaaaatcaggtaccgcatcagtcgtatgcctactaaataacttttacccaagagaagcaaaagtacaatggaaagtagacaacgccctacaatcaggaaactcacaagaatccgtaacagaacaagactcaaaagactcaacatacagcctatcatccaccctaacactatcaaaagcagactacgaaaaacataaagtttacgcatgcgaagtaacacaccaaggactaagctcaccagtaacaaaatcatttaacagaggcgaatgc

SEQ ID NO: 46480 - RNA, 1341 nt, synthetic construct
  misc_feature 1..1341: note = derived and/or modified sequence opt6 from Olizuab_HeavyChain1
  source 1..1341: mol_type = other RNA
gaagtccaactagtagaatcaggaggaggcctagttcaaccaggaggatcattaagattatcatgcgcagtatccggatattctataacctctggatactcatggaattggataagacaagcacccggaaaaggattagaatgggtcgcatcaatcacttatgacggatcaacaaactacaacccatccgtaaaaggaagaataacaataagccgcgatgactcaaaaaacacattttacttacaaaattcactaagagcagaagacacagcagtatattattgcgcacgaggctctcactatttcggacattggcattttgcagtatggggacaaggaaccttagtaacagtatcatcagcttcaaccaaaggaccgtcagtattcccactagcaccatcttcaaaatcaacatcaggaggaaccgcagcactcggctgcctagtaaaagactacttccccgaaccagtaacagtttcatggaactcaggcgccctaacctcaggcgtacacacattccccgctgtacttcaaagctcaggactatattcactatcatctgtcgtaacagttccaagtagctctttaggaacacaaacctacatttgcaacgttaatcacaaaccatcaaatacaaaagtagataaaaaagtagaacctaaaagttgtgacaaaacacacacatgcccaccatgtcctgcaccagaacttctcggaggaccatcagtattcctcttcccaccaaaaccaaaagatacactaatatctagaacacccgaagtaacatgcgtcgtcgtagacgtctcccacgaagaccccgaagtaaaatttaattggtatgtcgatggagtagaagtccacaacgcaaaaacaaaaccacgcgaagaacaatacaactcaacatacagagtagtatccgtactaacagtactacatcaagactggctaaacggaaaagaatacaaatgcaaagtatcaaataaagctctacctgcaccaatagaaaaaacaatatctaaagcaaaaggtcagccacgagaaccacaagtatataccttaccaccctcaagagaagaaacaaaaaatcaagtatccttaacatgcctagtcaaaggattttatccatcagatatagcagtagaatgggaatctaacggacaaccagaaaataactacaaaacaacaccaccagtcttagactcagacggatcattctttctctattcaaaactaacagtcgacaaatcaagatggcaacaaggcaatgtcttctcatgctcagtacacgaagcactacataaccattacacccaaaaatcactatcactttcacctggaaaa

SEQ ID NO: 46481 - RNA, 651 nt, synthetic construct
  misc_feature 1..651: note = derived and/or modified sequence opt6 from Olizuab_LightChain1
  source 1..651: mol_type = other RNA
gacatacaattaacacaatcaccatcatcattatcagcatcagtaggagacagagtcacaatcacatgcagagcatcacaatcagtcgactacgacggagactcctacaattggtaccaacaaaaaccaggaaaagcaccaaaattattaatatacgcagcaagctacttagaatcaggagtaccatcaagattctctggatctggatcaggaacagacttcaccctaaccatatcatcattacaaccagaagacttcgcaacatattactgccaacaatcacacgaagacccatacacattcggacaaggaacaaaagtagaaataaaaagaacagtagcagcaccatcagtattcatattcccaccatcagacgaacaactaaaatcaggaacagcctcagtagtatgcctattaaacaacttctacccaagagaagccaaagtacaatggaaagtagacaacgcactacaatcaggaaactcacaagaatcagtaacagaacaagactcaaaagactcaacatactcattatcatcaacattaaccttatcaaaagcagactacgaaaaacacaaagtatacgcatgcgaagtaacacaccaaggactatcatcaccagtaacaaaatcattcaacagaggagaatgc

SEQ ID NO: 46482 - RNA, 1341 nt, synthetic construct
  misc_feature 1..1341: note = derived and/or modified sequence opt6 from Olokizumab_HeavyChain1
  source 1..1341: mol_type = other RNA
gaagtacaactagtagaatctggaggaggactagtccaaccaggcggatctttaagattatcttgcgccgccagtggattcaactttaacgattattttatgaattgggtaagacaagcaccaggaaaaggattagaatgggtagcacaaatgagaaataaaaattaccaatatggtacctattacgcagaatcactagaaggacgtttcacaatttctagagatgattcaaaaaactcactttacttacaaatgaactcattaaaaacagaagatactgcagtttattactgcgcaagagaatcgtactacggattcacatcatattggggacaaggaacactagtaactgtatcatcagcctctaccaaaggaccctcagtatttccattagcaccatgtagcagatctacatctgaaagtacagcagccctaggatgtttagttaaagattactttcctgaaccagtaacagtatcatggaactcaggagcattaacatcaggagtacacacatttccagcagtattacaatcctccggtttatattcactatcatcagtagtcacagtaccgtcttcttcactaggaacaaaaacttacacttgtaacgttgatcataaaccatcaaatacaaaagtcgataaaagagtcgaatcaaaatacggaccaccatgccctccatgcccagctcctgaattcttaggaggaccatcagtattcctatttcctccaaaacctaaagatacactcatgatcagtcgaacaccagaagtaacatgtgtagttgtagatgtctcccaagaagatcctgaagtccaatttaactggtacgtagatggagtagaagtacacaatgcaaaaactaaaccacgagaagaacaattcaactctacataccgtgtagtatccgtattaacagtacttcatcaagattggctaaatggaaaagaatataaatgcaaagtttcaaataaaggactaccctcttctatagaaaaaacaataagcaaagcaaaaggccaacctagagaaccacaagtatacacattacccccttcccaagaagaaatgaccaaaaatcaagtaagcttaacatgcctagtaaaaggattttacccatcagatatagcagtagaatgggaatccaacggacaaccagaaaataactataaaacaacaccaccagtactagactcagacggatcattctttctctactcacgtttaacagtagacaaatcaagatggcaagaaggtaacgtcttctcatgttctgtaatgcatgaagcactacataaccactatacacaaaaatcattatcactatctctcggaaaa

SEQ ID NO: 46483 - RNA, 642 nt, synthetic construct
  misc_feature 1..642: note = derived and/or modified sequence opt6 from Olokizumab_LightChain1
  source 1..642: mol_type = other RNA
gatatacaaatgacacaatcaccatcaagcctatcagcatcagtaggagatcgagtaacaataacatgtcaagcaagtcaagacataggaatatccctatcttggtaccaacaaaaaccaggaaaagcaccaaaactactaatatacaacgcaaacaacctagcagacggcgtaccatcaagattttcaggatcaggctcaggaacagacttcaccctaacaataagctcactacaaccagaagacttcgcaacatactactgcttacaacacaactccgcaccatacacattcggacaaggaaccaaactagaaatcaaaagaacagtagcagcaccatcagtattcatattcccaccatcagacgaacaactaaaatcaggaacagcatcagtagtatgcctactaaacaacttctacccaagagaagcaaaagtacaatggaaagtagacaacgcattacaatcaggaaactcacaagaatcagtaacagaacaagactcaaaagactcaacatacagcttatcatcaaccctaaccttatcaaaagccgactatgaaaaacacaaagtatacgcatgcgaagtaacacaccaaggactatcatcaccagtaaccaaatcattcaacagaggagaatgt

SEQ ID NO: 46484 - RNA, 1341 nt, synthetic construct
  misc_feature 1..1341: note = derived and/or modified sequence opt6 from Omalizumab_HeavyChain
  source 1..1341: mol_type = other RNA
gaagtacaattagtagaatcaggtggtggcctcgtacaacccggaggatcactaagactatcatgcgcagtatctggatactctataacatcaggttactcatggaattggataagacaagcacctggaaaaggcctagaatgggtagcctcaataacatatgacggatctacaaattatgcagactctgtaaaaggaagattcacaatttcaagagacgactccaaaaacactttctacctccaaatgaattcattaagagcagaagataccgcagtatactactgcgcaagaggatcacactacttcggtcattggcatttcgccgtatggggacaaggaacattagtaacagtctcttccggcccatcagtattcccactagcaccatcatcaaaatcaacatccggtggaacagcagcacttggatgtctagtaaaagactacttcccagaacccgtaacagtctcatggaactcaggagctctaacttcaggagttcatacatttccagcagtcctacaatcatctggactatactcattatcatctgtagtaacagtaccatcatcctcgttaggtactcaaacttacatatgcaacgttaaccacaaaccaagtaacaccaaagtagacaaaaaagcagaaccaaaatcttgtgataaaacccacacatgccctccatgtcctgcaccagaactacttggtggaccatcagttttcttatttccaccaaaaccaaaagatacactaatgatatcaagaacacccgaagtaacatgtgtagtagtcgatgtatctcatgaagatccagaagtaaaatttaactggtatgtagacggcgtagaagtacacaatgccaaaaccaaacccagagaagaacaatacaattcaacataccgagtagtatcagtactaaccgtactacaccaagattggctaaacggcaaagaatataaatgcaaagtatcaaataaagcactaccagcacccatcgaaaaaacaatatctaaagcaaaaggccaaccaagagaaccccaagtctacacacttccaccatcacgagacgaattaactaaaaaccaagtaagtttaacttgcttagtcaaaggattctatccatcagacatagcagtcgaatgggaatccaacggacagccagaaaacaattacaaaacaacccccccagtactagactcagacggctctttttttttatactctaaactcacagtagataaatccagatggcaacaaggcaatgtattttcttgctcagtaatgcacgaagcactacacaaccactatacacaaaaatctctaagcttatcacccggtaaa

SEQ ID NO: 46485 - RNA, 645 nt, synthetic construct
  misc_feature 1..645: note = derived and/or modified sequence opt6 from Omalizumab_LightChain
  source 1..645: mol_type = other RNA
gacatacaactaacacaatcaccatcatcactatcagcaagcgtaggagacagagtaacaataacatgcagagcatcacaatcagtagactacgacggagactcatacatgaattggtaccaacaaaaaccaggaaaagcaccaaaactactaatatacgcagcatcatacctagaaagcggagtaccatcacgattctcaggatcaggatcaggaacagacttcacactaacaatatcatcactacaaccagaagacttcgcaacatactactgccaacaatcacacgaagacccatacacattcggacaaggcacaaaagtagaaataaaacgaacagtagccgcaccaagcgtattcatattcccaccatcagacgaacaattaaaatcaggaacagcatcagtcgtatgcctactaaacaacttctacccaagagaagccaaagtacaatggaaagtcgacaacgcactacaatcaggaaactcacaagaatcagtaaccgaacaagacagcaaagactcaacctacagcctatcatcaaccttaacactatcaaaagccgactacgaaaaacacaaagtatatgcatgcgaagtaacacaccaaggattatcatcaccagtcacaaaatcattcaacaga

SEQ ID NO: 46486 - RNA, 1347 nt, synthetic construct
  misc_feature 1..1347: note = derived and/or modified sequence opt6 from Onartuzumab_HeavyChain1
  source 1..1347: mol_type = other RNA
gaagtacaattagtagaatcaggaggcggtctagtacaacctggaggatcattacgactaagttgcgcagcctctggatatacattcacaagctattggctacactgggttagacaagccccaggaaaaggattagaatgggtaggaatgatagacccatcaaactcagacacaagattcaaccctaatttcaaagatagattcacaatatcagccgacacatcaaaaaacacagcatacttacagatgaattcattacgagcagaagacactgcagtatactattgtgcaacctacaggtcatatgtaacaccattagactactggggacaaggaactctagtaacagtatcatctgcctccacaaaaggtccatctgtatttccactagcaccatcatccaaatctacatcaggaggcacagcagcattaggatgtttagtaaaagactacttcccagaaccagtaacagtatcatggaactcaggtgcactaacatcaggagtacacacttttcccgcagtcttacaatcaagtggactctattcactctcctcagtagtcacagtaccatcatcatcactaggtacccaaacctatatatgtaacgtaaaccataaaccatcaaatacaaaagtagacaaaaaagtagaaccaaaaagctgcgataaaacacatacatgcccaccatgcccagcacctgaattactcggaggaccatcagtattcctatttccaccaaaaccaaaagatacactaatgatatcacgaactcccgaagtaacatgtgttgttgtagacgtttcacatgaagatccagaagtaaaatttaactggtacgtagatggcgtagaagtacataatgcaaaaaccaaaccaagagaagaacaatataattcaacatacagagtagtatcagtactaacagtattacaccaagactggttaaacggcaaagaatacaaatgcaaagtatcaaacaaagcattaccagcaccaatcgaaaaaaccataagtaaagcaaaaggccaaccaagagaaccacaagtttacactttaccaccttccagagaagaaatgactaaaaatcaagtctcactatcctgcgcagtaaaaggattttatccatccgacatcgctgtagaatgggaatcaaatggccaaccagaaaacaattataaaaccacaccaccagttctagattcagatggatcatttttcctagtatccaaattaaccgtagacaaatcaagatggcaacaaggaaacgtattctcatgctctgtaatgcacgaagcattacacaaccactacacccaaaaatcactatcactaagtccaggaaaa

SEQ ID NO: 46487 - RNA, 681 nt, synthetic construct
  misc_feature 1..681: note = derived and/or modified sequence opt6 from Onartuzumab_HeavyChain2
  source 1..681: mol_type = other RNA
gacaaaacccacacatgcccaccatgcccagcaccagaactattaggaggaccatcagtatttctattcccaccaaaacccaaagacactctaatgatatcaagaacaccagaagtcacatgcgtagtagtagacgtatcacacgaagacccagaagtcaaattcaactggtacgtagacggagtagaagtacacaacgcaaaaacaaaacccagagaagaacaatacaactcaacataccgcgtagtatcagtattaacagtactccaccaagattggttaaacggaaaagaatacaaatgcaaagtatcaaacaaagcactaccagcaccaatagaaaaaacaatatcaaaagccaaaggacaaccaagagaaccacaagtatacacactaccaccttcaagagaagaaatgacaaaaaaccaagtctcactatggtgcctagtaaaaggcttctatccatcagacatagcagttgaatgggaatcaaacggacaaccagaaaacaactacaaaacaacaccaccagtactagactcagacggatccttcttcctatactcaaaactaacagtagacaaatcaagatggcaacaaggaaacgttttctcatgctcagtaatgcatgaagcactacacaaccactacacacaaaaatcattatcactatcaccaggaaaa

SEQ ID NO: 46488 - RNA, 660 nt, synthetic construct
  misc_feature 1..660: note = derived and/or modified sequence opt6 from Onartuzumab_LightChain1
  source 1..660: mol_type = other RNA
gacatacaaatgacacaatcaccatcatccctatccgcatcagtaggagacagagtaaccataacctgcaaatcatcacaatcactactatacacctcatcccaaaaaaactacctagcatggtaccaacaaaaaccaggaaaagcaccaaaattactaatctactgggcatctacaagagaatcaggagtaccatcaagattctcaggatcaggatcaggaaccgatttcacactaacaatatcatcattacaaccagaagacttcgctacatactactgccaacaatactacgcatacccatggacattcggacaaggaacaaaagtagaaatcaaacgaacagtagcagccccatcagtattcatcttcccaccatcagacgaacaactaaaatcaggaacagcatcagtagtatgcttactaaataacttctacccaagagaagcaaaagtacaatggaaagtagacaacgcactacaatctggaaactcacaagaatcagtaacagaacaagactcaaaagactcaacatactcattatcatcaacactaacattatcaaaagcagactacgaaaaacacaaagtatacgcatgcgaagtaacacatcaaggactatcatcaccagtaacaaaatcattcaacagaggcgaatgc

SEQ ID NO: 46489 - RNA, 1362 nt, synthetic construct
  misc_feature 1..1362: note = derived and/or modified sequence opt6 from Ontuxizumab_HeavyChain1
  source 1..1362: mol_type = other RNA
caagtacaattacaagaatcaggacccggattagtaagaccatcacaaactctatcactaacctgcaccgcatccggctacacattcacagactacgtaatacactgggtaaaacaaccacctggaagaggactagaatggataggatatataaacccttatgatgacgacacaacatacaaccaaaaatttaaaggaagagtcaccatgctagtagatacttcctcaaacacagcctatctaagattatcttcagtaacagctgaagacacagcagtatactactgcgcaagaagaggaaattcttacgacggatattttgattactcaatggactactggggttcaggaacaccagtaactgtttcttcagcatcaaccaaaggtccatccgtttttccattagcaccttcatcaaaaagcacatctggtggaaccgccgcactaggctgtttagtaaaagactacttccccgaaccagtcacagtatcatggaattcaggagccttaacctcaggagttcacacatttccagcagtactacaatcaagcggtttatattcattatcttcagtagtaaccgtaccatcttcctcactcggaacacaaacctacatatgcaacgttaaccataaaccatcaaacacaaaagtagataaaaaagtagaaccaaaatcctgcgacaaaacacatacatgtccaccttgtccagcaccagaactacttggaggcccctctgtattcttatttcctcctaaacctaaagatacacttatgataagtagaactccagaagtcacatgcgtagtagtagacgtttcacacgaagatccagaagtcaaattcaattggtacgtagacggagttgaagtacacaacgccaaaacaaaacccagagaagaacaatacaactcaacttatcgcgtagtttcagttctaacagtattacatcaagactggcttaacggaaaagaatataaatgcaaagtatccaacaaagccttaccagctccaatagaaaaaactatatccaaagccaaaggacaaccaagagaaccacaagtatataccttaccaccctcaagagacgaactgacaaaaaatcaagtatctttaacatgtctagtaaaaggattctatccatcagatattgcagtagaatgggaatcaaatggacaaccagaaaataattacaaaacaacaccaccagtattagactccgacggatttttcttcctatactccaaactaacagtcgataaatcaagatggcaacaaggcaatgtattcagctgctctgtaatgcatgaagcactacataaccactacacacaaaaatcactatcattatcacccggaaaa

SEQ ID NO: 46490 - RNA, 645 nt, synthetic construct
  misc_feature 1..645: note = derived and/or modified sequence opt6 from Ontuxizumab_LightChain1
  source 1..645: mol_type = other RNA
gacatacaaatgacacaatctccatcatcactatcagcatcagtaggcgacagagtaacaataacatgcagagcatcacaaaacgtaggaacagcagtagcatggctacaacaaacaccaggcaaagcaccaaaactactaatatattcagcatcaaacagatacacaggagtaccatcacgattttcaggatccggatcaggaaccgactacacatttacaatatcatcattacaaccagaagacatagcaacatactactgccaacaatacacaaactacccaatgtacacatttggacaaggaacaaaagtacaaataaaaagaacagtagcagctccatctgtattcatattcccaccctcagacgaacaactaaaatcaggaacagcatcagtagtatgcttactaaacaacttctacccaagagaagcaaaagtacaatggaaagtagacaatgcactacaatcaggaaacagccaagaatccgtaacagaacaagactcaaaagactcaacatactccttatcatcaacactaacactctcaaaagctgattacgaaaaacacaaagtatacgcatgcgaagtaacacaccaaggactatcatccccagtaacaaaatcattcaacagaggagaatgc

SEQ ID NO: 46491 - RNA, 1341 nt, synthetic construct
  misc_feature 1..1341: note = derived and/or modified sequence opt6 from Opicinumab_HeavyChain1
  source 1..1341: mol_type = other RNA
gaagttcaattactagaatctggcggaggcttagttcaacctggcggttcactaagactctcctgcgcggcctcaggcttcacattctcagcatatgaaatgaaatgggtacgccaagccccaggaaaaggactagaatgggtatcagtaataggaccatcaggaggcttcactttttacgcagactcagtaaaaggtagatttacaatatcaagagataatagtaaaaacacattatatttacaaatgaattcattaagagccgaagacacagcagtatattactgcgcaacagaaggtgacaacgatgcatttgatatatggggacaaggaaccacagtaacagtatcctcagcatccactaaaggaccttcagtatttcctttagcaccatcatcaaaatccacatcaggaggaactgcagcattaggttgccttgtaaaagactactttccagaacctgtaactgtaagctggaattctggagccctaacatcgggagtacacacctttcctgcagtacttcaatcatcaggattatactcattaagttcagttgtaaccgttccaagctcatcactaggaacacaaacttacatatgtaacgtaaaccacaaaccctcaaacacaaaagtagacaaaaaagtagaaccaaaatcttgcgataaaacacatacatgtccaccatgcccagcaccagaactattaggaggaccatctgtattcttattcccacccaaacctaaagacacactaatgatttccagaacccccgaagttacctgtgttgtagttgatgtaagtcatgaagacccagaagtaaaatttaactggtatgtagatggtgtagaagttcacaacgcaaaaacaaaaccaagagaagaacaatacaattcagcttaccgagtagtatctgttttaaccgtacttcaccaagactggttaaatggaaaagaatataaatgtaaagttagtaataaagcattaccagcaccaatagaaaaaaccataagcaaagcaaaaggtcaaccaagagaaccacaagtttatacattaccaccctcaagagatgaattaacaaaaaatcaagtatccttaacatgtctagttaaaggtttttacccatctgatattgcagtagaatgggaatcaaatggccaaccagaaaataactataaaacaacaccaccagtactagactcagatggctcattcttcttatattccaaattaacagtcgataaatcaagatggcaacaaggcaacgttttttcctgttcagtaatgcacgaagcattacataaccattacactcaaaagtctttatccctatcacctgga

SEQ ID NO: 46492 - RNA, 645 nt, synthetic construct
  misc_feature 1..645: note = derived and/or modified sequence opt6 from Opicinumab_LightChain1
  source 1..645: mol_type = other RNA
gacatacaaatgacccaatcaccagcaacactctcactatcaccaggagaacgagccacactatcatgcagagcatcacaatcagtatcatcatacctagcatggtaccaacaaaaacccggccaagcaccaagattactaatatacgacgcatcaaacagagccacaggaataccagcacgattctcaggatcaggatcaggaacagacttcactctaacaatatcatcactagaaccagaagatttcgcagtatattactgccaacaaagatccaactggcccatgtacacattcggacaaggaacaaaactagaaataaaaagaacagtagcagcaccatcagtattcatattcccaccatcagatgaacaactaaaatcaggaacagcatcagtagtatgcctactaaacaatttttacccccgagaagcaaaagtacaatggaaagtagacaacgcactacaatcaggaaactcacaagaatcagtaacagaacaagactcaaaagactcaacatactcactatcatcaacactaacactatcaaaagccgactacgaaaaacacaaagtatatgcatgcgaagtaacacatcaaggactatcatcaccagtaacaaaatcattcaacagaggagaatgc

SEQ ID NO: 46493 - RNA, 1941 nt, synthetic construct
  misc_feature 1..1941: note = derived and/or modified sequence opt6 from Oportuzumab_monatox_HeavyChain1
  source 1..1941: mol_type = other RNA
catcatcatcatcaccatgatatacaaatgactcaatcaccatcaagtctaagtgcctccgtaggggatagagttacaataacttgtagatcaactaaatcattactacattctaatggtatcacatacttatactggtatcagcaaaaacctggaaaagctccaaaattactaatataccaaatgtctaatttagcaagcggagtaccatcacgattttcaagtagtgggtcaggaactgattttacacttacaatatcctctctacaacccgaagattttgcaacatattattgtgcacaaaatctagagataccaagaacatttgggcaaggcacaaaagttgaactaaaacgagccactccatcacacaattcacaccaagtaccaagtgctggtggaccaactgcaaatagtggcacaagcgggagcgaagtacaactagtccaatcaggaccaggattagttcaacctggaggctccgtaagaatatcatgtgcagccagtggatacacctttacaaattatggaatgaattgggttaaacaagctcccggaaaaggattagaatggatgggttggataaatacttatacgggtgaaagtacatatgcagattcgtttaaaggaaggtttactttttctttagatacatctgcaagtgcagcttatctacaaataaacagcttacgagcagaagatactgcagtatactattgcgctagatttgctataaaaggagattactggggacaaggaacattacttactgtaagcagtgaatttggtggagctccagaatttccaaaacctagcacaccgcccggaagttcaggattagaaggtggatcattagcagctctcacagcacatcaagcttgtcatttaccactagaaacatttacaagacatagacaaccgagaggttgggaacaattagagcaatgcggatatcctgtgcaaagactagtagctctatatttagcagcacggctatcatggaaccaggtagatcaagtaatccgcaatgcactagcaagcccaggatcaggcggtgatttaggggaagcaataagagaacaaccagaacaagcaagattagcgttaacacttgcagccgcagaatcggaaagatttgtaagacaaggtacaggaaatgatgaagcaggagcagcatccgccgacgtagtatcgctaacctgccctgttgccgccggagaatgcgcaggaccagcagattcaggagatgccctattagaaagaaattacccgacaggagcagaatttctaggtgacggaggagacgtatcctttagcacaaggggaacccaaaactggactgtagaaagactattacaagctcatcgtcaattagaagaaagaggttatgtttttgtcggatatcacggaacatttcttgaagccgctcaaagtatagtatttggaggagtaagagctagatcacaagatcttgatgccatatggagaggattttatatagcaggagatccagcactagcatatggttatgcacaagaccaagaacctgatgcaagaggaagaatcagaaatggagcactactgagagtttatgtacccagaagttcattaccaggtttttaccgaacaggactaacattagcagctccagaagcagctggtgaagttgaaagactaataggtcacccattgcctctcagattagatgcaattacaggtccagaagaagaaggtggaagactagaaacaatactaggatggccattagccgagagaacagttgtaataccatcagctataccaacagatccaagaaacgttggcggagatctagatccttcctcaataccagataaagaacaagctataagcgcactaccagattatgcttctcaacctgggaaaccaccgcatcatcatcaccaccataaagatgaatta

SEQ ID NO: 46494 - RNA, 1941 nt, synthetic construct
  misc_feature 1..1941: note = derived and/or modified sequence opt6 from Oportuzumab_monatox_SingleChain_variable_fragment
  source 1..1941: mol_type = other RNA
catcatcaccatcatcacgatatccaaatgacacaaagcccatcatctttatcagcttccgtcggagatagagtaactatcacttgcagaagtacaaaatctttattacattcaaatggaataacatacctttactggtatcaacaaaaaccaggtaaagctccaaaactacttatatatcaaatgtcaaatctggcatcaggagtaccttcaagattttcatcatcaggatcagggacagattttaccctcaccatctccagcctccaacctgaagatttcgcaacttactattgtgcacaaaatttagaaatcccaagaacattcgggcaaggcacaaaagtagaactaaaaagagcaacaccttcacataattcacatcaagtcccaagcgctggaggaccaacagcaaactcaggaacttctggtagtgaagttcaattagtacaaagcggacctggacttgtacaaccaggaggatcagtcagaatatcatgtgcagcttcaggatatacattcacaaactatggcatgaactgggtgaaacaagcaccaggaaaaggactagaatggatgggatggatcaatacatatactggtgaatcgacatatgcagattccttcaaaggtagattcactttttcacttgacacttcagcttcagctgcttacctacaaataaatagtttacgagctgaagatacagcagtatattattgcgctagatttgcaataaaaggagattattggggacaaggaactttactcacagtatcatcagaattcggaggcgcacctgagtttccaaaaccatcaactcctccaggaagtagcggattagaaggaggttcactagcagcattaacagcacatcaagcatgtcatttaccactagaaacatttacaagacaccgacaaccaagaggatgggaacaactagaacaatgtggatatccagtacaaagattagtagctttatacttagcagcaagattatcctggaatcaagtcgatcaagtaatccgaaatgcattagcatcaccaggcagtggaggcgatttaggcgaagccatacgtgaacaaccagagcaagctagactagcactaacattagctgctgccgaaagcgaaagatttgtaagacaaggaacaggaaatgacgaagcaggggcggcgagtgcagacgttgtaagtttaacttgtccagttgctgctggtgaatgtgctggacctgcagattcaggcgacgcacttctagagcggaactaccctacaggcgccgaatttctaggtgatggaggagatgtaagctttagtacaagaggcactcaaaattggactgtagaaagacttctacaagcacatagacaattagaggaaagaggatacgtctttgttggatatcacggaacatttttagaagctgcacaatctatagtattcggaggagttagggcacgctcacaagacctagatgctatatggagaggattttacatagcaggagatcccgcattagcctatggatatgctcaagatcaagaaccagatgccagaggtagaatcagaaatggagctttactaagggtctatgttccacgatctagtctaccaggcttctaccgaacaggattaacattagcagctccagaagcagcgggagaagttgaaagattaataggtcatccactgccgttaagattagatgctattacaggtccagaagaagaaggcggaagattagaaactatcctaggatggccattagcagaaagaacagtcgtcataccatcagcaataccaacagatccaagaaacgtcggtggagatttagatccaagcagtataccagataaagaacaagcaatatccgctctacctgattacgcatctcaaccaggaaaaccccctcatcatcatcatcatcataaagatgaatta

SEQ ID NO: 46495 - RNA, 762 nt, synthetic construct
  misc_feature 1..762: note = derived and/or modified sequence opt6 from Oreptacog_alfa_HeavyChain1
  source 1..762: mol_type = other RNA
atagtaggaggaaaagtatgcccaaaaggagaatgtccatggcaagtattactattagtaaatggagcacaattatgtggaggaacattaataaacacaatatgggtagtatcagcagcacattgttttgataaaataaaaaattggagaaacttaatagcagtattaggagaacacgatctatcagaacatgatggagacgagcaatcaagaagagtagcacaagtaataataccaagcacatatgtacctggaacaacaaatcatgatatagcattactaagactacatcaacccgttaatttaacagatcatgttgtaccattatgtctaccagaaagaacattctcagaaagaacattagcattcgttagatttagtctagtttcaggttggggacaattattagacagaggtgcaacagcactagaattaatggtactaaatgtaccaaggctaatgacacaagactgtctacaacaatcaagaaaagtaggagattcaccaaatataacagaatatatgttttgtgcaggatatagcgatggatcaaaagatagttgtaaaggagactcaggaggtccacacgcaacacattatagaggaacatggtacttaactggaatagtatcatggggacaaggatgtgcaacagtaggacatttcggagtatacacaagagtaagtcaatacattgaatggttacaaaaattaatgagaagcgaacccagaccaggagtattattaagagcaccatttcca

SEQ ID NO: 46496 - RNA, 456 nt, synthetic construct
  misc_feature 1..456: note = derived and/or modified sequence opt6 from Oreptacog_alfa_LightChain1
  source 1..456: mol_type = other RNA
gcaaatgcatttctagaagaattaagacaaggatcactagaaagagaatgcaaagaagaacaatgtagctttgaagaagcaagagaaatattcgaagacgaagaagaaacaaaactattttggataagttatagcgatggagatcaatgtgcatcaagcccatgccaaaacggaggatcatgcaaagaccaactacaaagttatatatgtttctgtctaccagcatttgaaggaagaaattgcgaaacacataaagatgaccaactaatatgcgtaaacgaaaacggaggatgtgaacaatactgtagcgatcacaatggaacaaaaagaagctgtagatgtcacgaaggatatagcttactagcagacggagtatcatgcacaccaacagtagaatacccatgcggaaaaataccaatactagaaaaaagaaacgcaagcaaaccacaaggaaga

SEQ ID NO: 46497 - RNA, 1353 nt, synthetic construct
  misc_feature 1..1353: note = derived and/or modified sequence opt6 from Orticumab_HeavyChain1
  source 1..1353: mol_type = other RNA
gaagtacaactcctagaatcaggtggaggacttgtacaaccaggcggttcactcagattatcctgcgccgcatcaggcttcacattctccaatgcttggatgtcctgggttagacaagcaccaggaaaaggcctagaatgggtatcatctatatcagtaggcgggcatagaacttactatgcagactcagtaaaaggaagatcaacaatatcacgtgacaattccaaaaatacactatacttacaaatgaattcattaagagctgaagacacagcagtatattattgtgcaagaattagagtaggaccatccggaggagcattcgattattggggacaaggcacattagtaacagtatcatcagcatccacaaaaggaccttcagtatttccattagcaccatcatcaaaatcaacatctggcggaacagcagcactaggatgtctagtaaaagattatttccccgaaccagtaaccgtctcctggaattcaggagcactgacttccggagtccacacatttcccgcagtattacaatcatctggactatattcattatcaagtgtagtcaccgtaccttcatcttcattaggaacacaaacatacatatgcaacgtcaatcacaaaccatcaaacacaaaagtcgataagaaagtcgaaccaaaatcatgcgataaaactcacacttgtccaccatgtccagcaccagaactcctaggaggcccatcagtttttttattccctcctaaacccaaagacactctaatgatatcaagaacaccagaagtaacctgcgttgtcgtcgacgtcagccacgaagatccagaagtaaaattcaattggtatgtagacggcgtagaagtacataacgcaaaaacaaaaccaagagaagaacaatataactcaacatacagagtagtatcagtattaaccgtactacatcaagactggctaaacggtaaagaatacaaatgtaaagtcagtaacaaagcattaccagctcccatagagaaaacaatatcaaaagccaaaggacaaccacgagaaccccaagtatacacattacccccatcaagagacgaattaacaaaaaaccaagtatcactaacatgtctagtaaaaggattctacccatcagacatagccgtcgaatgggaatccaacggacaaccagaaaacaactacaaaactacaccccccgttttagactcagatggatctttctttttatactcaaaactaactgtcgacaaatcaagatggcaacaaggaaatgtattttcatgctcagtaatgcacgaagccttacacaatcactacacacaaaaatcactatcactttccccaggaaaa

SEQ ID NO: 46498 - RNA, 648 nt, synthetic construct
  misc_feature 1..648: note = derived and/or modified sequence opt6 from Orticumab_LightChain1
  source 1..648: mol_type = other RNA
caatcagtactaacacaaccaccatcagcatctggaacaccaggacaaagagtaacaatatcatgctcaggatcaaatacaaacataggaaaaaactacgtatcatggtaccaacaactaccaggcaccgcaccaaaactattaatatacgccaattcaaacagaccatccggagtaccagacagattctcaggatcaaaatcaggaacatcagcatcactagcaatatcaggactaagatctgaagacgaagcagactactactgcgcatcatgggacgcatcactaaacggatgggtattcggaggaggaacaaaattaacagtactaggacaaccaaaagccgcaccatcagtaacactattcccaccatcttcagaagaactacaagcaaataaagcaaccctagtatgcttaatatcagacttctatccaggagcagtaaccgtagcatggaaagcagactcatcaccagtaaaagccggagtagaaacaacaacaccatcaaaacaatcaaacaacaaatacgcagcatcatcatacctatcattaacaccagaacaatggaaatcacacagatcatactcatgccaagtaacacacgaaggatcaacagtagaaaaaacagtagcaccaacagaatgctca

SEQ ID NO: 46499 - RNA, 1347 nt, synthetic construct
  misc_feature 1..1347: note = derived and/or modified sequence opt6 from Otelixizumab_HeavyChain1
  source 1..1347: mol_type = other RNA
gaagtacaattactcgaatcaggaggaggcctagtacaacccggaggaagtttaagactctcatgcgccgcttcaggattcactttctcatcatttcctatggcctgggtaagacaagcaccaggaaaaggactagaatgggtaagtacaatctcaacatcaggaggtcgaacttattacagagactcagttaaaggtagatttaccatttcaagagacaatagcaaaaacacactatatctacaaatgaattcactacgagcagaagacactgcagtttattattgtgccaaattcagacaatactcaggaggctttgattactggggacaaggtactttagtaacagtatcatccgcttcaacaaaaggtccatcagtctttcccctagcaccttcatcaaaatcaacttcaggaggaaccgcagcccttggatgtctagtaaaagactacttccccgaacctgtaacagtttcatggaacagcggtgcactcacatcaggcgtacatacattcccagcagtattacaatcatcaggtctatattcattatcatcagtagtcacagtaccatcctcaagtctaggaacacaaacctatatctgcaacgtcaaccataaaccttcaaatacaaaagtagacaaaaaagtagaaccaaaatcatgtgacaaaactcacacatgtccaccatgtcctgctcctgaactattaggtggcccatcagttttcctattccctccaaaaccaaaagatacattgatgatatcaagaaccccagaagtaacttgcgttgtagtcgacgtctcacatgaagatccagaagtaaaattcaattggtatgtcgacggagtagaagtacataacgcaaaaacaaaacccagagaagaacaatatgcttcaacatatagagtagtatctgtactaacagtactacatcaagactggttaaacggaaaagaatataaatgtaaagtctcaaacaaagcattaccagcccctatagaaaaaaccatttcaaaagccaaaggacaaccccgcgaaccacaagtatatacactaccaccatcaagagatgaattaacaaaaaaccaagtctcactcacttgcttagtaaagggattttacccatcagatatcgctgtggaatgggaaagtaatggacaaccagaaaataattacaaaacaacaccaccagtattagactcagatggatctttctttttatactcaaaactaacagtcgacaaatcacgatggcaacaaggcaacgtattctcttgttccgtaatgcatgaagcccttcacaaccattatacacaaaaatctttaagtctatcccccggcaaa

SEQ ID NO: 46500 - RNA, 648 nt, synthetic construct
  misc_feature 1..648: note = derived and/or modified sequence opt6 from Otelixizumab_LightChain1
  source 1..648: mol_type = other RNA
gacatacaactaacacaaccaaactcagtatccacctccctaggatcaacagtaaaattatcatgcacattatcatcaggaaacatcgaaaacaattacgtacactggtaccaactatacgaaggaagatcaccaacaacaatgatatacgacgacgacaaaagaccagacggagtaccagacagattctcaggctcaatagacagatcatcaaactcagcattcctaacaatacacaatgtagcaatagaagacgaagcaatatacttctgccactcatacgtatcatcattcaacgtattcggaggaggaacaaaactaacagtactacgacaacccaaagcagcaccatcagtaacactattcccaccctcaagtgaagaactacaagcaaacaaagcaacattagtatgcctaatatcagacttctacccaggagcagtaacagtagcatggaaagcagactcatccccagtaaaagcaggagtagaaacaacaacaccatcaaaacaatcaaacaacaaatacgccgcatcatcatacttatcactaacccccgaacaatggaaatcacaccgatcatactcatgccaagtcacacacgaaggatcaacagtagaaaaaacagtagcaccaacagaatgctca

SEQ ID NO: 46501 - RNA, 1449 nt, synthetic construct
  misc_feature 1..1449: note = derived and/or modified sequence opt6 from Otlertuzumab_HeavyChain1
  source 1..1449: mol_type = other RNA
gaagtacaattagtccaatcaggagcagaagtcaaaaaaccaggtgaaagtttaaaaatttcttgtaaaggatccggatactcatttactggatataatatgaactgggttagacaaatgccaggtaaaggattagagtggatgggaaatatagatccttattacggtggaacaacttataatagaaaattcaaaggacaagtaaccatatcagcagacaaaagcatttcaactgcatatctacaatggtcctcactaaaagcaagcgataccgccatgtattactgcgcaagatccgtaggaccattcgacagttggggacagggaacattagtgacagtatcatcaggcggaggaggatctggaggcggaggatcaggaggaggaggaagtggaggaggaggttcaggaggaggaggttcagaaatcgtactaacacaatcaccagcaactctatcactatcaccaggggaaagagcaaccctatcatgtagagcttcagaaaatgtatattcctaccttgcatggtaccaacaaaaacctggacaagcgccgagactattaatatatttcgcaaaaacactagctgaaggaatacccgccagattctctgggtctggttcaggaactgactttacattaacaataagctcactcgaaccagaggattttgcagtgtactactgccaacaccacagcgataacccatggacattcggacaagggacaaaagtagaaataaaaggcgatcaagaaccaaaaagttcagataaaacacacacatcaccaccatgcccagcaccagaactactaggaggaccaagcgttttcttatttcctccaaaacccaaagataccctcatgatctcgagaacccccgaagtaacatgtgtagtagtagacgtttctcatgaagatcccgaagtcaaattcaattggtatgtagatggagtagaagtacacaatgccaaaactaaaccacgagaagagcaatacaattcaacatatagagtagtatctgtactcactgtcttacatcaagattggttgaatggtaaagaatacaaatgcaaagtatcaaacaaagcactcccagcgccaatagaaaaaacaatatcaaaagcaaaaggacaaccaagagaaccacaagtatacacattaccaccaagtagagatgaattaacaaaaaaccaagtctctctcacttgcttagtaaaaggcttttatccaagcgatatagcagtagaatgggaaagcaatggacaacctgaaaataattacaaaacaacaccaccagtattagattcagatggttcatttttcttatactcaaaactaaccgtagacaaaagcagatggcaacaaggtaacgtattctcatgctcagtaatgcacgaagcattacataatcattatacacaaaaaagtttatctctatccccaggaaaa

SEQ ID NO: 46502 - RNA, 1347 nt, synthetic construct
  misc_feature 1..1347: note = derived and/or modified sequence opt6 from Oxelumab_HeavyChain1
  source 1..1347: mol_type = other RNA
gaagtacaactactagaatccgggggaggcctagtccaaccaggtggttccttaagattatcctgtgctgcatcaggatttacatttaactcctatgctatgagctgggtaagacaagcacccggtaaaggtctagaatgggtttccataatatcaggatctggaggattcacatactatgccgattcagttaaaggaagatttacaatctccagagacaactcacgaacaacactctatctacaaatgaattcattaagagctgaagatactgctgtatactactgtgctaaagatcgattagtagcaccaggtacattcgattactggggacaaggagcactcgtaacagtatcttccgcctcaactaaaggaccatcagtatttcccctagcaccatcttcaaaatccactagtggaggaactgcagcattaggctgcttagtaaaagactacttcccagaacctgtcacagtatcatggaattccggagctttaacatcaggagttcacactttcccagcagtattacaatcatcaggactatactcattatcatctgtagttacagtaccaagttcatcattaggtacacaaacttacatatgcaacgtaaatcacaaaccatcaaatacaaaagttgacaaaaaagttgaaccaaaatcctgtgacaaaacacatacatgcccaccatgtccagctccagaactactcggaggcccatcagtatttttatttccaccaaaaccaaaagacacattaatgatatcacgaacacctgaagttacatgtgtagtcgtagatgtatcacacgaagacccagaagtaaaatttaactggtacgtcgacggagtcgaagtacacaacgcaaaaactaaaccaagagaagaacaatataacagtacataccgtgtagtatctgtcctaacagtacttcaccaagactggctcaatggaaaagaatataaatgtaaagtctcaaacaaagcactaccagcccctatagaaaaaacaatatcaaaagccaaaggacaaccccgagaaccacaagtatacacattacctccatcaagagacgaattaacaaaaaatcaagtatcattaacatgtttagtaaaagggttctatccatctgacattgcagtagaatgggaatcaaacggacaaccagaaaacaactacaaaactacaccaccagtactagactctgacggatccttttttctttactcaaaactaacagtcgacaaatcacgatggcaacaaggaaacgtattttcatgttcagtaatgcatgaagcactacacaaccattacacgcaaaaatcattaagtctatcaccaggt

SEQ ID NO: 46503 - RNA, 642 nt, synthetic construct
  misc_feature 1..642: note = derived and/or modified sequence opt6 from Oxelumab_LightChain1
  source 1..642: mol_type = other RNA
gacatacaaatgacacaatcaccatcatcactatcagcatccgtaggagacagagtaacaataacatgcagagcatcacaaggaatatcatcatggttagcctggtaccaacaaaaaccagaaaaagcaccaaaatccctaatatacgcagcatcctcattacaatcaggagtaccatccagattctcaggatcaggatctggcacagactttacactaacaatatcctcactacaaccagaagacttcgcaacatactactgccaacaatacaactcatacccatacacattcggacaaggaacaaaactagaaatcaaacgaacagtagcagccccatcagtattcatattcccaccatcagacgaacaactaaaatcaggcacagcatcagtcgtatgcctactcaacaacttctacccaagagaagcaaaagtacaatggaaagtagacaacgcactccaatccggaaactcacaagaatcagtaacagaacaagattcaaaagactctacatactcattatcatcaacactaacattatcaaaagccgattacgaaaaacacaaagtatacgcatgcgaagttacacaccaaggactatcctcaccagtaacaaaatcattcaacagaggagaatgc

SEQ ID NO: 46504 - RNA, 1329 nt, synthetic construct
  misc_feature 1..1329: note = derived and/or modified sequence opt6 from Ozanezumab_HeavyChain1
  source 1..1329: mol_type = other RNA
caagtacaacttgtccaatcaggagcagaggtaaaaaaacccggagcatcagtcaaagtatcatgcaaagcctcaggttacacatttacatcatattggatgcattgggtaagacaagcaccaggacaaggactagaatggataggaaacatcaatccctctaatggaggaacaaactacaacgaaaaatttaaatcaaaagcaacaatgacaagagacacatcaacctcaacagcttacatggaactatcatcactaagatccgaagacaccgcagtatattactgtgaactaatgcaaggttattggggtcaaggaacactagtaacagtctcatctgcctcaacaaaaggaccttcagtattcccactagcaccatcatcaaaatcaacctctggaggaactgcagcattaggatgtctagtaaaagattacttcccagaaccagtaaccgtatcctggaacagcggtgcattaacatcaggagtacataccttcccagctgtactacaatcatcaggactatactccttatcatccgtagttaccgtaccatccagctcacttggaacacaaacatacatatgtaacgtaaatcacaaaccatctaacactaaagtagacaaaaaagtagaaccaaaatcatgtgacaaaacacatacttgtccaccctgtcccgcccccgaactagcaggcgccccatcagtattcctttttccacccaaaccaaaagacactctaatgatctcaagaacacccgaggtaacatgcgtagtcgtagatgtaagtcacgaagacccagaagtaaaattcaactggtacgtagacggagtggaagtacacaatgcaaaaacaaaaccacgagaagaacaatacaattcaacctacagagtagtatcagtattaacagtgttacaccaagactggttaaatggaaaagaatacaaatgcaaagtttcaaacaaagcattacccgctcccattgaaaaaacaatatcaaaagccaaaggacaacccagagaaccccaagtatacaccctaccaccatcaagagacgaactaacaaaaaaccaagtatcattaacatgccttgtaaaaggcttctatccatcagacatagcagtagaatgggaatcaaacggccaaccagaaaataattacaaaacaacaccaccagtacttgactctgacggatcattcttcctatattcaaaactaactgtagataaatcaagatggcaacaaggaaacgtcttttcctgctcagtcatgcatgaagcactacacaatcactatacacaaaagtcactatcactatctcccggaaaa

SEQ ID NO: 46505 - RNA, 657 nt, synthetic construct
  misc_feature 1..657: note = derived and/or modified sequence opt6 from Ozanezumab_LightChain1
  source 1..657: mol_type = other RNA
gacatagtaatgacacaatcaccactctcaaacccagtaacactaggacaacccgtatcaatatcatgcagatcatcaaaatcactactatacaaagatggaaaaacctacttaaactggttcttacaaagaccaggacaatcaccacaattactaatatacttaatgagcacacgagcatcaggagtaccagaccgattctcaggaggaggatcaggaacagacttcactctaaaaatatcaagagtagaagcagaagacgtaggcgtatactattgccaacaactagtagaatacccactaacattcggacaaggaacaaaactagaaataaaaagaacagtagcagcaccatcagtctttatattcccaccatcagacgaacaactaaaatcaggaacagcatcagtagtatgcctactaaacaatttctacccacgagaagcaaaagtacaatggaaagtagataacgcactccaatctggaaactcacaagaatcagtaacagaacaagactcaaaagactcaacatactcactatcctcaacattaacattaagcaaagcagactacgaaaaacacaaagtatacgcatgcgaagtaacacaccaaggactatcatcaccagtaacaaaatcattcaaccgaggcgaatgc

SEQ ID NO: 46506 - RNA, 1089 nt, synthetic construct
  misc_feature 1..1089: note = derived and/or modified sequence opt6 from Ozoralizumab_HeavyChain1
  source 1..1089: mol_type = other RNA
gaagtacaattagtagaaagcggaggaggactagtgcaaccaggtgggagcctaagattaagctgtgcagcatcgggatttactttttcagattattggatgtactgggtaagacaagcaccgggaaaagggttagaatgggtaagcgaaataaacacgaatggattaataacgaaatatccagatagtgtgaaaggaaggtttacaataagtagagataatgcaaaaaacacattatatctccaaatgaatagtttaagaccagaagatacagcagtatattactgtgcaagaagtccgagtggatttaatagaggacaagggacattagtaacagtaagtagtggaggaggaggatcgggaggaggatcagaagtacaattagtagaatcaggaggaggattagtacaaccgggaaattcattaagactaagttgtgcggcttcagggtttactttttcaagtttcggaatgagttgggtaagacaagcaccgggaaaaggattagaatgggtaagtagtataagtggatcaggatcagatacgttatatgcagatagtgtgaaaggtagatttacgataagtcgagataacgccaaaacaacactatatctacaaatgaatagtttaagacctgaagacacagctgtgtattactgtacgataggaggaagcttaagtcgctcatcacaaggaacattagtaacagtaagtagtggaggtggaggaagcggaggaggatcagaagtacaattagtagaatcaggaggagggttggtacaacctggaggaagtttaagactaagctgtgcagcaagtggatttacatttagtgactattggatgtattgggtacgacaagcgccaggaaaaggattagaatgggtaagtgaaataaatacaaatggtttaataacaaaatatccagatagcgtaaagggaagatttacaataagtagagataatgcaaaaaatactttatatttacaaatgaacagcttaagaccagaagatacagcagtatattattgtgcaagaagtccatcaggatttaatagaggacaagggacattagtaacagttagttca

SEQ ID NO: 46507 - RNA, 1350 nt, synthetic construct
  misc_feature 1..1350: note = derived and/or modified sequence opt6 from Palivizumab_HeavyChain
  source 1..1350: mol_type = other RNA
caagtaaccctaagagaatcaggaccagcattagtaaaacctacccaaacattaacactaacatgcactttttcaggcttctcactctcaacatcaggaatgtcagtaggatggataagacaaccaccaggaaaagctttagaatggctagcagacatatggtgggacgataaaaaagactataatccatctttaaaatcacgtctaacaataagcaaagatacatcaaaaaatcaagtagtattaaaagtcacaaacatggatccagcagacacagcaacttactactgcgcacgatcaatgataacaaattggtattttgacgtttggggcgcaggaacaacagtaaccgtatcatctgcatcaaccaaaggtccttcagtattcccattagcaccatcatccaaaagtacatcaggcggcacagccgcactaggctgcttagtaaaagactactttccagaaccagtaacagtctcttggaactctggagcattaacatcaggcgtacacacattccctgcagtactccaatcatcaggactatactccctaagctcagtagtaacagtcccatcatcatcactcggaacacaaacctacatatgtaacgtcaaccataaaccatcaaacactaaagttgataaaagagttgaaccaaaatcttgcgacaaaacacatacatgcccaccatgcccagctcccgagttattaggtggaccctcagtattcctcttcccaccaaaacccaaagatacactaatgatatcaagaacaccagaagtaacatgcgtagttgtcgacgtctcacacgaagatccagaagtaaaatttaactggtacgtagacggagtagaagtacataacgcaaaaactaaaccaagagaagaacaatacaacagcacatatagagtagtatcagtactaacagtactacaccaagactggctaaacggaaaagaatataaatgtaaagtatcaaacaaagccctacctgcaccaattgaaaaaacaatatccaaagcaaaaggacaaccaagagaaccacaagtatacacactaccaccatctagagaagaaatgacaaaaaatcaagtatcactcacttgcctagtaaaaggtttctacccatcagacatagcagtagaatgggaatccaacggccaacccgaaaacaattataaaacaactccacccgtactagactcagatggatcttttttcctttactcaaaactaacagtagataaatcacgatggcaacaaggaaatgtattttcatgctcagtaatgcacgaagcactccataatcactacacacaaaaatcactatcattatctccaggaaaa

SEQ ID NO: 46508 - RNA, 639 nt, synthetic construct
  misc_feature 1..639: note = derived and/or modified sequence opt6 from Palivizumab_LightChain
  source 1..639: mol_type = other RNA
gacatacaaatgacacaatcaccatcaacactatcagcatcagtaggagacagagtaacaataacatgcaaatgccaattatcagtcggatatatgcactggtaccaacaaaaacctggaaaagcaccaaaattactaatatacgacaccagtaaactagcaagcggagtaccaagcagattctcaggatcaggatcaggaacagaattcacactaacaatatcatcactacaaccagacgacttcgcaacatattactgcttccaaggatcaggatacccattcacattcggaggtggaacaaaactcgaaataaaaagaacagtagcagcaccaagcgtattcatatttccaccatcagacgaacaattaaaatcaggaacagcatcagtagtatgcctattaaacaacttctacccaagagaagcaaaagtacaatggaaagtagacaacgcactacaatccggaaactcacaagaatcagtaacagaacaagactcaaaagactcaacatactcactatcatcaacactaacattaagcaaagcagactacgaaaaacataaagtatacgcatgcgaagtaacacaccaaggattatcatcaccagtaacaaaaagcttcaacagaggagaatgt

SEQ ID NO: 46509 - RNA, 360 nt, synthetic construct
  misc_feature 1..360: note = derived and/or modified sequence opt6 from Palivizumab_VH-Region
  source 1..360: mol_type = other RNA
caagtaacattaagagaaagtggaccagcactagtaaaaccaacacaaacattaacattaacatgtacatttagcggattctcactatcaacatcaggaatgagcgtaggatggataagacaaccaccaggaaaagcactagaatggttagcagatatatggtgggatgacaaaaaagattacaatccatcactaaaaagtagattaacaatatcaaaagatacatcaaaaaatcaagtagtattaaaagtaacaaatatggatccagcagacacagcaacatactattgcgcaagatcaatgataacaaattggtatttcgatgtatggggagcaggaacaacagtaacagtaagctca

SEQ ID NO: 46510 - RNA, 1347 nt, synthetic construct
  misc_feature 1..1347: note = derived and/or modified sequence opt6 from Pamrevlumab_HeavyChain1
  source 1..1347: mol_type = other RNA
gaaggacaactagtacaaagcggaggaggactagtacatccaggtggaagcttaagattatcttgtgcaggaagcggatttactttttccagttatggaatgcattgggtaagacaagcaccaggaaaaggcctagaatgggtaagtggaataggtaccggaggaggaacatattcaacagattccgtaaaaggacggtttacaataagtagagataatgcaaaaaatagtttatacttacaaatgaactctttaagagccgaagatatggctgtatattactgcgcaagaggtgactattatggatcaggatcattcttcgattgttggggacaaggaacattagtaacagtctcatccgcatctactaaaggaccatcagtattcccattagcaccttcatctaaatcaacaagtggaggaacagcagccctaggatgcctagtaaaagattactttccagaaccagtcacagtatcatggaactctggagccctaacatcaggagtacatacattcccagcagtactacaaagctcaggtctatattcattatcatcagtagtaacagtcccttcatcaagcttaggtacacaaacatatatttgcaatgttaatcataaaccaagcaacacaaaagtcgacaaaagagtagaaccaaaatcttgtgataaaacacacacatgtcctccctgtccagctccagaactattaggaggaccatcagtatttttatttccaccaaaacctaaagacacactaatgatatccagaactccagaagtaacatgtgtagtagtagatgtttcacacgaagatccagaagtaaaatttaactggtacgtagatggagtagaagtccataatgcaaaaacaaaaccaagagaggaacaatataactcaacttatagagtagtatcagtacttactgtattacaccaagactggttaaatggaaaagaatataaatgtaaagtatcaaacaaagcattaccagcacctatcgaaaaaacaatctcaaaagcaaaaggacaaccaagagaaccccaagtatatacattaccaccatctagagaagaaatgacaaaaaatcaagtatcactaacatgtttagtcaaaggtttctacccatcagacatagctgtagaatgggaaagcaacggtcaaccagaaaacaactacaaaactacacctccagtactagatagcgatggatctttttttttatacagcaaattaactgtagacaaatcaagatggcaacaaggaaatgtattttcatgtagtgtaatgcatgaagcactacacaaccattatacacaaaaaagcttatctctttcaccagga

SEQ ID NO: 46511 - RNA, 642 nt, synthetic construct
  misc_feature 1..642: note = derived and/or modified sequence opt6 from Pamrevlumab_LightChain1
  source 1..642: mol_type = other RNA
gacatacaaatgacacaatcaccctcatccctctcagcatcagtaggagacagagtaacaataacctgccgagcatcacaaggaatatcatcatggctagcatggtaccaacaaaaaccagaaaaagcaccaaaatcattaatatacgccgcatcatcactacaatccggagtaccatccagattctcaggatcaggatcaggaacagacttcacattaacaatatcatcactacaaccagaagacttcgccacatactactgccaacaatacaactcataccccccaacattcggacaaggaacaaaattagaaataaaaagaacagtagccgcaccatcagtattcatattcccaccatcagacgaacaattaaaatcaggaaccgcatctgtagtatgcctactaaacaacttctatccaagagaagctaaagtacaatggaaagtagacaacgcactacaatcaggaaactcacaagaatcagtaacagaacaagactccaaagactcaacatactcattatcatcaacactaaccctatcaaaagcagactacgaaaaacacaaagtatacgcatgcgaagtaacacaccaaggactaagctcaccagtaacaaaatcatttaacagaggagaatgt

SEQ ID NO: 46512 - RNA, 1305 nt, synthetic construct
  misc_feature 1..1305: note = derived and/or modified sequence opt6 from Panitumumab_HeavyChain1
  source 1..1305: mol_type = other RNA
caagtacaactacaagaatcaggacctggactagttaaaccatcagaaactctatcactaacttgcacagtatccggaggatcagtaagctcaggagactattactggacatggataagacaatccccaggaaaaggattagaatggataggccacatatattactccggaaatacaaattacaacccatcacttaaatcaagactcacaatatcaatcgatacatcaaaaacccaattctctttaaaactatcatccgtaacagcagcagataccgcaatatactactgcgtaagagacagagtcacaggagcattcgacatctggggacaaggaacaatggtaacagtctcatccgcgtcaacaaaaggcccatcagtatttccattagcaccatgctctagaagcacatcagaaagtacagcagcactaggttgcttagtaaaagattactttccagaaccagtcacagtatcatggaactcaggagccctaacatcaggagtacataccttcccagctgtattacaatcatccggattatactccctatcatcagtagttacagttccatcatcaaacttcggaacccaaacgtatacatgcaatgtagaccacaaaccttcaaacacaaaagtagacgaaagaaaatgctgtgtagaatgcccagcaggtccatcagtattcctattcccacctaaacctaaagatacactaatgatatccagaaccccagaagtcacatgcgtagtagtagacgtatctcacgaagatcccgaagtccaatttaactggtacgtagatggcgtagaagtacacaatgcaaaaacaaaacccagagaagaacaattcaattcaacattcagagtagtatctgtacttacagtagtacatcaagactggctaaatggtaaagaatataaatgtaaagtatcaaataaaggattacccgcaccaattgaaaaaacaataagcaaaacaaaaggacagccaagagaacctcaagtatatacattacctccatccagagaagaaatgacaaaaaatcaagtttccttaacatgcctagtaaaaggattctatccatcagacatagcagttgaatgggaatcaaatggacaaccagaaaataattacaaaacaacaccacccatgctagattcagatggctcattcttcctctattcaaaactcacagtagacaaatcacgatggcaacaaggaaacgtcttttcttgtagtgtaatgcatgaagcattacacaaccactatacccaaaaaagtttatcattatctccaggaaaa

SEQ ID NO: 46513 - RNA, 642 nt, synthetic construct
  misc_feature 1..642: note = derived and/or modified sequence opt6 from Panitumumab_LightChain1
  source 1..642: mol_type = other RNA
gacatacaaatgacacaatcaccatcatcactatcagcatcagtaggagaccgagtaacaataacctgccaagcatcacaagacataagcaattacctaaactggtaccaacaaaaaccaggaaaagcaccaaaactactaatatacgacgcatcaaacctagaaacaggagtaccatcaagattctcaggatcaggatcaggaacagacttcacatttacaatatcatcattacaaccagaagacatagcaacatacttctgccaacacttcgaccatctaccactagcattcggaggaggaacaaaagtagaaataaaacgaacagtcgcagcaccaagcgtattcatattcccaccatcagacgaacaactaaaatcaggcacagcatcagtagtatgcttattaaacaacttctatccacgagaagcaaaagtccaatggaaagtagacaatgcactacaatcaggaaactcacaagaaagcgtaacagaacaagacagcaaagactcaacatatagcctatcatcaaccctaacattatccaaagcagactacgaaaaacacaaagtatacgcatgcgaagtaacacaccaaggactatcttcaccagtaacaaaatcattcaacagaggagaatgc

SEQ ID NO: 46514 - RNA, 1326 nt, synthetic construct
  misc_feature 1..1326: note = derived and/or modified sequence opt6 from Pankoab_HeavyChain1
  source 1..1326: mol_type = other RNA
gaagtacaactcgtcgaatcaggtggaggcttagtacaaccaggaggatcaagattatcatgtgtagcatccggatttccattttcaaactactggaattgggtaagacaagcaccaggaaaaggattagaatgggtaggagaaataagactaaaatcaaacaactacacaacacactacgcagaatccgtaaaaggtagattcacaataagccgagacgactcaaaaaactctttataccttcaaaactcattaaaaacagaagatacagcagtatattattgtacaagacattactactttgattattggggacaaggcacattagtaacagtatcatcggcatcaacaaaaggtccttcagtatttcccttagcaccatcatccaaaagcacatcaggtggaactgcagccttaggctgcctagtaaaagattacttcccagaacccgtaacagtatcctggaattctggtgccctaacatccggagtacacacttttccagcagtattacagtcctcaggactttactcactaagctcagtagtaacagtcccatcatcctcattaggcacacaaacatacatatgcaatgtaaaccacaaaccatctaacaccaaagtcgataaaaaagtagaaccgaaatcctgcgacaaaacacatacatgcccaccatgcccagcaccagaactactaggaggaccatcagtatttctattcccaccaaaaccaaaagacaccttaatatcacgaactccagaagtcacatgtgttgtagtagacgtatcacatgaagaccctgaagtcaaattcaactggtacgtcgacggagtagaagtccacaatgcaaaaacaaaaccaagagaagaacaatacaactctacataccgagtagtatcagttctaacagtattacaccaagactggcttaatggaaaagaatataaatgtaaagtatcaaacaaagcattaccagcaccaatagaaaaaacaatatcaaaagccaaaggacaaccaagagaaccccaagtttacacactaccaccatcacgagatgaactaacaaaaaaccaagtatcactaacatgtctagtaaaaggcttctatccatccgacatagctgtagaatgggaatcaaacggacaaccagaaaacaactacaaaacgacacccccggtacttgactcagacggttcattctttctatactctaaattaacagtagacaaatcaagatggcaacaaggaaatgtattctcctgctctgtacacgaaggactacataaccactacacacaaaaaagcttatcactatcaccaggaaag

SEQ ID NO: 46515 - RNA, 651 nt, synthetic construct
  misc_feature 1..651: note = derived and/or modified sequence opt6 from Pankoab_LightChain1
  source 1..651: mol_type = other RNA
gatatagtaacacaatcaccactatcaaaccccgtaacaccaggagaaccagcatcaatatcctgccgatcatcaaaatccctacttcactccaacggaataacctacttcttctggtacctacaaaaaccaggacaatcaccacaattattaatataccaatccaacctcgcatcaggagtaccagacagattctcaggatcaggatcaggaacagacttcaccctacgaatttcaagagtagaagcagaagacgtaggagtatactactgcgcacaaaacctagaattaccaccaacattcggacaaggaacaaaagtagaaataaaacgcacagtagcagcaccatctgtattcatattcccaccatcagacgaacaactaaaatcaggaacagcatcagtcgtatgcctactaaacaacttctacccaagagaagccaaagttcaatggaaagtcgacaacgcactacaatccggaaactcacaagaatccgtaaccgaacaagactccaaagactcaacatactcattatcatcaacactaacactatcaaaagccgactacgaaaaacacaaagtatacgcatgcgaagtaacacaccaaggattatcctcaccagtaacaaaatcatttaacagaggagaatgc

SEQ ID NO: 46516 - RNA, 651 nt, synthetic construct
  misc_feature 1..651: note = derived and/or modified sequence opt6 from Pankoab_LightChain2
  source 1..651: mol_type = other RNA
gacatagtaacacaatcaccattatcaaacccagtaacacccggagaaccagcatcaataagctgccgatcatcaaaatcactactacactcaaacggcataacatacttcttctggtacctacaaaaaccaggacaatccccacaactactaatataccaatcaaacttagcatcaggagtaccagacagattctcaggatcaggatcaggaaccgacttcacattacggataagcagagtagaagcagaagatgtaggagtatactactgcgcaggaaacctagaactaccaccaaccttcggacaaggaacaaaagtagaaataaaaagaacagtagcagcaccatcagtattcatatttccgccatcagatgaacaactaaaatcaggaacagcatccgtagtatgcttactaaacaacttttacccaagagaagcaaaagtacaatggaaagtagacaacgccttacaaagcggcaactcacaagaatcagtaacagaacaagactcaaaagactcaacatactcactatcatcaacactaacactatcaaaagcagactacgaaaaacacaaagtatacgcatgcgaagtaacacaccaaggcctatcatcaccagtaacaaaatcattcaacagaggagaatgt

SEQ ID NO: 46517 - RNA, 351 nt, synthetic construct
  misc_feature 1..351: note = derived and/or modified sequence opt6 from PankoMab_HeavyChain_VDJ-Region
  source 1..351: mol_type = other RNA
gaagtaaaactagtagaatcaggaggaggattagtacaaccaggaggatcaatgaaactatcatgcgtagcatcaggatttacattcagcaattactggatgaactgggtaagacaaagcccagaaaaaggattagaatgggtagcagaaataagactaaaatcaaacaattacacaacacattacgcagaatcagtaaaaggaagattcacaatatcaagagacgactcaaaatcaagcgtaagcctacaaatgaacaatctaagagtagaagacacaggaatatactactgcacaagacattactatttcgactactggggacaaggaacaacattaacagtaagctca

SEQ ID NO: 46518 - RNA, 339 nt, synthetic construct
  misc_feature 1..339: note = derived and/or modified sequence opt6 from PankoMab_LightChain_VJ-Region
  source 1..339: mol_type = other RNA
gacatagtaatgacacaagcagcattctcaaacccagtaacactaggaacatcagcatcaatatcatgcagatcatcaaaatcactactacactcaaacggaataacatacttcttctggtacctacaaaaaccaggactatcaccacaactactaatataccaaatgtcaaacctagcatcaggagtaccagaccgattctcaagctcaggatcaggaacagacttcacactaagaatatcaagagtagaagcagaagacgtaggagtatactactgcgcacaaaacctagaactaccaccaacattcggaggaggaacaaaactagaaataaaaaga

SEQ ID NO: 46519 - RNA, 1707 nt, synthetic construct
  misc_feature 1..1707: note = derived and/or modified sequence opt6 from Panobacumab_HeavyChain1
  source 1..1707: mol_type = other RNA
gaagaacaagtagttgaatctggtggaggctttgtacaacctggaggaagtcttcgtttatcatgcgcagcatcaggctttacttttagtccatactggatgcattgggtaagacaagcaccaggaaaaggactcgtttgggtatctcgaattaattcagatggatcgacttattatgcagattcagtaaaaggaagatttacaatatcacgggataatgcacgaaacaccctatatctacagatgaattcattacgcgctgaagataccgcagtttattattgtgctagagatagatattacggtccagaaatgtggggccaaggaacaatggtaacagtctcttcaggaagtgcatctgcaccaacactatttccattagtatcctgtgaaaattcaccatcagacacatccagtgttgcagtaggctgcttagcacaagactttctaccagattcaataaccttctcatggaaatacaaaaacaactcagatatatcatccacaagaggcttccccagcgtactaagaggcggaaaatacgcagcaacctcacaagttctattaccatcaaaagacgtaatgcaaggtacagacgaacatgtagtatgcaaagtacaacatccaaatggaaacaaagaaaaaaacgtaccattacctgtaatagcagaactcccaccaaaagtaagcgtatttgttccacctagagatggattttttggaaatccaagaaaatccaaactaatatgccaagcaacaggattctcacccagacaaatccaagtatcttggttaagagaaggaaaacaagtaggatcaggagttacaacagatcaagtacaagccgaagcaaaagaatcaggtcctacaacctacaaagtaacatcaaccttaacaataaaagaaagtgattggctttcacaatcaatgttcacatgtagagtagatcatcgaggtctaacattccaacaaaatgcatctagcatgtgcgtacctgatcaagatacagctataagagtatttgctataccaccatcatttgcaagcattttcctcacaaagtctacaaaactgacttgtcttgtaaccgatctcactacttatgattccgtaactatctcatggacaagacaaaatggagaagcagtaaaaacacatactaatatatccgaatcacatccaaatgcaacattcagtgcagttggtgaagcaagcatctgcgaagatgactggaattcaggagaaagatttacatgtacagttacacataccgatctaccatccccacttaaacaaaccatatcaagaccaaaaggagtcgccctacatcgaccagatgtgtatttattacctccagcaagagaacaattaaacttaagagaatccgcaacaatcacatgtctagtaacaggtttttccccagctgatgtttttgtacaatggatgcaacgaggtcaaccactatcaccagaaaaatatgttacaagcgcaccaatgccagaacctcaagcaccaggcagatacttcgctcattcaatactaacggtttctgaagaagaatggaatacaggagaaacttacacatgtgtagtagcacacgaagcactaccaaacagagtaactgaaagaacagtagataaaagcacaggcaaaccaacattatataacgtatcattagttatgtctgatacagcaggcacttgttat

SEQ ID NO: 46520 - RNA, 657 nt, synthetic construct
  misc_feature 1..657: note = derived and/or modified sequence opt6 from Panobacumab_LightChain1
  source 1..657: mol_type = other RNA
gacgtagtaatgacacaatcaccactatcactaccagtcacattaggacaaccagcatcaatatcatgcagatcatcacaatcactagtctactcagatggaaacacatacctaaactggttccaacaaagaccaggacaatcaccaagaagactaatatacaaagtatcaaacagagactcaggagtaccagacagattttctggatcaggatcaggaacagacttcacactaaaaataagccgagtcgaagcagaagacgtaggcgtatactactgcatgcaaggaacccactggccactaacattcggaggaggaaccaaagtagaaataaaaagaacagtagcagcaccatcagtattcatattccccccatcagacgaacaactaaaatcaggcacagcctcagtcgtatgcctactaaacaacttttacccaagagaagcaaaagtacaatggaaagtagacaacgcattacaaagcggaaactcacaagaatcagtaacagaacaagactcaaaagacagcacatactcactatcatcaacattaactttaagcaaagcagactatgaaaaacataaagtatacgcatgcgaagtaacccaccaaggactctcatcaccagtaacaaaatcattcaacagaggagaatgt

SEQ ID NO: 46521 - RNA, 414 nt, synthetic construct
  misc_feature 1..414: note = derived and/or modified sequence opt6 from Panobacumab_LightChain2
  source 1..414: mol_type = other RNA
ggagatgacgaagcaacaatattagcagataacaaatgcatgtgcacaagagtaacatcaagaataataccaagcacagaagatccaaatgaagatatagtagaaagaaacataagaatagtagtaccattaaacaatagagaaaacataagcgatccaacaagcccactaagaagaaatttcgtataccatctatcagacgtatgcaaaaaatgtgacccagtagaagtagaactagaagaccaagtagtaacagcaacacaaagcaatatatgtaacgaagacgatggagtaccagaaacatgttacatgtacgacagaaataaatgttacacaacaatggtaccactaagataccatggagaaacaaaaatggtacaagcagcattaacaccagactcatgctatccagat

SEQ ID NO: 46522 - RNA, 1359 nt, synthetic construct
  misc_feature 1..1359: note = derived and/or modified sequence opt6 from Parsatuzumab_HeavyChain1
  source 1..1359: mol_type = other RNA
gaagtacaactagtcgaatctggaggcggtctagtacaaccaggaggctccctacgtttatcctgcgcagcaagtggttacacatttatagactactatatgaattgggtaagacaagctcccggcaaaggactagaatgggtaggcgacataaacctagataacagtggaacacactacaaccaaaagttcaaaggacgcttcacaatatccagagataaatcaaaaaacacagcctatctacaaatgaactcactacgagcagaagacacagcagtatactactgcgcaagagaaggagtataccatgactacgacgactacgcaatggactactggggacaaggaacattagttacagtctctagcgcaagcacaaaaggtccatcagtattcccactcgctccatcctcaaaatcaacatcaggaggcaccgcagcactaggatgcctagtaaaagactacttcccagaaccagtaacagtttcatggaactcaggagcactaacatctggagtacatacatttccagccgtattacaatcaagtggtttatactcactatcatcagtagtaacagtacctagctcatcactcggaactcaaacttatatatgtaacgtaaaccacaaaccatcaaatacaaaagtagacaaaaaagtagaaccaaaatcatgcgacaaaacacatacatgccctccatgtccagcacccgaactcttaggaggaccttcagtcttcctattcccacccaaaccaaaagataccttaatgatatcacgaacccctgaagtaacatgcgttgttgtagatgtatcacacgaagacccagaagttaaattcaattggtatgttgacggagtagaagtccacaacgctaaaactaaaccaagagaagaacaatacaattcaacatacagagttgtatcagtactaaccgtattacaccaagattggctaaatggaaaagaatataaatgtaaagttagcaataaagccttaccagcaccaatagaaaaaacaatatcaaaagccaaaggtcaacctcgcgaaccacaagtatacacattaccacccagccgtgaagaaatgacaaaaaatcaagtctccttaacctgcctcgtaaaaggattttacccatcagatatagcagtagaatgggaatctaacggtcaaccagaaaataactacaaaacaacaccaccagtattagactctgatggatctttcttcttatactcaaaattgacagtagacaaatcaagatggcaacaaggaaacgtcttttcatgcagtgtaatgcacgaagcattacataatcattacacacaaaaatcactatcactttcacctggtaaa

SEQ ID NO: 46523 - RNA, 657 nt, synthetic construct
  misc_feature 1..657: note = derived and/or modified sequence opt6 from Parsatuzumab_LightChain1
  source 1..657: mol_type = other RNA
gatatacaaatgacacaatcaccatcatcactatcagcatcagtaggagacagagtaacaataacatgcagaacctcacaatccctagtacacatcaacgcaataacatacctacactggtaccaacaaaaaccaggaaaagcaccaaaactattaatatatagagtatcaaacagattctcaggagtaccatcacgattctctggatcaggatcaggaacagacttcacactaacaatatcctcactacaacccgaagacttcgcaacatactactgcggacaatcaacacacgtaccactaacattcggacaaggaacaaaagttgaaataaaacgaacagtagcagcaccatcagtattcatattcccaccatcagacgaacaactaaaatcaggaacagcatcagtagtatgtctactaaacaacttctaccccagagaagccaaagtccaatggaaagtagacaacgcactacaatcaggaaactcacaagaatcagtaacagaacaagactcaaaagactctacatatagcttatcatcaaccctaacactatcaaaagcagattacgaaaaacacaaagtatacgcatgtgaagtaacacaccaaggattatcatcaccagtaacaaaatcattcaatagaggcgaatgc

SEQ ID NO: 46524 - RNA, 1353 nt, synthetic construct
  misc_feature 1..1353: note = derived and/or modified sequence opt6 from Pascolizumab_HeavyChain1
  source 1..1353: mol_type = other RNA
caggtaacattaagagaatcaggaccagctttagttaaaccaacccaaacactaacattaacctgtacattttctggattttcactatcaacatcaggaatgggagtatcatggattagacaaccaccaggcaaaggactagaatggctagcacacatatactgggatgacgacaaacgatataacccatcattaaaatcacgactaacaatctcaaaagacacatcacgcaaccaagtcgtcctaacaatgacaaacatggacccagtagacacagctacttactactgcgccagacgagaaacagtattctattggtactttgacgtatggggaagaggaactcctgtaacagtatcatcagcctcaacaaaaggcccaagtgtatttcctctagccccatcatcaaaatcaacatctggaggcactgcagcactaggatgcctcgtcaaagattacttcccagaaccagtcacagtatcttggaatagcggagcactcacatcaggcgtacacactttcccagcagtactccaatcatcaggtttgtactcattatccagcgtagtaacagtaccctcctcatcacttggaacacaaacctacatatgtaacgtaaaccacaaaccatccaacaccaaagtagataaaagagtagaacctaaatcatgcgataaaacacacacatgcccaccatgtccagccccagaactcttaggaggaccctcagtattcttatttccaccaaaaccaaaagatacacttatgatctcacgaacccctgaagtcacctgtgtagtcgtcgacgtatcacatgaagatccagaagtaaaattcaactggtacgtagacggagtagaagtacataacgcaaaaacaaaaccaagagaagaacaatacaactcaacatacagagtagtatcagtactaacagtactccaccaagactggttaaacggtaaagaatacaaatgtaaagtatcaaacaaagccctaccagctccaatagaaaaaaccatctcaaaagctaaaggacaacccagagaaccacaagtatacacactaccaccatccagagaagaaatgacaaaaaatcaagtatcattaacatgtctagttaaaggtttctacccatcagatatagccgtagaatgggaatcaaacggacaaccagaaaacaattataaaacaacaccacctgtattagactcagacggaagtttcttcctatactcaaaactcaccgtagacaaatcaagatggcaacaaggaaacgtcttttcttgttcagtaatgcacgaagcactacacaaccactacactcaaaaatcattatcactttcacctggaaaa

SEQ ID NO: 46525 - RNA, 654 nt, synthetic construct
  misc_feature 1..654: note = derived and/or modified sequence opt6 from Pascolizumab_LightChain1
  source 1..654: mol_type = other RNA
gacatagtcttaacacaatcaccatccagcctatccgcatcagtaggagacagagtaacaataacatgtaaagcatcacaatcagtagactacgacggagactcatacatgaactggtaccaacaaaaacccggaaaagcaccaaaattactaatatacgccgcatcaaatttagaatcaggaataccatccagattctcaggatcaggatcaggaacagatttcacattcacaatatcatcactacaacccgaagacatagcaacatactactgccaacaatcaaacgaagacccaccaacattcggacaaggaacaaaagtagaaataaaaagaacagtcgcagcaccatcagtattcatattcccaccatcagacgaacaactaaaatcaggcacagcatcagtcgtatgcttactaaacaacttctacccaagagaagcaaaagtccaatggaaagtagacaacgcactacaatcaggaaactcacaagaatcagtaacagaacaagacagcaaagactcaacatactcactatcatcaacactaacactctccaaagccgactacgaaaaacacaaagtatacgcatgcgaagtaacacaccaaggactaagctcacccgtaacaaaatcatttaatcgaggagaatgc

SEQ ID NO: 46526 - RNA, 1512 nt, synthetic construct
  misc_feature 1..1512: note = derived and/or modified sequence opt6 from Pasotuxizumab_HeavyChain1
  source 1..1512: mol_type = other RNA
caagtacaattagtagaaagtggcgggggattagtaaaacccggagaatcattaagattatcatgtgcagcttcaggattcacatttagtgattattatatgtactgggtacgacaagcaccgggaaaaggactagaatgggtagcaattatatctgatggaggatattatacatactatagtgatataattaaaggaagatttactatatcgagggacaatgcaaaaaactcattatacctacaaatgaactcacttaaagcagaagacacagcagtatattattgtgcaagaggatttcctttattacgacatggcgcaatggactattggggacaaggaacattagtaacggtaagttcaggaggaggtggatcaggagggggcggatcaggaggaggaggatcagatatacaaatgacacaatcaccatcaagtttatcagcatcagtaggagacagagtaactataacatgtaaagcatcacaaaatgtagacacaaatgtagcatggtaccagcaaaaaccaggtcaagcaccaaaatcattaatatattcagcaagttatagatacagcgatgtaccaagcagattctcaggatcagcatcaggaactgacttcaccctaacaatatcatcagtacaaagtgaagattttgccacttattattgtcaacaatatgattcatatccatatacatttggaggaggaacaaaattagaaattaaatcaggagggggagggtcggaagttcaattagtagaaagtggcgggggtttagtgcaaccaggcggaagtttgaaacttagctgcgcagcaagtggatttacatttaataaatacgcaatgaattgggtaagacaagcaccaggaaaaggattagaatgggtcgcgagaataagaagtaaatataacaattatgccacatattatgcggactcagtaaaggatagatttacaatatcaagggatgactcaaaaaacacagcttatttacagatgaataatttaaaaacagaagacacagctgtatactattgcgtaagacacggaaactttggaaattcatacataagttattgggcatactggggacaagggactctagttacagttagcagtggagggggaggtagtggaggaggaggtagcggagggggtggatcacaaacagtagtaactcaagaaccaagtttaacagtaagtccaggcggaacagtgacattaacatgtggatcaagtacaggagctgtaacgtcaggaaattatcctaattgggtacaacaaaaaccaggtcaagcaccaagaggccttataggaggaacaaaatttttagcaccaggaacaccagctagattttcaggaagcttactaggaggaaaagcagcacttacactatcaggagtacaaccagaagatgaagcagaatattattgtgtactctggtatagtaacagatgggtatttggaggtggaacaaaattaacagtgttacaccatcatcatcatcat

SEQ ID NO: 46527 - RNA, 1512 nt, synthetic construct
  misc_feature 1..1512: note = derived and/or modified sequence opt6 from Pasotuxizumab_SingleChain
  source 1..1512: mol_type = other RNA
caagtacaactagtgcaatcaggaggaggtttggtaaaaccaggagaaagtctacggttatcatgtgcggcttcaggatttacatttagcgattactatatgtactgggtaagacaagcaccaggaaaagggttagaatgggtagcaatcataagtgatggaggatattatacttattactcagatataattaaaggtagatttacaatatcaagggataatgctaaaaatagtttatatcttcaaatgaatagtttaaaagcagaagatacagcagtatactattgtgcaagaggatttccattactaagacatggagcaatggattattggggacaaggaacattagttactgtaagttcaggaggaggtggtagcggaggaggaggttcaggcgggggaggtagtgacatacaaatgacacagtcaccatccagtttatcagcttccgtaggagatagagtaacaataacatgtaaagcttctcaaaatgtcgatacaaatgtagcttggtatcaacaaaaaccagggcaagcaccaaaaagtttaatatacagtgctagttacagatatagtgatgtaccatcaagattttctgggagtgcatcagggacagattttactctaacaatatcttcagtacaaagtgaagactttgcaacatactattgtcaacaatatgatagttatccatatacatttgggggaggaacgaaattagaaataaaaagtggaggagggggctcagaagtacaattagtagaaagcggaggtggactagtacaaccaggtggaagcttaaagttaagctgcgcagcaagtggatttacctttaataaatatgctatgaactgggtaagacaagcaccaggaaaaggattagaatgggtagcaagaataagaagtaaatataataactatgctacatattatgcagacagtgtaaaagatcgatttacaatttccagagatgatagtaaaaatacagcatatttacaaatgaataatttaaaaacagaggatacagcagtatactactgcgttagacatggaaattttggaaacagctatatatcctattgggcatattgggggcaagggacattagtaacagtatcaagtggtggaggaggaagtggaggtggaggaagtggaggaggtggatcacaaacagtggttacacaagaaccaagcttaacagtaagtccaggaggaacagtaactttaacatgtggaagtagcactggagcagtaactagtggaaattatccaaattgggtacaacagaaaccaggacaagcaccaagaggactaataggaggaacaaagtttttagctccaggaacgccggcaagattctcaggatcattactaggaggaaaagcagcactaactttaagtggagtacaaccagaagatgaagctgaatattattgtgtattatggtatagcaatcgatgggtatttggaggaggaacaaaattaacagtattacatcatcatcatcatcat

SEQ ID NO: 46528 - RNA, 1341 nt, synthetic construct
  misc_feature 1..1341: note = derived and/or modified sequence opt6 from Pateclizumab_HeavyChain1
  source 1..1341: mol_type = other RNA
gaagtacaactagtagaatcaggcggcggtctcgtacaacccggaggttccctaagactatcatgcgcagcatctggatacactttcacatcatacgttatacactgggtaagacaagcaccaggaaaaggactagaatgggtaggatacaataacccatataacgcaggaaccaactacaacgaaaaattcaaaggaagattcacaatatccagtgacaaatccaaaaatacagcatacttacaaatgaactccctacgagcagaagatacagccgtatactactgttcaagaccaacaatgctaccgtggttcgcatactggggacaaggaaccttagtaacagtttcatctgcatcaacaaaaggtccatcagtatttccactcgcgccatcatctaaatcaacatcaggaggaacagcagctctaggctgtctagtcaaagactacttcccagaaccagttaccgtaagttggaactcaggagccttaacttcaggagtacacacattccctgcagtactacaatcatccggactctattccctatcatccgtcgtaacagtcccctcatcctcactaggaacacaaacttacatatgcaacgttaaccataaaccatccaatacaaaagtagataaaaaagtagaaccaaaatcctgcgacaaaacacacacctgcccaccatgtccagccccagaattattaggagggccatcagtattcctattcccaccaaaaccaaaagacaccttaatgatatctagaacaccagaagtaacatgtgtagtagtagacgtatcacatgaagatccagaagttaaatttaactggtatgtagatggggtagaagtacacaacgcaaaaacaaaaccaagagaagaacaatataactcaacatacagagttgtctcagtcctaacagttctacaccaagattggctaaacggtaaagagtataaatgcaaagtatcaaacaaagcattacctgcacccatagaaaaaacaatatcaaaagcaaaaggacaaccccgagaacctcaagtatacacactaccaccatccagagaagaaatgacaaaaaaccaagtttcactcacatgcttagtcaaaggcttttacccatcagacatagcagtagaatgggaatcaaacggacaaccagaaaacaattacaaaacaacaccaccagtcttagacagtgacggatccttttttctatattcaaaactaaccgtcgataaatccagatggcaacaagggaacgtattttcatgctccgtaatgcacgaagcactacacaaccactatacacaaaaatctctatcactatcaccagga

SEQ ID NO: 46529 - RNA, 642 nt, synthetic construct
  misc_feature 1..642: note = derived and/or modified sequence opt6 from Pateclizumab_LightChain1
  source 1..642: mol_type = other RNA
gacatacaaatgacacaatcaccatcatcactatcagcatcagtaggagacagagtaacaataacatgcagagcaagccaagcagtatcatcagcagtagcatggtaccaacaaaaacccggaaaagcaccaaaattactaatatacagcgcatcacacagatatacaggagtaccatcaagattctcaggatcaggctcaggaacagactttacactaacaatatcatcactacaaccagaagacttcgcaacatactactgccaagaatcatactcaacaccctggacattcggacaaggaaccaaagtagaaataaaaagaacagtagctgcaccatcagtctttatattcccaccatcagacgaacaattaaaatcaggaacagcatcagtagtatgcttactaaacaacttttacccaagagaagccaaagtacaatggaaagtagataacgcactacaatcaggaaattcacaagaatcagtaacagaacaagactcaaaagattcaacatactcattatcatcaacactaaccctaagcaaagcagattacgaaaaacacaaagtatacgcatgcgaagtaacacaccaaggactatcatcaccagtaactaaatcattcaacagaggagaatgc

SEQ ID NO: 46530 - RNA, 1341 nt, synthetic construct
  misc_feature 1..1341: note = derived and/or modified sequence opt6 from Patritumab_HeavyChain1
  source 1..1341: mol_type = other RNA
caagtacaactacaacaatggggcgcaggattattaaaaccatcggaaacactttctttgacttgtgcagtatatggaggctcattctctggatactattggtcttggatacgacaaccaccaggaaaaggtttagaatggataggagaaataaaccattcaggatcaacaaattataacccatccctcaaatcaagagtaacaatatcagtcgaaacctcaaaaaaccaatttagcttaaaattgtcatcagttacagcagcagacacagcagtatactactgcgccagagacaaatggacatggtattttgatttatggggaagaggaacactcgtaacagtatcatcagcctcaacaaaaggaccatctgtattccctctagcaccatcaagcaaatccacatctggaggaacagcagcattagggtgtctcgtaaaagactattttccagaaccagtaacagtatcttggaactcaggagcactaacctcaggagtccacacattcccagcagtcctacaatcatccggactttactcactatcctcagtagtaacagtaccatcctcaagtttaggcacacaaacatatatatgcaacgtcaatcataaaccatcaaataccaaagtagataaacgtgtagaaccaaaatcatgtgataaaacccacacatgtcctccatgccccgcaccagaactattaggaggtccatcagtattcctgtttccacccaaaccaaaagacacattaatgatatcgagaacacccgaagttacatgcgttgtagtagacgtatcacacgaagacccagaagtaaaatttaattggtacgtagacggagtagaagtccacaacgccaaaacaaaaccaagagaagaacaatacaactccacataccgagtagtatcagtattaacagtattacatcaagactggctaaacggaaaagaatacaaatgcaaagtttctaacaaagcactcccagccccaatagaaaaaaccatctcaaaagcaaaaggacaacctagagaaccgcaagtctacacattaccaccatcaagagaagagatgaccaaaaaccaagtatcattaacatgcctcgtaaaaggattttacccatccgacatagcagtagaatgggaatcaaatggacaacctgaaaataactacaaaaccacaccaccagtcctagatagcgacggatcattcttcctatactcaaaattaacagttgacaaatcaagatggcaacaaggcaatgtattctcatgctccgtaatgcatgaagcactacacaaccactacacacaaaaatccctttccttatcaccaggaaaa

SEQ ID NO: 46531 - RNA, 681 nt, synthetic construct
  misc_feature 1..681: note = derived and/or modified sequence opt6 from Patritumab_hinge-CH2-CH3
  source 1..681: mol_type = other RNA
gacaaaacacacacatgcccaccatgcccagcaccagaattattaggcggaccatctgtatttttattcccaccaaaaccaaaagacacattaatgatatcaagaacaccagaagtaacatgcgtcgtagtagacgtatcacacgaagatccagaagtaaaattcaactggtacgtagacggcgtagaagtacacaacgcaaaaacaaaaccaagagaagaacaatacaactcaacatacagagtagtatcagtactaacagtactacaccaagactggttaaacggaaaagaatacaaatgcaaagtatccaataaagcattaccagcaccaatagaaaaaacaatatcaaaagcaaaaggacaacccagagaaccacaagtatacacactaccaccatcaagagaagaaatgacaaaaaaccaagtatcattatggtgcctagtaaaaggattctacccatcagacatagcagtagaatgggaatcaaacggacaaccagaaaacaactacaaaaccaccccaccagtactagactcagacggatcatttttcctatactccaaactaacagtagacaaatccagatggcaacaaggcaacgtattcagctgctcagtaatgcacgaagcattacacaaccactacacacaaaaatcactatcattatcaccaggaaaa

SEQ ID NO: 46532 - RNA, 660 nt, synthetic construct
  misc_feature 1..660: note = derived and/or modified sequence opt6 from Patritumab_LightChain1
  source 1..660: mol_type = other RNA
gatatagaaatgacacaatcaccagactcactagcagtatcactaggagaaagagcaacaataaactgcagatcatcccaatcagtactatacagctcaagcaacagaaactacttagcatggtaccaacaaaacccaggacaaccaccaaaactactaatatactgggcatcaacaagagaatccggagtcccagacagattctcaggatcaggatcaggaactgactttacactaacaatatcatcactacaagcagaagacgtagcagtatactattgccaacaatactactcaacaccaagaacatttggacaaggaacaaaagtagaaataaaacgaacagtagcagccccatcagtattcatattcccaccatcagacgaacaattaaaatcaggaacagcatcagtagtatgcctactaaacaacttctacccaagagaagcaaaagtacaatggaaagtagacaacgcattacaaagtggaaactcacaagaatcagtaacagaacaagactcaaaagactcaacatactcattatcatcaacattaacactaagcaaagcagactatgaaaaacacaaagtatacgcatgcgaagtaacacaccaaggcctatcatcaccagtaacaaaatcattcaacagaggagaatgc

SEQ ID NO: 46533 - RNA, 1341 nt, synthetic construct
  misc_feature 1..1341: note = derived and/or modified sequence opt6 from Pembrolizumab_HeavyChain1
  source 1..1341: mol_type = other RNA
caagtccaattagtacaaagcggagtagaagtaaaaaaaccgggagcctcagtaaaagtatcatgcaaagcatccggttacacattcacaaattattatatgtactgggtaagacaagcaccaggacaaggcctagaatggatgggaggaataaacccatccaacggtggtacaaattttaacgaaaaattcaaaaatagagtaacactcacaactgattcttctacaacaacagcatacatggaacttaaaagtctacaattcgacgacactgccgtttactattgcgccagaagagactacagatttgacatgggattcgactactggggacaaggaacaacagtaacagtctcatcagcatcaacaaaaggcccaagtgtatttccacttgctccatgttctagatcaacaagcgaatcgaccgccgcactaggatgtctagtcaaagactactttccagaaccagtaacagtaagctggaactcaggagcattaacatcaggtgtacacacattcccagccgtattacaatcatcaggattatattctctatcatcagtagtcacagtaccatcatcctcactaggaacaaaaacatatacatgcaacgtagatcataaaccatccaatactaaagtagacaaaagagtcgaatcaaaatatggaccaccttgtcccccatgtccagcacccgaatttctaggaggaccatccgtattcttatttccaccaaaacccaaagacacactcatgatttcaagaacaccagaagtcacctgcgtagtagtagatgttagtcaagaagaccccgaagtacaattcaattggtatgtagacggtgtagaagtacataacgcaaaaacaaaaccaagagaagaacaattcaactcaacatacagagtagtatcagtattaacagtactacaccaagattggctcaacggaaaagaatataaatgcaaagtatccaataaaggattaccatcatccattgaaaaaaccatatctaaagcaaaaggacaacctagagaaccacaagtctacactctcccacccagccaagaagaaatgactaaaaatcaggtctcactcacatgcctcgttaaaggattctacccatctgacatcgcagttgaatgggaatctaacggacagcctgaaaataactacaaaacaacccccccagtattagattcagacggatccttcttcttatactcaagactaactgtagataaatcaagatggcaagaaggaaatgtattttcctgctcagtaatgcatgaagcattacataaccactacacacaaaaatcactatccctttcattaggaaaa

SEQ ID NO: 46534 - RNA, 654 nt, synthetic construct
  misc_feature 1..654: note = derived and/or modified sequence opt6 from Pembrolizumab_LightChain1
  source 1..654: mol_type = other RNA
gaaatagtactaacacaatcacccgcaacattatccctatcaccaggagaacgagcaaccctatcatgccgagcatcaaaaggtgtatcaacatcaggatactcatacctacactggtaccaacaaaaaccaggacaagcaccaagattactaatatatctagcttcatacctagaatcaggagtcccagccagattctcaggatcaggatcaggcacagatttcacactaacaatctcatcactagaaccagaagactttgcagtatactactgccaacactcaagagacctaccattaacattcggaggaggaacaaaagtagaaatcaaaagaaccgtcgcagcaccatcagtattcatatttccaccatcagacgaacaactaaaatcaggaacagcatcagtagtatgcctactaaacaacttctacccaagagaagcaaaagtacaatggaaagtagacaacgcactacaatcaggaaactcacaagaatcagtaacagaacaagactcaaaagactcaacctactcactatcatcaaccctaactctatcaaaagcagactacgaaaaacacaaagtatacgcatgtgaagtaacacaccaaggtttatcatcacccgtaacaaaatcatttaacagaggagaatgc

SEQ ID NO: 46535 - RNA, 1356 nt, synthetic construct
  misc_feature 1..1356: note = derived and/or modified sequence opt6 from Perakizumab_HeavyChain1
  source 1..1356: mol_type = other RNA
gaagtacaattagtagaatccggaggcggactcgtacaaccaggaggcagtttaagactctcatgtgcagcgagtggattcacattcagcgactataccatgttatgggtaagacaagcaccaggtaaaggactagaatgggtagcaattataaaatcaggcggatcatattcatattatccagacagtgtaaaaggacgtttcacaattagtagagataacgcaaaaaatagtttatacttacaaatgaactcactaagagccgaagacacagcagtctactactgtgcaagagacggagattacggaagctcatacggcgcaatggattattggggccaaggtacgttagtaacagtatcaagtgcatcaactaaaggcccatcagtattcccattagccccatcaagtaaatcaacatcaggaggaacagcagcactaggatgtcttgtaaaagattactttccagaaccagtaacagtaagctggaattcaggagcactaacatcaggagtccacacatttccagcagtattacaatcatcaggactctattcactttcatctgtagtaacagtaccaagctcatcattaggcacacaaacatatatttgtaatgtgaatcacaaaccatcaaatacaaaagttgacaaaaaagtagaaccaaaatcatgtgataaaacacatacatgtccaccatgcccagcacctgaagcagccggtggaccatcagtattcctttttcccccaaaacccaaggacacattaatgataagtagaacaccagaagtaacttgtgtagtagtagacgtaagtcacgaagacccagaagtaaaattcaattggtatgttgatggtgtagaagttcacaatgcaaaaacaaaaccaagagaagaacaatataacagcacatatagagtcgtatcagtattaacagtactacatcaagattggttaaacggtaaagaatacaaatgtaaagtaagtaataaagcactacccgcaccaatagaaaaaacaatatcaaaagcgaaaggacaaccacgagaaccacaagtatacacactccccccaagcagagatgaactaacaaaaaaccaagtatccttaacatgcctagtcaaaggattttacccatcagacatagcagtagaatgggaatcaaatggccaaccggaaaacaattacaaaacaacaccaccagtacttgacagtgacggatcattctttctctactcaaaactaacagtagataagtcaagatggcaacaaggaaacgtattcagttgcagcgtaatgcacgaagctctccataaccactacacacaaaaatcattatcactatcaccaggaaaa

SEQ ID NO: 46536 - RNA, 645 nt, synthetic construct
  misc_feature 1..645: note = derived and/or modified sequence opt6 from Perakizumab_LightChain1
  source 1..645: mol_type = other RNA
gacatacaaatgacacaatcaccatcatcactatccgcctcagtaggagacagagtaacaatcacatgcagagcatcacaagacataaattcatacctatcatggtttcaacaaaaaccaggaaaagcaccaaaatcattaatagtacgagcaaacagactagtagacggagtaccatcaagattctccggatcaggatcaggacaagactactcactaacaatatcatccctacaaccagaagacttcgcaacatactactgtctacaatacgacgcattcccaccatacacattcggacaaggaacaaaattagaaataaaaagaacagtagcagccccatcagtattcatattcccaccatctgacgaacaattaaaatcaggaacagcaagcgtcgtatgcctactaaacaatttctacccaagagaagcaaaagtacaatggaaagtcgacaacgcattacaatcaggaaattcacaagaatcagtaacagaacaagactcaaaagactcaacatattcactatcatcaacattaacactatcaaaagcagattacgaaaaacacaaagtatacgcatgcgaagtaacacaccaaggattaagctcaccagtaacaaaatcattcaacagaggagaatgc

SEQ ID NO: 46537 - RNA, 1332 nt, synthetic construct
  misc_feature 1..1332: note = derived and/or modified sequence opt6 from Pertuzuab_HeavyChain1
  source 1..1332: mol_type = other RNA
gaagtacaactagtagaatccggcggaggactagtccaaccaggcggctcactaagattatcatgtgcagcatcgggatttacattcacagactacaccgactgggttagacaagcaccaggaaaaggacttgagtgggtcgctgacgtaaacccaaacagcggcggatctatatacaaccaacgtttcaaaggaagatttaccttaagcgtagatagaagtaaaaatacattatacctacaaaattcactaagagctgaagatacagctgtatactactgcgcacgcaatctaggaccatcattttacttcgactactggggacaaggaacattagtaacagtctcctctgcatcaacaaaaggaccatcagtattcccactcgcaccatcctctaaatccacaagtggaggaacagcagcacttggatgtctagtcaaagattacttccctgaaccagtaacagtatcatggaactccggtgccctaacatctggagtacacacattcccagcagtactccaaagctcaggattatattcactatcatccgtcgtaacagtaccatcctctagtctaggcactcaaacttacatatgcaacgtaaaccacaaaccatcaaatacaaaagtagacaaaaaagtagaaccaaaaagctgcgacaaaacacatacatgcccaccatgcccagcacctgaactactaggaggaccttcagtattcttattcccaccaaaaccaaaagacaccctcatatcacgtaccccagaagtcacatgcgtagtagtagacgtctcacacgaagaccccgaagtaaaattcaactggtatgtcgatggcgtagaagtacacaatgcaaaaacaaaacccagagaagaacaatacaactcaacttacagagtagtatcagtactaacagtacttcatcaagactggttaaacggaaaagaatataaatgtaaagtatcaaacaaagcactaccagcacccatagaaaaaacaatatcaaaagccaaaggacaaccaagagaaccacaagtttacacactaccaccttcaagagaagaaacaaaaaaccaagtttcactaacatgtctcgtaaaaggattctacccctccgacatagcagtcgaatgggaaagcaacggacaacctgaaaacaactacaaaacaacaccacctgtattagactcagacggcagctttttcttatactcaaaactaactgtagacaaatcaagatggcaacaaggtaacgttttttcatgctccgtacatgaagcactacacaaccactatacacaaaaatcactctctttatcaccaggaaaa

SEQ ID NO: 46538 - RNA, 639 nt, synthetic construct
  misc_feature 1..639: note = derived and/or modified sequence opt6 from Pertuzuab_LightChain1
  source 1..639: mol_type = other RNA
gacatacaaacacaatcaccatcaagcttatcagcatcagtaggagacagagtaacaataacatgcaaagcatcccaagacgtatcaataggagtagcatggtaccaacaaaaaccaggaaaagcacccaaactactaatatactcagcaagctacagatacacaggagtaccatcaagattctcaggatcaggatcaggaacagacttcacactaacaatatcatcattacaacccgaagacttcgccacatactactgccaacaatactacatctacccatacacattcggacaaggaacaaaagtagaaataaaacgaacagtagcagcaccaagcgtattcatattcccaccatcagacgaacaactaaaatcaggcacagcatcagtagtatgcctactaaataacttctacccaagagaagccaaagtacaatggaaagtagacaacgcattacaatcaggaaactcacaagaaagtgtaacagaacaagactcaaaagactcaacatattcactaagctcaacattaacattaagcaaagcagactacgaaaaacacaaagtttacgcatgcgaagtaacacaccaaggactaagctcaccagtaacaaaatcattcaacagaggagaatgc

SEQ ID NO: 46539 - RNA, 642 nt, synthetic construct
  misc_feature 1..642: note = derived and/or modified sequence opt6 from Pertuzumab_HeavyChain
  source 1..642: mol_type = other RNA
gacatacaaatgacacaatcaccatcatccctatcagcatcagtaggagaccgagtaacaataacatgcaaagcatcacaagacgtatcaataggagtagcatggtaccaacaaaaaccaggaaaagcaccaaaactattaatatactcagcatcataccgatacacaggagtaccatccagattctcaggatcaggatcaggcacagatttcacactaaccatatcctcactacaaccagaagacttcgctacatactactgccaacaatactacatatacccatacacattcggacaaggaacaaaagtagaaataaaaagaacagtagcagcaccatcagtattcatattcccaccctcagacgaacaactaaaatcaggaacagcatcagtagtatgcttactaaacaatttctacccaagagaagccaaagtccaatggaaagtagacaacgcactccaatcaggaaactcacaagaatcagtaacagaacaagactcaaaagactcaacatattcactatcctcaacactaacactatcaaaagcagactacgaaaaacacaaagtatacgcatgcgaagtaacacaccaaggactatcatcaccagtcacaaaatcattcaacagaggagaatgc

SEQ ID NO: 46540 - RNA, 1344 nt, synthetic construct
  misc_feature 1..1344: note = derived and/or modified sequence opt6 from Pertuzumab_LightChain
  source 1..1344: mol_type = other RNA
gaagtacaattagtagaatcaggcggaggactggtacaacctggaggctcactcagactatcatgtgccgcatccggcttcacattcacagactatacaatggactgggtacgtcaagcaccaggaaaaggattagaatgggtagcagatgtaaacccaaactcaggaggatcaatatacaaccaaagattcaaaggaagattcacattatcagtagaccgatcaaaaaatactctatatttacaaatgaattctttaagagcagaagacacagcagtatattattgtgcacgaaatttaggtccatcattctatttcgactactggggacaaggaacattagtaaccgtatccagcgcatcaacaaaaggaccatcagttttcccattagcaccttcatcaaaaagtacatcaggaggaacagccgcattaggttgcttagtaaaagactactttccagaaccagttacagtatcatggaattctggagctctaacatcaggtgtacacacattcccagcagtattacaatcctcaggactatactctctatcatcagtagtaacagtaccgtcatcatcactaggaacacaaacatacatatgtaacgtcaaccacaaaccttcaaatacaaaagtcgataaaaaagtagaaccaaaatcatgtgataaaacacacacatgcccaccatgtccagcaccagaactactcggaggaccatcagtattcttatttccaccaaaaccaaaagacacacttatgatatcacgaacaccagaagtaacatgtgtagttgtagacgtctcacacgaagacccagaagtaaaattcaactggtacgttgatggtgtagaagttcacaacgccaaaactaaacctcgagaagaacaatacaactcaacatacagagttgtatctgtactaacagtactacaccaagactggctaaatggaaaagaatacaaatgtaaagtatcaaacaaagcactaccagcaccaatagaaaaaaccatttcaaaagccaaaggacaaccaagagaaccacaagtatatacactacccccatctagagaagaaatgacaaaaaaccaagtatcacttacatgtctagtaaaaggcttctacccatcagacatagcagtagaatgggaatccaacggacaaccagaaaacaactacaaaacaacaccaccagttctagattcagacggatcatttttcctatattcaaaactaacagtagataaatcccgatggcaacaaggcaacgtattttcctgttctgtaatgcacgaagcattacacaatcactatacacaaaaaagtctatcactctcaccaggc

SEQ ID NO: 46541 - RNA, 750 nt, synthetic construct
  misc_feature 1..750: note = derived and/or modified sequence opt6 from Pexelizumab_h5g1.1-scFv
  source 1..750: mol_type = other RNA
atggcagatatacaaatgacacaaagcccatcaagtttaagcgcaagtgtaggtgatagagtaacaataacatgtggagcaagtgaaaacatatatggagcattaaattggtatcaaagaaaaccaggaaaagcaccaaagttattaatatatggagcaactaatttagcagatggtgtacctagtagattttcaggaagcggatcaggaacagattatacactaacaataagtagtctacaaccagaagattttgcaacatattattgtcaaaatgtattaaatacaccattaacatttggacaaggaacaaaagtagaaataaaaagaacaggaggaggaggatcaggaggaggaggaagtggaggaggaggaagccaagtacaattagtacaatcaggagcagaagtagaaaaaccaggagcatcagtaaaaaaagtatcatgcaaagcaagtggatacatattcagtaactattggatacaatgggtaagacaagcaccaggacaaggattagaatggatgggagaaatattaccaggaagtggtagtacagaatacgcacaaaaatttcaaggaagagtaacaatgacagcagatacatcaacaagtactgcatatatggaattatcaagtctaagatcagaagatacagcagtatattactgtgctagatatttttttggtagctcaccaaattattggtattttgatgtatggggacaaggaactctagtaacagtatcatca

SEQ ID NO: 46542 - RNA, 345 nt, synthetic construct
  misc_feature 1..345: note = derived and/or modified sequence opt6 from Pexelizumab_h5g1.1VHC_+_F_Heavy_Chain_V-Region
  source 1..345: mol_type = other RNA
caagtacaattagtacaaagcggagcagaagtaaaaaaaccaggagcaagcgtaaaagtaagctgtaaagcaagcggatacatattctcaaactattggatacaatgggtaagacaagcaccaggacaaggactagaatggatgggagaaatattaccaggaagcggaagcacagaatatgcacaaaaatttcaaggaagagtaacaatgacagcagacacaagcacaagtacagcatatatggaattatcaagtttaagatcagaagatacagcagtatattactgtgcaagatactttttcggaagctcaccaaattggtatttcgtatggggacaaggaaca

SEQ ID NO: 46543 - RNA, 318 nt, synthetic construct
  misc_feature 1..318: note = derived and/or modified sequence opt6 from Pexelizumab_h5g1.1VHC_+_F_Light_Chain_V-Region
  source 1..318: mol_type = other RNA
gacatacaaatgacacaatcaccatcactatcagcatcagtaggagacagagtaacaataacatgcggagcatcagaaaacatatacggagcactaaactggtaccaaagaaaaccaggaaaagcaccaaaactactaatatacggagcaacaaacctagcagacggagtaccatcaagattctcaggatcaggatcaggaacagactacacactaacaatatcatcactacaaccagaagacttcgcaacatactactgccaaaacgtactaaacacaccactaacattcggacaaggaacaaaagtagaaataaaa

SEQ ID NO: 46544 - RNA, 1326 nt, synthetic construct
  misc_feature 1..1326: note = derived and/or modified sequence opt6 from PF-05082566_HeavyChain1
  source 1..1326: mol_type = other RNA
gaagtacaactagtacaaagcggcgcagaagttaaaaaaccaggagaaagtcttcgtataagctgcaaaggctccggatactcattttccacttactggatatcctgggtaagacaaatgcctggaaaaggactagaatggatgggaaaaatatatcctggagactcatatacaaattattctccatcattccaagggcaagtaacaatatccgcagataaatcaatatctactgcttacctacaatggtcttccttaaaagcctcagacactgctatgtattattgtgccagaggttacggcatatttgattactggggtcaaggaacattagtcaccgtatcatcagcatcaacaaaaggaccatcagtatttccattagcaccatgttcaagaagtacaagcgaatccacagcagcactcggatgcctagtaaaagattatttcccagaaccagtaaccgtatcatggaactcaggcgcactaacatcaggcgtacatacattcccagctgtactacaatcatccggattatattcactttcatcagtagtaacagtaccaagctcaaatttcggaacccaaacatatacatgtaatgttgaccataaaccatcaaacaccaaagttgataaaacagtagaacgcaaatgctgtgtcgaatgcccaccatgccccgcaccaccagtagcaggaccttcagtttttttattccctccaaaaccaaaagatacactaatgatatcaagaacaccagaagtaacatgtgtcgtagttgacgtatcccacgaagacccagaagtccaattcaactggtatgtagacggagttgaagtacacaatgcaaaaacaaaaccaagagaagaacaatttaactccaccttcagagtagtatctgtccttacagtagtacaccaagattggctcaacggaaaagaatacaaatgcaaagtatccaacaaaggcctaccagccccaatagaaaaaacaatttcaaaaacaaaaggacaaccccgagaaccccaagtatatacactcccaccatccagagaagaaatgacaaaaaaccaagtatcactaacatgtctagtcaaaggcttttacccatcagacatagctgttgaatgggaatcaaacggccaaccagaaaataactataaaacaactccccccatgttagactcagacggatcatttttcctttactcaaaattaacagttgacaaatctagatggcaacaaggaaatgttttctcatgctccgtaatgcatgaagccctccataatcactatactcaaaaatccctatcactatccccaggaaaa

SEQ ID NO: 46545 - RNA, 642 nt, synthetic construct
  misc_feature 1..642: note = derived and/or modified sequence opt6 from PF-05082568_LightChain1
  source 1..642: mol_type = other RNA
tcatacgaactaacacaaccaccatcagtatcagtatccccaggacaaaccgcatcaataacctgctcaggagacaacataggagaccaatacgcacactggtaccaacaaaaaccaggacaaagcccagtactagtaatataccaagacaaaaacagaccatcaggaataccagaaagattctcaggatcaaactcaggaaacacagcaacactaacaatatcaggaacacaagcaatggacgaagcagactactattgcgcaacatatacaggattcggatcactagcagtattcggcggaggaacaaaattaacagtattaggacaaccaaaagcagcaccatcagtaacattattcccaccatcatcagaagaactacaagcaaacaaagcaacactagtatgcctcatatcagacttctacccaggagcagtaacagtagcatggaaagcagactcatcaccagtaaaagcaggagtagaaacaacaacaccatcaaaacaatcaaacaacaaatacgcagcatcatcatacctatcactaacacccgaacaatggaaatcacacagaagttattcatgtcaagtaacacacgaaggatcaacagtagaaaaaaccgtagcaccaacagaatgcagc

SEQ ID NO: 46546 - RNA, 1341 nt, synthetic construct
  misc_feature 1..1341: note = derived and/or modified sequence opt6 from Pidilizumab_HeavyChain1
  source 1..1341: mol_type = other RNA
caagtacaactagtccaatcaggatcagaactaaaaaaaccaggagcatctgtaaaaatatcatgtaaagcatcaggatacacattcacaaattacggcatgaactgggttagacaagcaccaggacaaggactacaatggatgggatggatcaatacagattcaggagaatcaacatacgcagaagaatttaaaggtagattcgtgttctccttagacacatctgtaaacactgcatatctacaaataacttcactaacagcagaagacacaggaatgtacttttgcgtaagagtcggatacgacgcattagactattggggacaaggtacgcttgttacagtatcatcagcatccactaaaggaccatcagtattcccattagcaccatcatcaaaatctacatcaggaggaactgcagcactcggatgcctcgtaaaagactacttccccgaaccagttacagtatcatggaactctggagcactaacatccggtgtacacacattcccagccgtactacagtcttcaggactatattcattatcttccgtagtaacagtcccatcatcatcattaggcacacaaacttacatatgtaatgttaaccataaaccaagcaacacaaaagttgacaaaagagtagaacccaaatcatgtgacaaaacacacacatgccctccatgcccagcaccagaattattaggaggaccatcagtatttttattcccaccaaaacctaaagataccctaatgatatcaagaacacctgaagtaacatgcgtagtagttgacgtatcacacgaagaccccgaagtaaaattcaactggtatgtagacggagtagaagtacacaatgcaaaaacaaagcctcgagaagaacaatataattcaacataccgagtagtatccgtcctcactgtattacaccaagactggttaaatggtaaagaatacaaatgtaaagtatcaaacaaagcacttcctgcaccaatagaaaaaacaatttccaaagcaaaaggacaacccagagaaccccaagtctacacactacctccctcacgtgaagaaatgacaaaaaatcaagtttctttaacttgcctagtaaaaggattctatccatcggatatagcagtagaatgggaatccaacggtcaaccagaaaacaactacaaaacaacaccacctgtcctagattcagacggatctttttttttatactcaaaattaacagtagacaaatcacgatggcaacaaggcaacgtattttcatgctcagtaatgcacgaagcactacataaccactacacacaaaaatcattatcactatcaccaggaaaa

SEQ ID NO: 46547 - RNA, 639 nt, synthetic construct
  misc_feature 1..639: note = derived and/or modified sequence opt6 from Pidilizumab_LightChain1
  source 1..639: mol_type = other RNA
gaaatagtactcacacaatcaccatcatccctatcagcatcagtaggtgatagagtaacaataacatgctcagcaagatcatcagtatcatacatgcactggttccaacaaaaaccaggaaaagcaccaaaactatggatataccgtacatccaacttagcatcaggagtaccatccagattctcaggctcaggatccggaacatcatactgcctaacaataaactcattacaaccagaagacttcgcaacatactactgccaacaaagatcatcattcccactaacatttggaggaggtaccaaactagaaataaaaagaacagtagcagctccatcagtatttatattcccaccatcagacgaacaattaaaatcaggaacagcatcagtagtatgtctactaaataacttttacccacgagaagccaaagtacaatggaaagtagacaacgcactacaatccggaaactcccaagaatcagtaacagaacaagactcaaaagactcaacctactccctatcatcaacattaacactatcaaaagcagactacgaaaaacacaaagtttacgcatgtgaagtaacacatcaaggactatcatcaccagtaacaaaatccttcaacagaggagaatgt

SEQ ID NO: 46548 - RNA, 1350 nt, synthetic construct
  misc_feature 1..1350: note = derived and/or modified sequence opt6 from Pinatuzumab_vedotin_HeavyChain1
  source 1..1350: mol_type = other RNA
gaagtacaactagtagaatccggcggcggtctagtacaaccaggcggatcattaagattaagttgtgccgcaagcggatatgaattctcaagatcttggatgaactgggtaagacaagccccaggaaaaggattagaatgggttggaagaatatacccaggagatggagacacaaattactcaggaaaatttaaaggtagattcacaatatcagcagatacatcaaaaaatactgcatatctacaaatgaactctttaagagccgaagacactgcagtatactactgcgctagagacggatcatcctgggactggtatttcgatgtctggggccaaggaacactcgttacagtatcatcagcctcaacaaaaggcccctcagtattcccacttgcaccatcatcaaaatcaacatccggaggaacagctgcattaggttgcctagtaaaagactactttcctgaacctgtaacagtttcatggaactctggagcattaacctcaggagtacacacattccctgccgtattacaatcatcaggattatattcattatcatcagtagtaactgtaccctcatcatcactaggaacacaaacttacatatgcaacgtaaaccataaaccaagcaacactaaagtagataaaaaagtagaaccaaaatcttgtgataaaacacacacctgtccaccatgtccagcccctgaactcttaggtggaccatccgttttcctattcccaccaaaaccaaaagacactctaatgatctcaagaacaccagaagtaacatgcgttgtagtagacgtatcacacgaagatcccgaagtaaaattcaactggtatgtagacggagttgaagtccacaacgcaaaaacaaaacctagagaagaacaatataattcaacatatagagtagtatcagtcctcacagtcctacatcaagattggctaaatggtaaagaatataaatgtaaagtaagtaacaaagcattaccagctccaatcgaaaaaacaataagtaaagctaaaggtcaacccagagaaccacaagtatacacactaccaccatcacgcgaagaaatgacaaaaaatcaagtttcactaacatgtctcgtaaaaggattctatccttccgacatagccgtagaatgggaatccaatggacaaccagaaaacaattacaaaacaacaccacctgtactagactcagacggatcattctttctctattcaaaattaacagttgataaatcaagatggcaacaaggcaacgttttcagttgttcagtcatgcatgaagctctccataatcactatacacaaaaatcactatcactatcaccaggtaaa

SEQ ID NO: 46549 - RNA, 657 nt, synthetic construct
  misc_feature 1..657: note = derived and/or modified sequence opt6 from Pinatuzumab_vedotin_LightChain1
  source 1..657: mol_type = other RNA
gacatacaaatgacacaatcaccatcatcactatcagcatcagtaggagacagagtcacaataacatgcagatcctcacaatcaatcgtacactccgtaggaaacacattcctagaatggtaccaacaaaaaccaggaaaagcaccaaaactactaatatacaaagtctcaaacagattctcaggagtaccatcaagattttcaggatcaggatcaggaacagactttacactaacaatatcctcactacaaccagaagacttcgcaacctattactgcttccaaggttcacaattcccatacacattcggacaaggaaccaaagtagaaataaaaagaacagtcgcagcaccctcagtattcatattcccaccatcagacgaacaactaaaatcaggaacagcatccgtagtatgcctcctaaacaacttctaccccagagaagcaaaagtacaatggaaagtagacaacgcactacaatcaggaaactcacaagaatcagtaacagaacaagactcaaaagactcaacatactcactatcatcaacactaacactatcaaaagcagactacgaaaaacacaaagtatacgcatgcgaagtaacacaccaaggactatcatcaccagtaaccaaatcatttaacagaggcgaatgc

SEQ ID NO: 46550 - RNA, 1023 nt, synthetic construct
  misc_feature 1..1023: note = derived and/or modified sequence opt6 from Placulumab_chain1
  source 1..1023: mol_type = other RNA
gacatacaaatgacacaatcaccatcatcactatccgcatcagtaggagaccgagttacaataacatgcagagcatctcaagcaatagattcatatctacactggtaccaacaaaaaccaggaaaagctccaaaactactcatatactcagcatcaaacctagaaacaggagtaccatcaagattctcaggatcaggaagtggtacagacttcacattaaccatctcaagtttactaccagaagacttcgcaacatactactgccaacaagtcgtatggagaccattcacattcggacaaggaacaaaagtagaaataaaaagagtagaacctaaatcatcagataaaacacatacatgtccaccctgtccagctccagaactactcggaggaccatcagtattcttattcccaccaaaaccaaaagacacactcatgatatcaagaacaccagaagtaacatgcgtagtagtagacgtctcacatgaagaccccgaagtaaaattcaactggtacgtagacggagtagaagtacacaatgctaaaacaaaaccacgcgaagaacaatacaactcaacctatagagtcgtctcagttctaacagtactacaccaagactggttaaatggaaaagaatacaaatgtaaagtatcaaacaaagcactaccagcaccaatagaaaaaacaatatcaaaagcaaaaggacaaccaagagaaccacaagtatatacactaccaccatcaagagacgaactaaccaaaaatcaagtatcactaacatgcctagtcaaaggattctatccatcagacatcgccgtcgaatgggaatcaaacggacaaccagaaaacaactacaaaacaacaccacccgtcttagacagtgacggatctttttttctatactccaaattaacagtcgacaaatcacgatggcaacaaggaaatgtattctcatgttcagtaatgcacgaagcactacacaaccattatacacaaaaatccttatcattatcaccaggaaaa

SEQ ID NO: 46551 - RNA, 1023 nt, synthetic construct
  misc_feature 1..1023: note = derived and/or modified sequence opt6 from Placulumab_HeavyChain1
  source 1..1023: mol_type = other RNA
gatatacaaatgacacaatccccctcatctctttcagcatccgtcggagaccgcgtaacaatcacatgccgagcttcacaagcaatagactcatatctacactggtaccaacaaaaacccggcaaagcaccaaaactactaatctactcagcatcaaatctagaaacaggtgtaccatctagattctcaggatcaggatctggcacagactttacactaacaatatcatcactcctaccagaagacttcgccacatactactgccaacaagttgtatggcgaccattcacatttggacaaggaacaaaagtagaaataaaacgagtagaaccaaaatcatcagacaaaacacacacttgcccaccatgcccagcccccgaactcctaggaggaccatcagtatttctattcccaccaaaaccaaaagacacattaatgatatcaagaacaccagaagtaacatgcgtagtcgtcgacgtatcccacgaagatccagaagtaaaattcaactggtacgtagacggtgtagaagtacacaacgccaaaacaaaaccaagagaagaacaatacaattcaacctacagagtcgtatcagtactcacagtattacaccaagactggttaaacggaaaagaatacaaatgcaaagtcagcaataaagccttaccagcaccaatagaaaaaacaatatcaaaagccaaaggacaaccaagagaaccacaagtatacacattacccccatctagagatgaactaacaaaaaaccaagtatctttaacatgcctagtaaaaggattctacccatcagacatagcagtagaatgggaaagcaatggacaaccagaaaacaattacaaaacaacaccacccgtattagactccgacggatccttctttctatactcaaaattaacagtagacaaatcaagatggcaacaaggaaacgtattctcatgctcagtcatgcacgaagcactacacaaccactacactcaaaaatcactctcactatcaccaggaaaa

SEQ ID NO: 46552 - RNA, 1341 nt, synthetic construct
  misc_feature 1..1341: note = derived and/or modified sequence opt6 from Plozalizumab_HeavyChain1
  source 1..1341: mol_type = other RNA
gaagtacaactagtagaatcaggcggaggactagtaaaacccggcggttcgctacgattatcttgcgcagcatccggatttacattttctgcctatgcaatgaattgggttagacaagcaccaggaaaaggcctagaatgggtaggaagaataagaacaaaaaacaataactatgcaacatactacgctgactcagttaaagacagattcactatatccagagacgactctaaaaacacattgtacttacaaatgaactcactcaaaaccgaagatacagctgtatattactgcacaactttctacggtaacggagtatggggacaaggcacactcgtaacagtatcatcagcatccacaaaaggaccaagtgtcttcccactagcaccctcatcaaaaagcacatcaggaggaacagcagcattaggatgcctagtaaaagattactttccagaaccagttacagtctcttggaatagcggcgcactcacatctggagtacacacattcccagcagttctacaatcatcaggtctatacagcctatcctccgtcgtaacagttccttcatcaagcttaggaactcaaacatacatttgcaacgtaaaccacaagccatcaaacaccaaagtcgataaaaaagtagaaccaaaatcatgcgataaaacacacacatgtccaccatgtccagcacccgaactagctggcgccccctcagtcttcttatttccgcccaagcctaaagacactttaatgatatcaagaacaccagaagtaacatgcgtagtagtagatgtatctcacgaagacccagaagttaaattcaactggtacgtagacggagtagaagtccacaacgcaaaaaccaaaccaagagaagaacaatataattcaacttacagagtagtatcagtattaacagtattacatcaagactggcttaacggaaaagaatataaatgcaaagtatcaaataaagctttaccagcaccaattgaaaaaacaataagtaaagcaaaaggccaaccaagagaaccacaagtatatacattaccaccttcaagagatgaactaacaaaaaaccaagtatccctcacatgcttagtaaaaggcttctatccatcagatatagccgtagaatgggaatcaaacggacaaccagaaaacaattataaaacaacaccaccagtactcgattcagacggctcattttttttatactcaaaattaacagtagacaaatcaagatggcaacaaggaaatgtattctcatgctctgtaatgcacgaagcattacacaaccactacacacaaaaatcactatcattatcaccaggcaaa

SEQ ID NO: 46553 - RNA, 657 nt, synthetic construct
  misc_feature 1..657: note = derived and/or modified sequence opt6 from Plozalizumab_LightChain1
  source 1..657: mol_type = other RNA
gacgtagtaatgacacaatcaccattatcattaccagtaacactaggacaaccagcatcaatatcatgcaaatcatcacaatcattattagactcagacggaaaaacatttttaaactggttccaacaaagaccaggacaatcaccaagaagactaatatacctagtaagcaaactagactcaggagtaccagacagattctcaggatcaggatcaggtacagacttcacactaaaaatctcaagagtagaagcagaagacgtaggagtatactactgctggcaaggaacacacttcccatacacattcggacaaggaactagactagaaataaaacgaacagtagcagcaccaagcgtattcatattcccaccatcagacgaacaattaaaatcaggaacagcatcagttgtatgcttactaaacaacttctacccaagagaagcaaaagtacaatggaaagtagacaacgcattacaaagcggaaactcacaagaatcagtaacagaacaagacagcaaagactcaacatactcactaagctcaaccctaacactaagcaaagcagactacgaaaaacacaaagtatatgcatgtgaagttacacaccaaggattaagctcaccagtcacaaaaagcttcaacagaggagaatgc

SEQ ID NO: 46554 - RNA, 1341 nt, synthetic construct
  misc_feature 1..1341: note = derived and/or modified sequence opt6 from Pogalizumab_HeavyChain1
  source 1..1341: mol_type = other RNA
gaagtacaactagtacaatctggcgccgaagtaaaaaaaccaggagcctcagtcaaagtatcatgcaaagcatccggctatacattcacagacagttacatgagctgggtaagacaagcacccggacaaggactagaatggataggagacatgtatccagacaacggtgatagctcatataaccaaaaattcagagaaagagtaacaataaccagagacacctccacctccacagcatatttagaactctcaagtctaagatcagaagacacagcagtatattactgtgtacttgccccacgctggtacttctcagtatggggacaaggaacactcgtaaccgtttcttcagccagcacaaaaggtccatcagtctttccactagccccatcctcaaaatcaacatctggcggaaccgcagcactaggatgtctagttaaagactactttccagaaccagtcacagtatcatggaactcaggagcactaacatcaggagtccacacctttccagcagtactacaatcatccggattatactcattatcatctgtagtcacagttccatcctcatcattaggaacccaaacatatatttgcaacgtcaaccataaaccaagcaatacaaaagtagacaaaaaagtagaaccaaaatcatgcgataaaacacatacatgcccaccatgcccagctccagaattacttggaggaccatcagtattcttattcccaccaaaaccaaaagatacattaatgatatcccgaacaccagaagtaacctgcgtagtagtagatgtctcacatgaagaccccgaagtaaaatttaactggtatgtcgacggcgtagaagtacacaatgccaaaacaaaaccccgtgaagaacaatacaactcaacatatcgcgtagtatccgtattaacagtactacaccaagactggctcaacggcaaagaatacaaatgcaaagtatcaaacaaagcactaccagcacccatagaaaaaacaataagcaaagcaaaaggccaaccaagagaaccacaagtatacacactaccaccatcaagagaagaaatgaccaaaaatcaagtatcactcacatgcctagtaaaaggattctacccaagcgacattgcagtagaatgggaatcaaacggtcaaccagaaaacaactacaaaacaacacccccagtattggactcagacggatcctttttcctatattctaaactaacagtagataaatctagatggcaacaaggaaatgtattcagttgctcagtaatgcatgaagcactacataatcactatacccaaaaatcattatcattatccccaggaaaa

SEQ ID NO: 46555 - RNA, 642 nt, synthetic construct
  misc_feature 1..642: note = derived and/or modified sequence opt6 from Pogalizumab_LightChain1
  source 1..642: mol_type = other RNA
gacatacaaatgacacaatccccatcatcactatcagcatccgtaggagacagagtaacaataacttgcagagcatcccaagacatatcaaactacctaaattggtaccaacaaaaaccaggaaaagcaccaaaactactaatatactacacatcaagactaagatcaggagtaccatccagattctcaggatccggatcaggcacagacttcaccctaacaatatcatcactacaacccgaagacttcgcaacatactactgccaacaaggacacacattaccacccacattcggacaaggaacaaaagtagaaataaaaagaacagtagcagcaccatcagtattcatattcccaccatcagacgaacaattaaaatcaggaacagcctcagtagtatgcctattaaacaacttctacccaagagaagccaaagtccaatggaaagtagacaacgcactacaatcaggaaactcacaagaatccgtaacagaacaagactcaaaagattcaacctactcattatcctcaactctaacactatcaaaagccgactacgaaaaacacaaagtatacgcatgcgaagtaacacaccaaggactatcatcaccagtaacaaaatcattcaacagaggagaatgc

SEQ ID NO: 46556 - RNA, 1341 nt, synthetic construct
  misc_feature 1..1341: note = derived and/or modified sequence opt6 from Polatuzumab_vedotin_HeavyChain1
  source 1..1341: mol_type = other RNA
gaagttcaattagtagaatcaggcggaggattagtacaacctggtggatcactaagattatcctgtgccgcatccggatacactttctcatcatactggatagaatgggtaagacaagcaccaggcaaaggactagaatggataggagaaatcctcccaggaggaggagacacaaattataatgaaatattcaaaggtagagcaacattttccgccgacacttccaaaaatacagcatatttacaaatgaattcattaagagcagaagatacagcagtgtattattgtacccgacgagtacccataagattagactattggggacaagggacacttgtaacagtctcttccgctagtacaaaaggaccatcagtctttccacttgccccatcatcaaaatcaacatcaggtggaacagcagcattaggttgcttagtaaaagattactttcccgaacctgttacagtatcctggaactccggagcactaacatcaggagtacatacctttccagctgtattacaatcatcaggactatatagtttatcatcagtagttacagtcccttccagttcattaggcacacaaacatatatatgtaatgtaaatcataaaccctccaatacaaaagtcgataaaaaagtagaaccaaaaagctgtgacaaaacacacacatgtccaccatgcccagccccggaactactaggaggaccttcagtattcctatttccacccaaaccaaaagatacactcatgatctcacgaacacccgaagtaacatgcgttgtagtagatgtttctcatgaagatcctgaagttaaattcaattggtacgttgacggagtcgaagtacataatgccaaaacaaaaccaagagaagaacaatataactctacttaccgagtagtatcagtactaactgtactacatcaagattggctaaacggaaaagaatacaaatgcaaagtttccaataaagccttacccgcaccaatagaaaaaaccataagcaaagctaaaggtcaaccaagagaaccacaagtatacacactacctccctccagagaagaaatgacaaaaaaccaagtatcattaacatgcctcgttaaaggattctatccctccgacatagcagtcgaatgggaaagcaatggacaaccagaaaacaattacaaaacaacaccaccagtcttagattcagatggatcctttttcctatactcaaaattaactgttgacaaatctagatggcaacaaggaaacgttttctcatgcagtgtaatgcacgaagctcttcacaaccattatacacaaaaatcactatcactatccccaggaaaa

SEQ ID NO: 46557 - RNA, 654 nt, synthetic construct
  misc_feature 1..654: note = derived and/or modified sequence opt6 from Polatuzumab_vedotin_LightChain1
  source 1..654: mol_type = other RNA
gacatacaactaacacaatcaccatcttccctatcagcatcagtcggagacagagtaacaataacatgtaaagcatcacaatccgtagactacgaaggagactcattcctaaactggtaccaacaaaaaccaggaaaagcaccaaaattactaatatatgcagcatcaaacctcgaatcaggagtaccatcaagattctcaggctccggatcaggaacagacttcacactaaccatatcatcattacaaccagaagactttgcaacatactactgccaacaatcaaacgaagacccactaacattcggacaaggaacaaaagtagaaatcaaaagaacagtagcagcaccatcagtattcatatttccaccatcagacgaacaattaaaatcaggaacagcatcagtagtatgcctattaaacaacttctacccaagagaagcaaaagtacaatggaaagtagataatgcactacaatcaggaaactcccaagaatcagtaacagaacaagattccaaagactcaacctactccctatcatcaacactaacactctcaaaagctgactacgaaaaacacaaagtatatgcatgcgaagttacacaccaaggactaagctccccagtaactaaatcattcaacagaggagaatgc

SEQ ID NO: 46558 - RNA, 1326 nt, synthetic construct
  misc_feature 1..1326: note = derived and/or modified sequence opt6 from Ponezumab_HeavyChain1
  source 1..1326: mol_type = other RNA
caagttcaattagtacaatcaggcgcagaagtaaaaaaaccaggcgcaagcgtaaaagtttcatgtaaagcatcaggatattatacggaagcatactacatccactgggtccgacaagcaccaggacagggtttagaatggatgggcagaatagatcccgccacaggtaacacaaaatacgcaccacgattacaagatagagtaacaatgacaagagacacatcaacaagtaccgtatacatggaactatcatccttaagatcagaagacacagcagtatactactgcgcatcactatattccttaccagtatactggggacaaggcacaacagtaacagtatcatcagcatcaacaaaaggaccatcagtcttcccactagctccatgctccagatcaacatccgaatccaccgcagctctaggttgcttagtaaaagattacttccccgaaccagtaacagttagctggaacagcggagcactaacaagcggagtacatacctttcccgccgtattacaatcatcaggactatactcactaagctcagtagtcacagttccatcatcaaatttcggtactcaaacctacacctgtaacgtagatcacaaaccctccaacactaaagtagacaaaacagttgaaagaaaatgctgcgtagaatgtccaccatgcccagcacccccagtagcaggaccatccgtatttctattcccaccaaaacctaaagacacacttatgatatcacgaacgcctgaagttacatgcgtagtcgtagacgtatctcatgaagacccagaagtacaatttaactggtatgtcgacggagtagaagtacacaacgccaaaacaaaaccaagagaagaacaatttaactccacattccgagtagtaagcgtcctaactgtagtacaccaagactggttaaacggaaaagaatacaaatgcaaagtctcaaacaaaggattaccatcatccatagaaaaaaccatatcaaaaacaaaaggacaaccacgagaaccacaagtatacactctaccaccatcacgtgaagaaatgacaaaaaatcaagtatcactaacatgcttagtaaaaggattctacccatctgacatcgcagtagaatgggaatcaaatggacaacctgaaaacaactacaaaacaacacccccaatgttagactcagatggatcattcttcttatactcaaaattaacagtcgataaatcgagatggcaacaaggaaacgtattttcatgctcagtaatgcatgaagcactacacaaccactacactcaaaaatccctctcactatctccaggaaaa

SEQ ID NO: 46559 - RNA, 657 nt, synthetic construct
  misc_feature 1..657: note = derived and/or modified sequence opt6 from Ponezumab_LightChain1
  source 1..657: mol_type = other RNA
gacgtagttatgacacaatcaccattatcattaccagtaacattaggacaaccagcatcaatatcttgcaaatcctcacaatccctactatactcagacgcaaaaacatacttaaactggttccaacaaagaccaggacaatccccacgaagactaatataccaaatatcaagactagatccaggagtaccagacagattctcaggttcaggatcaggaacagacttcacactaaaaatatcaagagtagaagcagaagatgtaggagtatactactgcctacaaggaacacactacccagtattattcggacaaggaacaagactagaaataaaaagaacagtagcagcaccatcagtattcatattcccaccatcagacgaacaactaaaatcaggcacagcatcagtagtatgcttactaaacaacttctaccccagagaagcaaaagtacaatggaaagtcgacaatgcactacaatcaggcaactcacaagaatcagtaacagaacaagactcaaaagactcaacatactcactatcatcaacactaacactatccaaagcagactacgaaaaacacaaagtatacgcatgcgaagtaacacaccaaggattatcatcaccagtaacaaaatcattcaacagaggagaatgc

SEQ ID NO: 46560 - RNA, 1362 nt, synthetic construct
  misc_feature 1..1362: note = derived and/or modified sequence opt6 from Pritoxaximab_HeavyChain1
  source 1..1362: mol_type = other RNA
caagtacaattacaagaaagcggtgcagaattagtacgctcaggagcctcagtaagaatgtcctgtaaagcaagcggctacactttcacatcatacaatatgcactgggttaaacaaacaccaggccaaggactagaatggataggctacatatacccaggaaacggaggcacaaactacatacaaaaattcaaaggaaaagcaatactaacagccgacacatcatcatcaacagcatacatgcaaatatcttcactaacctcagaagactcagccgtatacttctgcacaagatcaccctcacactactcttccgacccctacttcgactactggggacaaggaactaccttaacagttagctccgaatttgcatcaacaaaaggaccatcagtatttccactagctccctcatcaaaatcaacatctggtggaacagcagcattaggatgtttagtcaaagactactttccagaaccagtaacagtatcatggaattcaggcgcactaacatcaggagttcacaccttcccagcagtattacaatcatcaggactatactcactatcaagcgtagtcacagtcccatcttcttcactaggaacccagacctacatttgcaatgtaaaccacaaaccaagcaataccaaagtagacaaaaaagtagaaccaaaatcttgcgacaaaacacatacatgcccaccatgtccagcaccagaactattaggcggaccatcagtattccttttccctcccaaacccaaagacacattaatgatttcaagaacaccagaagtcacttgcgtagtagtagacgtatcacacgaagaccctgaagttaaattcaattggtacgtagacggtgtagaagtacacaatgcaaaaacaaaaccaagggaagaacaatataactccacctacagagtagtcagcgtactaacagtcctccatcaagactggttaaacggaaaagaatacaaatgtaaagtatctaataaagcattacccgcacccatagaaaaaacaatatctaaagcaaaaggacaaccaagagaaccacaagtatacacattaccacccagtcgagacgaattaacaaaaaatcaagtttcactaacctgcctcgtaaaaggattttacccatcagatatagcagtagaatgggaatcaaacggacaacctgaaaacaactacaaaacaacacctcccgtactagattcagacggttcattttttctgtattccaaattaacagtagacaaatctcgatggcaacaaggcaacgtattcagctgttcagttatgcatgaagctttacacaatcactacacacaaaaatcattatccctatcaccaggtaaa

SEQ ID NO: 46561 - RNA, 642 nt, synthetic construct
  misc_feature 1..642: note = derived and/or modified sequence opt6 from Pritoxaximab_LightChain1
  source 1..642: mol_type = other RNA
gacatagtaatgtcacaatcacacaaattcatgtcaacatcagtaggagacagagtatcaataacctgcaaagcatcacaagacgtaggaacagcagtagcatggtaccaacaaaatccaggacaatcaccaaaattcctaatatactgggcatcaacacgacacaccggagtaccagacagattcacaggatctggctctggaacagacttcacactaacaataaccaacgtacaatcagaagacctagcagactacttctgccaacaatactcctcatacccactaacattcggagcaggaacttcactagaactcaaacgaacagtagcagcaccatcagtattcatattcccaccatcagacgaacaactaaaatcaggaacagcatcagtagtatgcctactaaacaacttctacccaagagaagcaaaagtacaatggaaagtagacaacgcattacaatcaggaaactcacaagaatcagtaacagaacaagactcaaaagactcaacttacagcctaagttcaacactaacactatcaaaagcagactacgaaaaacacaaagtatacgcatgcgaagtaacacaccaaggactatcatcaccagtaacaaaatcattcaacagaggagaatgc

SEQ ID NO: 46562 - RNA, 1350 nt, synthetic construct
  misc_feature 1..1350: note = derived and/or modified sequence opt6 from Pritumumab_HeavyChain1
  source 1..1350: mol_type = other RNA
gaagtacaattactagaatcaggaggagatttagtacaacccggaggatctctaagattatcctgcgcagcctcaggatttacattctccaactacgcaatgtcctgggtacggcaagcgccaggaaaaggactagaatgggtaagcgcaataactccatcaggaggctcaacaaactacgcagactctgtaaaaggaagattcacaatatccagagacaattcacaaaatactttataccttcaaatgaactccctccgagttgaagatacagcagtatacatatgcggacgagttccgtacagatcaacctggtatcctctatactggggtcaaggaaccctagtaacagtctcatccgcatcaaccaaaggaccatcagtattcccactagcaccaagctcaaagtccacctcaggtggcaccgcagcattaggatgtttagtaaaagactactttccagaaccagtaacagtctcatggaactctggagcattaacatcaggtgtgcacacattcccagcagtactacaatcatctggattatattcactatcctcagtagtaactgtaccatcaagctcactaggaacacaaacatacatttgcaatgtaaaccataaaccatctaataccaaagtagataaaaaagtagaaccaaaatcatgtgacaaaacacacacatgcccaccatgtcctgcaccagaactattaggcggaccatccgtcttcctatttccaccaaaacctaaagacaccttaatgataagcagaacacccgaagtaacatgtgtagtagtagatgtttcacatgaagatccagaagtcaaatttaactggtacgtagacggcgttgaagtacataacgcaaaaacaaaaccaagagaagaacaatataattcgacctacagagtagtatctgtactcacagttttacaccaagactggctaaacggaaaagaatacaaatgcaaagtatcaaacaaagcactaccagcacccattgaaaaaactatatcaaaagctaaaggacaacctagagaaccacaagtatacacactaccaccctcaagagatgaactaacaaaaaaccaagtatccttaacctgtctcgtaaaaggattttatccatctgacatagctgtagaatgggaaagtaacggacaacctgaaaacaattataaaactactcctcccgtactagactcagatggatcttttttcctatattcaaaactaacagtagataaatcaagatggcaacaaggaaatgtattcagctgcagtgtaatgcatgaagcactacataatcactacacccaaaaatccctatcattatcccctggaaaa

SEQ ID NO: 46563 - RNA, 642 nt, synthetic construct
  misc_feature 1..642: note = derived and/or modified sequence opt6 from Pritumumab_LightChain1
  source 1..642: mol_type = other RNA
gacatacaaatgacacaatcaccatcatcactttcagcatccgtaggagaccgagtaaccataacatgcagagcatcacaagacatatccaattacctagcatggttccaacaaaaaccaggaaaagcaccaaaatcactaatatatgccgcatcatcactacactccaaagtaccaacacaattctcaggatcaggctccggaacagacttcaccctaaccatatcatcattacaaccagaagacttcgcaacatactactgcctacaatactccacatacccaataacattcggaggaggaacaaaagtagaaataaaaagaacagtagcagcaccatctgtattcatattcccaccatcagacgaacaactaaaatcaggcacagcatcagtagtatgcttactaaacaacttctacccaagagaagcaaaagtacaatggaaagtagacaacgcactacaatcaggaaattcacaagaatcagtaacagaacaagactcaaaagactcaacatactcattatcatcaacattaaccctatccaaagcagactacgaaaaacacaaagtatacgcatgcgaagtaacacaccaaggactatcctcacctgtaacaaaatcattcaacagaggcgaatgc

SEQ ID NO: 46564 - RNA, 1341 nt, synthetic construct
  misc_feature 1..1341: note = derived and/or modified sequence opt6 from Quilizumab_HeavyChain1
  source 1..1341: mol_type = other RNA
gaagtacaactcgtagaatctggcggcggtctagtacaaccaggaggctctctaagactatcatgcgctgcatccggattcacattctcagactacggaatagcttgggtaagacaagcaccaggaaaaggactagaatgggtagcattcatatcagacctagcatacacaatttactacgcagacaccgtaacaggccgattcactatatctagagataattcaaaaaatacactatacctacaaatgaattctttaagagcagaagacacagcagtatactactgcgccagagacaactgggacgcaatggattactggggtcaaggcacactagtcacagtatcatcagcatcaacaaaaggaccaagcgtctttccattagctccatcatccaaatcaacatccggaggcacagcagcattaggttgcctcgtcaaagactattttccagaacctgtaacagtatcatggaactcaggagccctcacctccggtgtccatactttccctgcagtattacaatcctctggattatactccctctcttcagtagtaacagttcctagttcatccctaggaacacaaacatatatatgcaacgttaaccacaaaccatcaaacacaaaagtcgacaaaaaagttgaacctaaatcatgtgataaaacacatacttgcccaccttgcccagcaccagaactactaggcggaccatcagttttcctattccccccaaaaccaaaagatacattaatgatctcaagaacaccagaagtgacatgcgtagttgtagacgtatctcatgaagaccctgaagttaaattcaattggtatgtagatggagtagaagtacacaacgcaaaaactaaaccaagagaagaacagtacaactcaacatacagagtagtaagcgtattaacagtactacatcaagactggttaaatggcaaggaatataaatgcaaagtaagtaataaagccttacctgcaccaatagaaaaaacaatatcaaaagccaaaggccaaccaagagaaccacaagtatacacactaccaccatccagagaagaaatgacaaaaaaccaagtttcactaacctgtctagtaaaaggattctatccatctgacatagctgtagaatgggaatcaaacggtcaaccagaaaacaattataaaacaacaccacccgtactcgactctgacggctcattctttttatattcaaaattaacagttgataaatcaagatggcaacaaggaaacgtcttcagttgcagcgtaatgcatgaagcactccacaatcattatacacaaaaaagcctatcactatcaccaggaaaa

SEQ ID NO: 46565 - RNA, 657 nt, synthetic construct
  misc_feature 1..657: note = derived and/or modified sequence opt6 from Quilizumab_LightChain1
  source 1..657: mol_type = other RNA
gacatacaaatgacacaatcaccatcatcactatcagcatccgtaggagaccgagtaacaataacatgcagatcatcacaatcattagtacacaacaacgcaaacacatacctacactggtaccaacaaaaacctggaaaagcaccaaaactactaatatataaagtatccaacagattctcaggagtcccatcaagattctcaggatcaggatcaggaacagatttcacattaacaatatcctcactccaaccagaagacttcgcaacatactactgctcacaaaacacactagtaccatggaccttcggacaaggaacaaaagtagaaataaaaagaacagtagcagcaccatcagtattcatatttccaccatccgacgaacaattaaaatcaggaacagcatcagtagtatgcctactcaacaacttctacccaagagaagcaaaagtacaatggaaagtagacaacgcattacaatctggcaactcccaagaatcagtaacagaacaagactccaaagactcaacatactcactctcatcaacactaacactatcaaaagcagactacgaaaaacacaaagtatacgcatgcgaagtaacacaccaaggcctatcatcaccagtaacaaaatcattcaacagaggagaatgc

SEQ ID NO: 46566 - RNA, 1335 nt, synthetic construct
  misc_feature 1..1335: note = derived and/or modified sequence opt6 from Racotumomab_HeavyChain1
  source 1..1335: mol_type = other RNA
caagtacaactacaacaaagtggagcagaactagtaaaaccaggagcatcagtaaaattatcatgcaaagcatcaggttacacatttacttcatatgatataaattgggtacgacaaagaccagaacaaggattagaatggataggatggatattcccaggagacggctcaaccaaatacaatgaaaaattcaaaggaaaagcaacactaacaacagacaaatcatcttccacagcatacatgcaactaagccgattaacatcagaagattccgccgtatacttctgcgcacgagaagactactacgacaattcatattactttgattactggggacaaggaacaacactaacagtatcctcagctaaaaccacaccaccatcagtctacccactagccccaggctcagcagcacaaacaaactccatggtaacattaggctgcctcgttaaaggatacttcccagaacccgtaacagtcacatggaactcaggatcactatcaagtggcgtacatacattcccagcagtactacaatcagacctatacacattatcaagttcagtcacagtacctagctcaccaagaccatccgaaacagttacatgtaacgttgcccacccagcttcctccacaaaagtcgacaaaaaaattgtaccaagagattgcggctgcaaaccatgcatatgcacagtaccagaagtctcaagcgtattcatatttccaccaaaaccaaaagacgtattaacaataacattaacaccaaaagtcacatgcgtagtcgtcgatattagcaaagacgacccagaagtccaattttcatggttcgtcgatgacgtcgaagtccacacagcacaaacccaaccaagagaagaacaatttaactcaacattcagatccgtatccgaactcccaatcatgcaccaagattggctcaatggaaaagaattcaaatgccgagtaaactctgccgcatttccagcaccaatagaaaaaacaataagcaaaacaaaaggcagaccaaaagcaccacaagtttacacaataccacctccaaaagaacaaatggcaaaagataaagtatcactaacatgcatgataacagatttcttcccagaagacataacagtagaatggcaatggaacggacaacccgcagaaaattataaaaacacacaaccaattatgaacaccaatggctcatactttgtctactcaaaactaaacgtacaaaaatccaattgggaagctggcaatacattcacatgctccgttttacatgagggattacacaatcaccacacagaaaaatcactatcacactcaccaggaaaa

SEQ ID NO: 46567 - RNA, 642 nt, synthetic construct
  misc_feature 1..642: note = derived and/or modified sequence opt6 from Racotumomab_LightChain1
  source 1..642: mol_type = other RNA
gacatacaaatgacacaaacaacatcatcactatctgcatcattaggagacagagtaacaatatcatgcagagcatcacaagacatatcaaactacctaaactggtaccaacaaaaacccgacggaacagtaaaactactaatatactacacatccagattacattcaggagtaccatcaagattctcaggatcaggatcaggaaccgactacagcttaacaatatcaaacctagaacaagaagatatagcaacatacttctgccaacaaggaaacacactaccatggacattcggcggaggaacaaaactagaaataaaaagagcagacgcagcaccaacagtatcaatattccctccatcatcagaacaattaacatcaggcggagcatcagtagtatgcttcctaaacaacttctacccaaaagacataaacgtcaaatggaaaatagacggatccgaaagacaaaatggagtactaaactcatggacagaccaagactcaaaagactctacatactcaatgagctcaacactaactttaacaaaagacgaatacgaaagacacaactcatacacatgcgaagcaacacacaaaacatcaacatcacccatagtaaaatcattcaacagaaacgaatgc

SEQ ID NO: 46568 - RNA, 1089 nt, synthetic construct
  misc_feature 1..1089: note = derived and/or modified sequence opt6 from Racotumomab_scVH-VH'-VH_chain
  source 1..1089: mol_type = other RNA
gaagtacaattggtagagtcaggaggagggttagtacaaccaggaggatcattaagactaagctgtgcagcaagtggattcacatttagtgattactggatgtactgggtaagacaagcacccggaaaaggactagaatgggtatcagaaataaacactaatggactaataacaaaatacccagatagcgtaaaaggaagatttacaataagcagagacaatgcaaaaaacacactatatttacaaatgaatagcttaagaccagaagatacagcagtatactattgtgcaagatcaccaagtggattcaatagaggacaaggaacattagtcacagttagcagtggaggaggaggaagtggaggaggaagtgaagtacaattagtagaaagcggaggaggacttgtacaaccaggtaattcattacgattaagctgtgcagcaagcggttttacatttagtagttttggaatgtcatgggtaagacaagcaccaggaaaaggattagaatgggtatcatcaattagtggcagtggaagtgacacactatatgcagactctgttaaaggaagatttacaataagcagagataatgcaaaaacaacactatatttacaaatgaatagcttaagaccagaagatacagcagtgtattattgcacaataggaggaagtttaagtagaagtagtcaaggtactttagtaacagtaagctcaggaggaggaggttcagggggaggaagtgaagtacaattagtagaaagtggtggaggattggtacaaccaggaggcagcctaagattaagctgcgcagcaagtggattcacatttagtgattattggatgtattgggtaaggcaagcaccaggtaaaggattagagtgggttagtgaaataaacacaaatggtttgataacaaaatatccagattccgttaaaggcagatttacaatatcacgagataatgcaaaaaatacattatatctacaaatgaatagtctgagaccagaagatacagctgtctattattgtgcaagaagcccaagtggttttaatagaggacaaggaacattagtaacagtaagcagt

SEQ ID NO: 46569 - RNA, 1071 nt, synthetic construct
  misc_feature 1..1071: note = derived and/or modified sequence opt6 from Radretumab_HeavyChain1
  source 1..1071: mol_type = other RNA
gaagtacaattacttgaaagtggtggaggattagtacaaccaggaggttccttaagactaagttgcgcagcaagcggatttacatttagttcattctcaatgtcatgggtaagacaagcaccaggaaaaggattagaatgggtatcatccattagtggatcatctggaacaacatattatgccgatagtgtcaaaggaagatttacaataagtcgagataacagtaaaaatacattatatttacaaatgaactcattaagagcagaagatacagctgtatattattgtgcaaaaccatttccctatttcgactattggggtcaaggaacattagtaacagtatcaagtggagatggaagttccggaggtagcggaggagcatcagaaatagtactcacacaatcacccggaacattatcattatctccaggagaaagagcaacattaagctgtagagcaagtcaaagtgtaagttcatcatttttagcctggtatcaacaaaaaccaggtcaagcgccacgattattaatatattatgcatcatcaagagccacaggaataccagacagatttagtggatcaggatcaggtacagattttacactaacaataagtagattagaacctgaggatttcgctgtttattactgtcaacaaacaggaagaatacctccaacatttggacaaggaacaaaagttgaaataaaatcaggagggtcaggaggaccaagagcagcaccagaagtatatgcatttgcaacaccagaatggcctggatcaagagataaaagaacactagcttgtctaatacaaaatttcatgcctgaagatatttcagtacaatggctacataacgaagtacaactacctgatgcaagacactcaacaacacaaccaagaaaaacaaaaggatcaggatttttcgtcttttcaagattagaagtaactcgagcagaatgggaacagaaagatgaattcatatgtagagcagtacatgaagcagccagtccgagtcaaacggtacaaagagcagtatcagtaaacccagaatcatcaagaagaggaggatgt

SEQ ID NO: 46570 - RNA, 414 nt, synthetic construct
  misc_feature 1..414: note = derived and/or modified sequence opt6 from Radretumab_j_chain
  source 1..414: mol_type = other RNA
ggagatgacgaagcaacaatattagcagataacaaatgcatgtgcacaagagtaacatcacgaataataccaagtacagaagatccaaatgaagatatagtagaaagaaacataagaatagtagtaccattaaacaatagagaaaacataagcgatccaacaagcccactaagaagaaatttcgtttaccatctatcagacgtatgcaaaaaatgtgacccagtagaagtcgaactagaagaccaagtagtaacagcaacacaaagcaatatatgtaacgaagacgatggagtaccagaaacatgttacatgtacgatagaaataaatgttacacaacaatggtaccactaagataccatggagaaacaaaaatggtacaagcagcattaacaccagactcatgctatccagat

SEQ ID NO: 46571 - RNA, 1368 nt, synthetic construct
  misc_feature 1..1368: note = derived and/or modified sequence opt6 from Rafivirumab_HeavyChain1
  source 1..1368: mol_type = other RNA
caagtacaactagtccaatcaggagccgaagtaaaaaaaccaggaagctctgtaaaagtatcatgcaaagcatccgggggaacattcaacagatacacagtaaactgggtacgacaagcaccaggacaaggattagaatggatgggcggaataatacccattttcggaacagcaaactacgcacaaagattccaaggacgactaacaataactgcagacgaatctacatcaaccgcatatatggaactatcaagtttaagatcagatgacacagcagtatacttctgtgccagagaaaatttagacaattcaggaacatactactattttagcggatggtttgacccatggggacaaggtacactagtaacagtatcatccgcatcaaccaaaggaccttctgtctttccactagcaccatcatccaaatccacatctggcggcacagcagctttaggctgtctagtcaaagactatttccctgaaccagtcaccgtatcatggaactcaggagcactaacatccggcgttcatacatttccagccgtactacaatcaagtggattatactccttatcaagtgtagtaacagtaccatcatcatcactaggaacccaaacatatatatgtaacgtaaaccacaaaccatcaaatacaaaagtagataaaagagtagaaccaaaatcatgcgataaaacacacacatgccccccatgcccagcaccagaactcttaggcggtccaagcgtattcttattcccacccaaacctaaagacacccttatgatttcaagaacaccagaagtcacatgcgtagtagtagatgtatcacacgaagatcccgaagtaaaatttaactggtacgtagatggtgttgaagtacataacgccaaaaccaaacccagagaagaacaatacaactcaacatatcgcgtcgtctccgtactaaccgtactacatcaagattggcttaacggaaaagaatataaatgcaaagtctcaaacaaagccctaccagcccccatagaaaaaacaatatctaaagcaaaaggccaaccaagagaaccacaagtctacacactaccaccatcaagagaagaaatgacaaaaaaccaagtatcactaacatgcttagtaaaaggattctacccatccgacatagctgtagaatgggaatcaaacggacaacctgaaaacaactacaaaacaacaccaccagtactagactcagacggatcattcttcctctattccaaactaacagttgacaaatccagatggcaacaaggtaacgtattctcatgcagtgtaatgcacgaagccttacataatcactacacccaaaaatccttatcattatctccagga

SEQ ID NO: 46572 - RNA, 1368 nt, synthetic construct
  misc_feature 1..1368: note = derived and/or modified sequence opt6 from Rafivirumab_HeavyChain
  source 1..1368: mol_type = other RNA
gaagtccaattagtacaatcaggcgcagaagtaaaaaaacctggttcatcagtaaaagtcagctgtaaagcatcaggtggtacattcaacagatatacagtaaactgggttagacaagcaccaggacaaggactagaatggatgggtggaataataccaatatttggaacagcaaactacgcacaaagattccaaggaagattaactattacagcagacgaatcaacatcaaccgcatatatggaactatcatccttaagatcagacgacaccgcagtatatttctgcgcccgtgaaaacctagataattcaggaacatactattatttttccggttggtttgatccatggggacaaggtacattagtaacagtatcttcagcatcaacaaaaggaccatccgtctttccattagctccaagctccaaatcaacatcaggaggaacagcagcactcggctgcctagtcaaagactatttcccagaaccagtaaccgtatcctggaacagtggagcattaacatcaggagtacatacatttccagcagttctacaatcctcaggactatactctctatcatcagtagtaacagtaccatcatcttcactaggaactcaaacctacatatgtaacgtaaatcataaaccctccaataccaaagtagacaaacgcgtagaacccaaatcatgcgacaaaacacacacctgtcctccctgcccagcacctgaattactaggcggcccatcagtattcttattccctccaaaacctaaggatacactaatgatatcaagaacacctgaagtaacatgcgtcgtagtagacgtatcccacgaagacccagaagtaaaatttaattggtacgtagacggcgtagaagtacacaacgcaaaaacaaaaccacgagaagaacaatataactcaacatacagagtagtatcagtactaacagttttacatcaagactggctaaatggaaaagaatacaaatgtaaagtatccaacaaagcactcccagcaccaatcgaaaaaaccatatcaaaagcaaaaggacaaccacgagagccacaagtctacacattaccaccatcacgcgaagaaatgacaaaaaatcaagtaagtttaacatgtctagtgaaaggcttctacccttccgatatcgcagtagaatgggaatcaaatggacaaccagaaaacaactacaaaacaacaccaccagtactagactcagacggctcattttttctatactcaaaattaaccgtagacaaatcaagatggcaacaaggtaacgtattttcatgttctgtaatgcatgaagcattacacaaccattacacacaaaaatcattatcattatcccctgga

SEQ ID NO: 46573 - RNA, 654 nt, synthetic construct
  misc_feature 1..654: note = derived and/or modified sequence opt6 from Rafivirumab_LightChain1
  source 1..654: mol_type = other RNA
caatcagcactaacacaaccaagatcagtatccggatcaccaggacaatcagtaactatatcatgcacaggaaccagctccgacataggaggatacaacttcgtatcatggtaccaacaacacccaggaaaagcaccaaagctaatgatatacgacgcaacaaaaagaccatcaggagtaccagacagattctcaggatcaaaatcaggaaacacagcaagcttaacaatatcaggactacaagcagaagacgaagcagattactactgctgcagttatgcaggagactacacaccaggagtagtattcggaggaggaacaaaactaacagtactaggacaaccaaaagcagctccatcagtaacattattccccccatcctcagaagaactacaagcaaataaagcaacactagtatgcctaatatccgacttctacccaggagcagtaacagtagcatggaaagcagattcatcaccagtaaaagcaggagtagaaacaacaacaccatcaaaacaatcaaacaacaaatacgcagcatcatcatacctatcactaacaccagaacaatggaaatcacatagaagttattcatgccaagtaacacacgaagggtcaactgtagaaaaaacagtagcacccaccgaatgctca

SEQ ID NO: 46574 - RNA, 654 nt, synthetic construct
  misc_feature 1..654: note = derived and/or modified sequence opt6 from Rafivirumab_LightChain
  source 1..654: mol_type = other RNA
gaatcagcactaacacaaccaagatcagtctcaggatcaccaggacaatcagtaacaatatcatgcacaggaacatcatccgacataggcggatacaacttcgtctcatggtaccaacaacaccctggaaaagcaccaaaattaatgatatacgacgcaacaaaaagaccaagcggagtaccagacagattctctggatcaaaatcaggaaacaccgcatcactaacaatatcaggattacaagcagaagacgaagcagactactactgttgctcatacgcaggagactacacacccggagtagtattcggaggaggaacaaaactaacagtattaggacaaccaaaagcagcaccatcagtaacactatttccaccatcatcagaagaactacaagcaaacaaagcaaccctagtctgcctaatatcagacttctacccaggagcagtaacagtagcatggaaagcagactcatcaccagtaaaagcaggagtagaaacaacaacaccatcaaaacaaagtaacaacaaatacgcagcatcaagctacttatcattaacaccagaacaatggaaatcacacagatcatactcatgccaagtaacacacgaaggatcaacagtagaaaaaacagtcgctcccacagaatgcagc

SEQ ID NO: 46575 - RNA, 1332 nt, synthetic construct
  misc_feature 1..1332: note = derived and/or modified sequence opt6 from Ralpancizumab_HeavyChain1
  source 1..1332: mol_type = other RNA
caagtacaactcgtacaatcaggcgcagaagtaaaaaaaccaggagcttccgtaaaagtatcctgcaaagcatccggatacaccttcacatcatactatatgcactgggtaagacaagctcccggccaaggattagaatggatgggagaaatccacccctcaggaggaagaacaaattataacgaaaaatttaaatctagagtaacaatgacaagagacacatctacatcaaccgtatatatggaactaagctcactaagatcagaagacaccgcagtatattattgcgctagagaaagaccactatacgcctcagatttatggggacaaggaacaacagtaacagtatcctcagctagcacaaaaggaccctcagtatttccattagcaccatgttcacgatcaacctctgaatcaactgcagcactaggatgcctagtaaaagactatttcccagaaccagtaactgtctcatggaactccggagcactaacaagtggagtacacacatttcctgcagtactccaatcttcaggactttactccttatcatccgtagtaacagtaccctcatcaaacttcggaacacaaacatacacatgcaacgtagatcacaaaccatcaaacacaaaagttgacaaaacagtagaaagaaaatgctgcgtagaatgcccaccctgccctgcacctcccgtcgcaggaccatcagtttttttattcccacccaaaccaaaagacacactcatgatttcaagaaccccagaagttacatgcgtagtagtagacgtatcacacgaagacccagaagttcaatttaattggtatgtcgatggagtagaagtacacaacgccaaaaccaaaccaagagaagaacaatttaattcaacattccgagtagtatcagtcttaacagtcgttcaccaagactggctaaacggtaaagaatacaaatgtaaagtatcaaataaaggattaccatcctcaattgaaaaaacaatatctaaaacaaaaggacaaccacgagaaccacaagtttacacactaccaccatctagagaagaaatgacaaaaaaccaagtctccctaacatgcctagttaaaggattttatccctcagatatagcagttgaatgggaatcaaacggacaacccgaaaacaactacaaaacaacccccccaatgctcgactcagacggatcctttttcctatattcaaaattaacagtagacaaatcacgctggcaacaaggaaacgtattctcatgttcagtaatgcatgaagcattacacaaccactatactcaaaaatccttatcattaagtccaggtaaa

SEQ ID NO: 46576 - RNA, 642 nt, synthetic construct
  misc_feature 1..642: note = derived and/or modified sequence opt6 from Ralpancizumab_LightChain1
  source 1..642: mol_type = other RNA
gacatacaaatgactcaatcaccatcatcactatccgcaagcgtaggagacagagtaaccataacatgcaaagcaagccaagacgtacacacagcagtagcatggtaccaacaaaaaccaggaaaagccccaaaactactaatataccacgcatcatatcgatatacaggagtcccatcccgattctcaggatcaggatccggaacagacttcactttcacaatatcatcattacaaccagaagacatagcaacatactactgccaacaaagatactcactatggagaacattcggacaaggaacaaaactagaaataaaaagaacagtagccgcaccatccgtattcatattcccaccatcagacgaacaattaaaatcaggaacagcctcagtcgtatgcctactaaacaacttctacccacgtgaagcaaaagtacaatggaaagtagacaacgcactacaaagcggaaactcacaagaatcagtaacagaacaagactcaaaagactcaacatacagcctatcctcaacactaacattatcaaaagcagactacgaaaaacacaaagtatacgcatgcgaagtaacacaccaaggattatcatcaccagtaacaaaatcattcaacagaggcgaatgt

SEQ ID NO: 46577 - RNA, 1338 nt, synthetic construct
  misc_feature 1..1338: note = derived and/or modified sequence opt6 from Ramucirumab_HeavyChain1
  source 1..1338: mol_type = other RNA
gaagtacaattagtacaatctggaggaggtctagtaaaaccaggaggatcattaagactatcatgcgcagcatcaggttttacattctcatcgtattccatgaattgggtaagacaagcacccggtaaaggactagaatgggtatcaagcatatcatcatcatcttcttacatatactacgcagacagtgtaaaaggaagatttacaatctccagagacaacgccaaaaactccctatacttacaaatgaactcacttagggcagaagacacagccgtatactattgtgcacgagtaacagatgcatttgacatatggggccaaggaacaatggtaacagtatcctcagcatctacaaaaggaccatcagtattccctctagcaccatcatcaaaatccacttctggaggaaccgcagccttaggatgtctcgtaaaagattacttcccagaacccgtaactgtatcctggaactcaggtgcattaactagtggagtacacacatttcctgcagtattacaatcctccggtctatactctttatcctcagtagtaacagtaccatcatcatcattaggaacacaaacctacatatgcaacgtaaaccacaaaccatcaaacacaaaagtagacaaaaaagtagaaccaaaatcctgcgacaaaacccatacatgtccaccatgccctgccccagaactactcggaggcccatctgttttcttattccctcctaaaccaaaagacacattaatgatatcaagaactccagaagtcacatgcgtagtagtagacgtctcccacgaagacccagaagtaaaattcaactggtacgtagatggtgtcgaagtacataatgcaaaaaccaaaccaagagaagaacaatacaattccacatatagagtagtaagcgtattaaccgttctacaccaagattggttaaacggaaaagaatacaaatgcaaagtatcaaataaagcactaccagcaccaatagaaaaaacaatatccaaagccaaaggacaaccaagagaacctcaagtatatacactaccaccatcaagggaagaaatgacaaaaaaccaagtatcactaacatgcctcgtcaaaggattttacccctcagacatcgccgtagaatgggaatccaacggacaacctgaaaacaactacaaaacaacaccaccagtactagactcagacggatcattcttcttatactcgaaactaacagtagataaatcaagatggcaacaaggaaacgttttctcatgctcagttatgcacgaagcactacataatcactacactcaaaaatcattatccctaagtcccggaaaa

SEQ ID NO: 46578 - RNA, 642 nt, synthetic construct
  misc_feature 1..642: note = derived and/or modified sequence opt6 from Ramucirumab_LightChain1
  source 1..642: mol_type = other RNA
gatatccaaatgacacaatcaccatcaagcgtaagtgcaagcataggagatcgagtaaccataacatgtagagcaagccaaggaatagacaattggctaggatggtaccaacaaaaaccaggaaaagcaccaaaactcttaatatatgacgcaagcaatctagacaccggagtaccaagcagattctcaggatcaggctcaggaacatactttacattaacaataagctcactacaagcagaagactttgcagtatacttttgccaacaagcaaaagcattcccacccacattcggaggaggtacaaaagtagatataaaaggaacagtagcagcaccaagcgtattcatattcccaccatctgacgaacaattaaaatcaggaacagcatctgtcgtatgtttactaaataacttctacccacgagaagcaaaagtacaatggaaagtagataacgcactacaaagcggaaactcacaagaatcagtaacagaacaagatagtaaagactcaacatatagcttaagttcaacattaacattaagcaaagccgattacgaaaaacataaagtatacgcatgcgaagtaacacaccaaggactaagttcacccgtaacaaaaagttttaacagaggcgaatgc

SEQ ID NO: 46579 - RNA, 687 nt, synthetic construct
  misc_feature 1..687: note = derived and/or modified sequence opt6 from Ranibiziuab_HeavyChain1
  source 1..687: mol_type = other RNA
gaagtacaactagtagaatcaggaggcggattagtccaaccaggcggaagcctacgattatcatgtgcagcctcaggatacgatttcactcactatggaaattgggtaagacaagcaccaggaaaaggattagaatgggtaggatggataaacacttacacaggagaaccaacatacgcagcagacttcaaaagaagatttacattctcattagatacaagtaaatcaacagcatacctccaaaattcattaagagcagaagatacagcagtatattattgtgcaaaatacccatactattacggtacatcacattggtactttgacgtatggggacaaggaacattagtaacagtatcatcagcatcaacaaaaggtccatcagtatttccactagcaccatcatcaaaatcaacatcaggaggaaccgcagccttaggctgcttagtaaaagactactttccagaaccagtaacagtatcatggaactcaggagcactaacaagcggagtacatacatttccagcagtattacaatcatcaggcctatattcattatcatcagtcgtaacagtaccatcatcatcattaggaacacaaacatatatatgtaacgtaaaccataaaccatcaaatacaaaagtagataaaaaagtcgaaccaaaatcatgtgacaaaacacattta

SEQ ID NO: 46580 - RNA, 642 nt, synthetic construct
  misc_feature 1..642: note = derived and/or modified sequence opt6 from Ranibiziuab_LightChain1
  source 1..642: mol_type = other RNA
gacatacaactaacacaatcaccatcatcactaagcgcatccgtaggagacagagtaacaataacatgctcagcatcacaagacatatcaaactacttaaactggtaccaacaaaaaccaggcaaagctccaaaagtactaatatacttcacatcatcactacactccggagtaccatctcgattttcaggatcaggatcaggaacagacttcacactaacaatatcatcactacaacccgaagacttcgcaacatactactgccaacaatactccacagtaccatggacattcggacaaggaacaaaagtagaaataaaaagaacagttgcagccccatcagtattcatatttccaccctcagacgaacaattaaaatcaggaacagcatcagtagtatgcctactcaacaacttctatccaagagaagcaaaagtacaatggaaagtagacaacgcactacaatcaggaaactcccaagaatcagtaacagaacaagactcaaaagactcaacttattccctatcatcaacactaacactatccaaagcagactacgaaaaacacaaagtatacgcatgcgaagtaacccaccaaggactatcatcacccgtaaccaaatcattcaacagaggagaatgc

SEQ ID NO: 46581 - RNA, 639 nt, synthetic construct
  misc_feature 1..639: note = derived and/or modified sequence opt6 from Ranibizumab_fab_fragment
  source 1..639: mol_type = other RNA
gacatacaactaacacaatcaccatcatcattatctgcatcagtaggagacagagtaacaataacctgctcagcatcacaagacatatcaaactacctaaactggtaccaacaaaaaccaggaaaagcaccaaaagtcttaatatacttcacatcctcactacactccggagtaccatcaagattctcaggatcaggatctggaacagacttcacactaacaatatcatcactacaaccagaagacttcgccacatactactgccaacaatacagcacagtcccatggacattcggacaaggaacaaaagtcgaaataaaaagaacagtagcagccccatcagtattcatattcccaccctcagacgaacaattaaaatcaggcacagcatcagtagtatgcctactaaacaacttttacccaagagaagcaaaagtacaatggaaagtagacaacgccctacaatccggaaactcacaagaatcagtaacagaacaagactcaaaagactcaacctactccctatcatccacactaacattatcaaaagcagactacgaaaaacacaaagtatacgcatgcgaagtaacacaccaaggactatcatcaccagtaacaaaatccttcaacagaggagaa

SEQ ID NO: 46582 - RNA, 693 nt, synthetic construct
  misc_feature 1..693: note = derived and/or modified sequence opt6 from Ranibizumab_HeavyChain
  source 1..693: mol_type = other RNA
gaagtacaattagtcgaatcaggaggaggactagtacaaccaggaggatcattaagattaagctgcgcagcatcaggatacgacttcacacactatggaatgaactgggtaagacaagcaccaggaaaaggattagaatgggtaggatggataaatacatatacaggcgaaccaacatatgctgctgactttaaaagaagatttacattttcattagacacaagtaaatcaacagcatatctacaaatgaattcattaagagctgaagatacagcagtatattactgtgcaaaatacccttattattacggaacatcacactggtactttgacgtatggggacaaggaaccttagtaacagtatcatcagcctcaacaaaaggtccatcagtatttccacttgcaccatcatcaaaatcaacatctggaggaacagctgcattaggatgtctagtaaaagattacttcccagaaccagtaacagtatcatggaactctggagcactaacatcaggagtacacacatttccagcagtattacaatcatcaggactatatagcttatcatctgtagtaacagtaccaagttcatcactaggaacacaaacatatatatgtaacgtaaaccataaaccatcaaatacaaaagtagataaaaaagtagaaccaaaatcatgtgacaaaacacattta

SEQ ID NO: 46583 - RNA, 654 nt, synthetic construct
  misc_feature 1..654: note = derived and/or modified sequence opt6 from Ranibizumab_LightChain
  source 1..654: mol_type = other RNA
gaagtacaattagtggaatcaggaggaggattagtacaaccaggaggatcattaagactatcatgtgcagcatcaggctacgatttcacacactatggaatgaactgggtaagacaagcaccaggaaaaggactagaatgggtaggatggataaatacctatacaggagaaccaacatatgcagcagactttaaacgaagatttacattctcattagacacatcaaaatcaacagcatatttacaaatgaattcattacgagcagaagatacagccgtctattactgcgcaaaatatccatactattatggaacatcacactggtactttgacgtatggggacaaggaacactagtaacagtatcatcagcatcaacaaaaggtccatcagtatttccattagcaccatcaggaacagctgcattaggatgtctagtaaaagattattttccagaaccagtaacagtatcatggaactcaggagcactaacatcaggagtacatacatttccagcagtattacaatcatcaggactatattcattatcatcagtagtaacagtaccatcatcatcactaggaacacaaacatatatatgcaacgtaaaccataaaccatcaaatacaaaagtagataaaaaagtagaaccaaaa

SEQ ID NO: 46584 - RNA, 642 nt, synthetic construct
  misc_feature 1..642: note = derived and/or modified sequence opt6 from Ranibizumab_LightChain_variant
  source 1..642: mol_type = other RNA
gacatacaattaacacaatccccatcatcattatcagcatccgtaggagatagagtaacaataacatgttcagcatcacaagacatatcaaactacctaaactggtaccaacaaaaaccaggaaaagcaccaaaagtactaatatacttcacatcatcactacactcaggagtaccatccagattctcaggatcaggatcaggcacagacttcacattaacaatatcatcactccaaccagaagacttcgccacatactactgccaacaatactcaacagtaccatggacattcggacaaggaaccaaagtagaaatcaaacgcacagtagcagccccatcagtattcatattcccaccatcagacgaacaattaaaatcaggaacagcatcagtagtatgcttattaaacaacttctatccaagagaagccaaagtacaatggaaagttgataacgccctacaatcaggaaactcacaagaaagtgtaacagaacaagacagcaaagactcaacatactcactaagctcaacactaacactatcaaaagcagactacgaaaaacacaaagtatacgcctgcgaagtaacacaccaaggactatcctccccagtaacaaaatcattcaacagaggagaatgc

SEQ ID NO: 46585 - RNA, 1368 nt, synthetic construct
  misc_feature 1..1368: note = derived and/or modified sequence opt6 from Refanezumab_HeavyChain1
  source 1..1368: mol_type = other RNA
caagtacaactagtccaatctggatcagaactaaaaaaacctggtgcatcagtaaaagtatcttgtaaagcatcaggatatacattcacaaattacggaatgaactgggtcagacaagcaccaggacaaggattagaatggatgggatggataaatacctacactggagaaccaacatatgcagacgatttcacaggaagatttgttttttccctagacacatcagtatcaacagcatacctacaaatatcttccctaaaagcagaagacacagcagtatactactgcgcaagaaatccaatcaattactacggcataaactacgaaggttatgtaatggactattggggacaaggaaccttagtaacagtatcctccgcatcaactaaaggaccaagcgtcttcccccttgcccccagctcaaaatcaacctcaggaggcacagcagcactagggtgcctagttaaagactacttcccagaaccagttaccgtctcatggaactcaggtgcactaacctcaggcgtacacacattcccagcagttttacaatcatctggcttatattcactctcatctgtagtaacagtaccatcatcatcattaggaacacaaacatatatatgtaatgtaaaccataaaccatcaaacacaaaagtagacaaaaaagtagaaccaaaatcctgcgacaaaactcatacatgtcctccatgccctgcaccagaattagctggagcacccagtgtattccttttcccaccaaaacctaaagacacgctaatgatatcacgaactccagaagtaacatgcgtcgtagtagacgtatctcacgaagatccagaagtaaaattcaactggtacgtagacggagtagaagtacacaacgcaaaaactaaaccaagagaagaacaatacaattcaacctacagagtagtctcagttctaacagtattacatcaagactggctaaatggaaaagaatataaatgcaaagtatcaaacaaagccctaccagcaccaatagaaaaaacaatatctaaagcaaaaggacaacccagagaaccacaagtctacacattaccaccatccagagacgaactcacaaaaaatcaagtaagtttaacatgtctagtaaaaggattttatccatctgacatagcagttgaatgggaatcaaacggccaaccagaaaacaattacaaaacaacaccacccgtactagattctgatggttcattcttcttatactccaaattaacagtcgacaaatcaagatggcaacaaggaaacgtattttcatgttcagtaatgcacgaagcacttcacaaccactacacccaaaaatcactctctttatcaccaggaaaa

SEQ ID NO: 46586 - RNA, 657 nt, synthetic construct
  misc_feature 1..657: note = derived and/or modified sequence opt6 from Refanezumab_LightChain1
  source 1..657: mol_type = other RNA
gacatagtaatgacacaatcaccagactcactagcagtatcactaggagaaagagcaacaataaactgcaaatcctcacactcagtactatactcatcaaaccaaaaaaactacttagcatggtaccaacaaaaaccaggacaaccaccaaaattactaatatactgggcatccacacgagaatcaggagtaccagatagattctccggatcaggatcaggaacagacttcacactaacaatatcatcactacaagcagaagacgtagcagtatactactgccaccaatacctatcttcattaacattcggacaaggaacaaaattagaaataaaaagaacagtagcagcaccctcagtattcatattcccaccctcagacgaacaactaaaatcaggaaccgcatcagtagtatgcctattaaataacttctacccaagagaagcaaaagtccaatggaaagtagacaacgcactacaatcaggtaactcacaagaatcagtaacagaacaagacagcaaagactcaacctattcactatcctcaacactaacattatcaaaagcagactacgaaaaacacaaagtatacgcatgcgaagtaacacaccaaggcctatcatcacccgtaacaaaatcattcaacagaggagaatgc

SEQ ID NO: 46587 - RNA, 1314 nt, synthetic construct
  misc_feature 1..1314: note = derived and/or modified sequence opt6 from REGN2810_HeavyChain1
  source 1..1314: mol_type = other RNA
gaagtccaattactagaatccggcggagttctagtacaacctggaggaagtttaagattatcatgtgcagcatcaggatttactttttcaaactttggaacttgggtcagacaagcacctggaaaaggtttagaatgggtctcaggaatctcaggaggaggaagagatacctatttcgccgactctgtaaaaggaagattcactatatctagagataacagtaaaaatacattatacttacaaaattctctaaaaggagaagatacagcagtatattattgcgtaaaatggggtaacatatactttgactattggggacaaggaacattagtaacagtttcatcagcatcaacaaaaggaccatcagtattcccattagccccatgttcaagatcaacatcagaatcaacagcagcattgggatgtctagtaaaagattacttccccgaaccagttacagtaagctggaattcaggagcattaacatcaggagtacatacctttcccgcagtattacaatcaagtggcttatattcactatcatcagtagttacagtaccatcaagctcactcggaacaaaaacttatacatgcaatgttgatcacaaacccagtaataccaaagtagacaaaagagtagaatcaaaatacggaccaccttgtccaccatgtccagctccagaattcttaggaggaccatcagtctttctattcccaccaaaaccaaaagatactttaataagtagaactccagaagtaacatgtgtagtagtagatgtatcccaagaagacccagaagtacaattcaattggtatgtagatggcgtcgaagtacataatgcaaaaacaaaaccacgtgaagaacaatttaactcaacatatcgcgtagtatcagtattaacagtattacatcaagactggttaaatggcaaagaatataaatgcaaagtttctaacaaaggacttccatcatcaatagaaaaaacaatttcaaaagcaaaaggacaaccaagagaaccacaagtatacactctcccaccatctcaagaagaaacaaaaaatcaagtatcattaacatgtctagtcaaaggattctacccaagcgacatagcagtagaatgggaatctaatggacaaccagaaaataactacaaaacaacccctccagttctagactccgacggctctttctttctctactcaagactaaccgtagataaatcacgatggcaagaaggaaacgtattttcatgttcagtccacgaagcattacacaatcactacacacaaaaatcattatcactatcactagga

SEQ ID NO: 46588 - RNA, 639 nt, synthetic construct
  misc_feature 1..639: note = derived and/or modified sequence opt6 from REGN2810_LightChain1
  source 1..639: mol_type = other RNA
gacatacaaacacaatcaccatcatccctatcagcatccgtcggcgactctataaccataacatgcagagcatccctatcaataaacacattcctaaactggtaccaacaaaaaccaggaaaagcaccaaacctcctaatatacgcagcatcatcactacacggaggagtcccatcaagattctcaggatcaggatcaggcacagacttcacattaacaataagaacactacaaccagaagacttcgcaacatactactgccaacaatcatcaaacaccccattcacattcggaccaggaacagtagtcgacttcagaagaacagtagcagccccatcagtattcatattccccccatcagacgaacaactaaaatcaggaacagcctctgtcgtatgcctactcaacaacttctacccaagagaagcaaaagtacaatggaaagtagacaacgcacttcaatcaggaaactcacaagaaagcgtaacagaacaagactcaaaagattccacatactcattatcctcaacattaaccttatcaaaagcagactacgaaaaacacaaagtatacgcatgcgaagtaacacaccaaggcttatcatcaccagtaaccaaatcattcaacagaggagaatgc

SEQ ID NO: 46589 - RNA, 651 nt, synthetic construct
  misc_feature 1..651: note = derived and/or modified sequence opt6 from rhuMab_HER2(9CI)_LightChain
  source 1..651: mol_type = other RNA
gtacactcagacatacaaatgacacaatcaccatcatcactatcagcatccgtaggagacagagtaacaataacatgcaaagcatcacaagacgtatcaataggagtagcatggtaccaacaaaaaccaggaaaagcaccaaaactactaatatactccgcatcatacagatacacaggcgtaccatcaagattctcaggatccggatcaggaacagacttcacactaacaatatcctcattacaacccgaagacttcgcaacatactactgccaacaatactacatatacccatacacatttggacaaggaacaaaagttgaaataaaaagaacagtagcagcaccatcagtattcatattcccaccctcagacgaacaactaaaatcaggaacagcatcagtcgtatgcctactaaacaacttctacccaagagaagcaaaagtacaatggaaagtagacaacgccctacaaagtggaaactcacaagaatcagtaaccgaacaagactccaaagactcaacatactcactatcttcaaccttaaccctatccaaagcagactacgaaaaacacaaagtatatgcatgcgaagtcacacaccaaggactatcatcaccagtaacaaaatcattcaacagaggagaatgc

SEQ ID NO: 46590 - RNA, 1215 nt, synthetic construct
  misc_feature 1..1215: note = derived and/or modified sequence opt6 from rhuMab_HER2_HeavyChain
  source 1..1215: mol_type = other RNA
gaagtacaattagtcgaatcaggaggaggactagtacaaccaggaggaagcttaagattatcatgtgcagcatcaggcttcacattcacagactataccatggactgggtaagacaagcaccaggtaaaggacttacagcagtctactattgcgcccgcaacttaggaccatcattctattttgattattggggacaaggaacattagtaacagtaagctctgcatcaacaaaaggcccatccgtatttccattagcaccatctagtaaatcaacttccggaggaacagcagccttaggttgtctagttaaagactatttccccgaaccagtcacagtatcatggaacagcggagcactaacctctggagtacatactttccctgcagtattacaatcatcaggcttatactcactatcatcagtagtaacagtaccatcatcatcattaggaacacaaacatacatctgcaacgtaaatcataaaccatcaaacaccaaagttgacaaaaaagtagaaccaaaatcatgtgacaaaacacatacatgcccaccttgcccagcaccagaattactaggaggtccatccgtattcctattccctccaaaacctaaagacacactaatgatctccagaacaccagaagtaacctgcgtagtagtagacgtatcacatgaagacccagaagtaaaattcaactggtacgtagacggagttgaagtacataacgcaaaaacaaaaccaagagaagaacaatataattcaacatatagagtagtttcagtattaacagtattacaccaagactggttaaacggaaaagaatacaaatgtaaagtatccaataaagcactacctgcacctatagaaaaaactatctcaaaagcaaaaggacaaccaagagaaccacaagtttacactctaccaccatcacgagaagaaatgacaaaaaaccaagtatcactaacatgcctagtaaaaggcttctacccctcagacatagccgtagaatgggaatcaaacggacaaccagaaaataattacaaaacaacaccaccagtactagactctgacggatcattcttcctatactcaaaattaaccgtcgataaatcacgatggcaacaaggaaacgttttttcctgctcagtaatgcacgaagcacttcacaaccactacacacaaaaatccctttccctatctccaggacccaaa

SEQ ID NO: 46591 - RNA, 645 nt, synthetic construct
  misc_feature 1..645: note = derived and/or modified sequence opt6 from rhuMab_HER2_LightChain
  source 1..645: mol_type = other RNA
tcagacatacaaatgacacaatcaccatcatccctatcagcatcagtaggagaccgagtcacaataacatgcagagcatcacaagacgtaaacacagcagtcgcatggtaccaacaaaaaccaggaaaagcaccaaaactattaatctactcagcatcattcctctactcaggagtcccatcaagattctcaggatcaagatcaggaacagacttcacattaacaatatcatcactacaaccagaagacttcgccacatactactgccaacaacactatacaacaccaccaacattcggccaaggaaccaaagtagaaatcaaacgcacagtagcagcaccaagcgtattcatatttccaccatcagacgaacaactaaaatcaggaacagcatcagtagtatgcttactaaacaacttctacccaagagaagcaaaagtacaatggaaagtcgataacgcactacaatcaggaaactcacaagaatcagttacagaacaagactcaaaagattcaacatattcattatcatccacactaacactttccaaagcagattacgaaaaacacaaagtatatgcatgcgaagtaacacaccaaggactatcatcaccagtaacaaaatccttcaacagaggagaatgc

SEQ ID NO: 46592 - RNA, 318 nt, synthetic construct
  misc_feature 1..318: note = derived and/or modified sequence opt6 from rhuMab_HER2_LightChain_variant1
  source 1..318: mol_type = other RNA
acagtagcagcaccatcagtattcatattcccaccatcagacgaacaactaaaatcaggaacagcatcagtagtatgcctactaaacaacttctacccaagagaagcaaaagtacaatggaaagtagacaacgcactacaatcaggaaactcacaagaatcagtaaccgaacaagactcaaaagactcaacatactcactatcatcaacactaacactatcaaaagcagactacgaaaaacacaaagtatacgcatgcgaagtaacacaccaaggactatcatcaccagtaacaaaatcattcaacagaggagaatgc

SEQ ID NO: 46593 - RNA, 642 nt, synthetic construct
  misc_feature 1..642: note = derived and/or modified sequence opt6 from rhuMab_HER2_LightChain_variant2
  source 1..642: mol_type = other RNA
gacatacaaatgacacaatccccatcatcactatcagcatcagtaggagacagagtaacaataacatgcagagcatcacaagacgtaaacacagccgtagcatggtaccaacaaaaaccaggaaaagcaccaaaactactaatatactcagcatcatttctatactccggagtaccatccagattctcaggctcacgatcaggaacagatttcacactaacaatatcatcactacaacccgaagacttcgccacatactactgccaacaacactacacaacaccaccaacattcggacaaggaacaaaagttgaaataaaacgaacatgcgcagcaccatcagtattcatattcccaccctcagacgaacaattaaaatcaggcacagcatcagtcgtatgcttactaaacaacttctatccaagagaagcaaaagtccaatggaaagtcgacaacgcactccaatcaggaaactcacaagaatcagtaacagaacaagactcaaaagattcaacatactccctatcatcaaccctaacattatcaaaagcagattacgaaaaacacaaagtatacgcatgcgaagtcacacaccaaggactatcatcacccgtaacaaaatcattcaacagaggcgaatgc

SEQ ID NO: 46594 - RNA, 642 nt, synthetic construct
  misc_feature 1..642: note = derived and/or modified sequence opt6 from rhuMab_HER2_LightChain_variant3
  source 1..642: mol_type = other RNA
gacatacaaatgacacaatcaccttcatcattatcagcttcagtaggagaccgagtaacaataacatgcagagcatcccaagacgtaaacacagcagtagcctggtaccaacaaaaaccaggaaaagcaccaaaactattaatctactcagcatccttcttatactcaggagtcccatcaagattctcaggatcaagatcaggaacagacttcacattaaccatatcttcactacaaccagaagacttcgcaacatactactgccaacaacactacacaaccccaccaacattcggacaaggaaccaaagtagaaataaaacgaacagtagcagcaccatcagtattcatatttccaccatcagacgaacaattaaaatcaggaacagcatcagtagtctgcctactaaacaacttctacccacgagaagccaaagtacaatggaaagtagacaacgcactacaatcaggaaactcacaagaatccgtaaccgaacaagacagcaaagactcaacatactccctatcatcaacactaacactatcaaaagcagactacgaaaaacacaaagtatacgcatgcgaagtaacacaccaaggattatcatcaccagtaacaaaatccttcaacagaggagaatgc

SEQ ID NO: 46595 - RNA, 645 nt, synthetic construct
  misc_feature 1..645: note = derived and/or modified sequence opt6 from rhuMab_HER2_LightChain_variant4
  source 1..645: mol_type = other RNA
tcagatatacaaatgacacaatcaccatcatcactatcagcatctgtaggagaccgagtaacaataacatgcagagcatcccaagacgtaaacacagcagtagcatggtaccaacaaaaacccggaaaagcaccaaaactattaatatactccgcatcattcctatattcaggagtaccatcacgattctcaggatcaagatcaggcacagacttcacattaacaatatcttcactacaaccagaagactttgcaacatactactgccaacaacactacacaacaccaccaacattcggacaaggcacaaaagtcgaaatcaaaagaacagtcgcagcaccatcagtattcatattcccaccatcagacgaacaactaaaatcaggaacagcatcagtagtatgcctattaaacaacttctacccaagagaagcaaaagtacaatggaaagtagacaacgcactacaatcaggaaactcacaagaatcagtaacagaacaagactcaaaagactctacatactccctatcatccaccctaacactatcaaaagccgactacgaaaaacacaaagtctacgcatgcgaagtaacacaccaaggactatcatccccagtaaccaaatcattcaacagaggagaatgc

SEQ ID NO: 46596 - RNA, 321 nt, synthetic construct
  misc_feature 1..321: note = derived and/or modified sequence opt6 from rhuMab_HER2_LightChain_V-Region
  source 1..321: mol_type = other RNA
gacatacaaatgacacaatcaccatcatcactatcagcatccgtaggagacagagtaacaataacatgcagagcatcacaagacgtaaacacagcagtagcatggtaccaacaaaaaccaggaaaagcaccaaaactactaatatactcagcatcattcctatactcaggagtaccatcaagattctcaggatcaagatcaggaacagacttcacactaacaatatcatcactacaaccagaagacttcgcaacatactactgccaacaacactacacaacaccaccaacattcggacaaggaacaaaagtagaaataaaa

SEQ ID NO: 46597 - RNA, 1350 nt, synthetic construct
  misc_feature 1..1350: note = derived and/or modified sequence opt6 from rhuMab_HER2_gamma1-Chain
  source 1..1350: mol_type = other RNA
gaagtacaactagtagaatcaggaggaggactcgtacaaccaggaggatcactaagactatcatgcgcagcatcaggattcaatataaaagatacatacatacattgggtcagacaagcacccggaaaaggactagaatgggtagcaagaatatacccaacaaacggatacaccagatatgcagactccgtaaaaggacgatttacaatatctgccgacacctccaaaaacactgcatatttacaaatgaactcacttcgagcagaagatactgcagtatactactgctctagatggggaggcgacggattctacgcaatggactattggggacaaggaacattagtaacagtatcctcagcctcaacaaaaggaccatcagtatttcctctagcaccctcctcaaaatccacttcaggcggaacagcagcactaggatgccttgtaaaagactatttcccagaaccagttacagtaagttggaattctggagcattaacatcaggagtacacactttcccagcagttctgcaatcatccggactatattctctatcatccgtagtaacagtaccctcttcatcactaggaacacaaacctatatttgcaacgtaaatcacaaaccatcaaacactaaagtagacaaaaaagtagaacctaaaagttgtgataaaacacacacatgccctccctgcccagctccagaactattaggaggcccatccgtatttctattcccaccaaaaccaaaagacacacttatgatatcccgaacacccgaagtaacttgtgtagtagtagatgtatcacacgaagacccagaagtaaaattcaactggtacgtagacggagttgaagtacacaacgcaaaaacaaaacccagagaagaacaatataactccacatatagagtagtctcagtacttacagtacttcaccaagattggctaaatggaaaagaatacaaatgcaaagtttcaaacaaagccttaccagcacccatagaaaaaacaataagcaaagccaaaggacaaccacgtgaaccacaagtatacacactaccaccatcaagagaagaaatgacaaaaaaccaagtatcattaacatgtttagtaaaaggattttacccaagcgacatagcagttgaatgggaatcaaacggacaacccgaaaacaactacaaaacaacaccaccagtactagactcagatggctcttttttcctatattcaaaactaacagtagataaatcaagatggcaacaaggaaacgtcttttcctgttctgtaatgcacgaagcattacacaaccactatactcaaaaatcattatcattatcaccaggcaaa

SEQ ID NO: 46598 - RNA, 1350 nt, synthetic construct
  misc_feature 1..1350: note = derived and/or modified sequence opt6 from rhuMab_HER2__gamma1-Chain
  source 1..1350: mol_type = other RNA
gaagtacaactagttgaaagcggaggcggcttagtacaaccaggaggatcactaagactctcctgtgcagcatccggcttcaatataaaagacacctatatacattgggtaagacaagcaccaggaaaaggactagaatgggttgcacgaatttacccaaccaacggatacacacgatacgcagactcagtaaaaggaagatttacaatatcagcagacacatcaaaaaacacagcatacctacaaatgaactcactaagagctgaagatacggctgtatactactgctcccgatggggcggagacggattttatgcaatggactactggggacaaggaacactagtcacagtatcatcatgctctactaaaggtccatccgtcttccccttagcaccaagctcaaaatcaacatctggaggtacagcagcactaggatgcttagtcaaagattactttcctgaaccagttacagtatcatggaactcaggagcacttacatcaggagtacacacattcccagcagtactacaatcatcaggattatactcactctcatcagtagtaacagtaccctcatcatcattaggaactcaaacatatatttgcaacgtaaaccacaaaccctccaacacaaaagtagacaaaaaagtagaacctaaatcatgcgacaaaacacatacttgcccaccctgtccagcacccgaattattaggaggaccatcagtattcttattcccaccaaaaccaaaagacacattaatgatatctagaacacccgaagtaacatgtgtagtagtcgatgtctcacatgaagaccctgaagtaaaattcaactggtacgtagacggagtagaagtacacaatgcaaaaacaaaaccacgagaagaacaatataactcaacataccgagtcgtaagtgttctaacagtactccaccaagactggctaaatggaaaagaatacaaatgtaaagtatccaataaagctctacctgcaccaatagaaaaaacaatatctaaagcaaaaggacaaccgagagaaccacaagtatatacactaccaccttctagagaagaaatgacaaaaaaccaagtttcattaacatgcttagtcaaaggattctacccatcagacatagcagtagaatgggaatcaaatggacaaccagaaaacaattacaaaacaacacccccagtactggattcagatggatcatttttcctatactcaaaattaactgtcgacaaatcacgctggcaacaaggaaacgtattttcttgctcagtaatgcatgaagcactacacaaccactacacacaaaaatctctatcactatcaccaggaaaa

SEQ ID NO: 46599 - RNA, 729 nt, synthetic construct
  misc_feature 1..729: note = derived and/or modified sequence opt6 from rhuMab_HER2_gamma1-Chain__rhuMab_HER2_LightChain_sc4D5
  source 1..729: mol_type = other RNA
gaagtacaattagtagaaagcggaggaggattagtacaaccaggaggaagtttaagactaagttgtgcagcaagcggatttaatataaaagacacatatatacactgggttagacaagcaccaggaaaaggactagaatgggtagccagaatatatccaacaaatggatatacaagatatgctgatagcgtaaaaggaagatttacaataagtgcagatacaagtaaaaatacagcatatttacaaatgaattcattaagagcagaagatacagcagtatattactgcagtagatggggaggagatggattttatgcaatggattactggggacaaggaacattagtaacagtaagtagcggtggaggaggaagcggaggaggaggctcaggaggaggaggaagcgatatacaaatgacacaaagtccatcgagtttaagtgcaagcgtaggagacagagtaacaataacatgtagagcgtcacaagacgtaaatacagcagtagcatggtatcaacaaaaacccggaaaagcaccaaaactattaatatatagcgcaagttttttatatagtggagtcccaagtagattctcaggatcaagatcaggaacagactttacattaacaataagtagtttacaaccagaagactttgcaacatattattgccaacaacattacacaacaccaccaacattcggacaaggaacaaaagttgaaattaaaaga

SEQ ID NO: 46600 - RNA, 1350 nt, synthetic construct
  misc_feature 1..1350: note = derived and/or modified sequence opt6 from rhuMab_HER2_gamma1-Chain_variant1
  source 1..1350: mol_type = other RNA
gaagtacaactagtagaatcaggcggtggattagtacaacccggaggatcattaagactttcttgcgcagcaagtggttttaacatcaaagacacatacatccactgggtaagacaagcaccaggaaaaggactagaatgggtagcaaggatatatccaacaaatggatacaccagatatgcagacagtgtcaaaggacgtttcactatatcagcagacacaagtaaaaacacagcatacctacaaatgaattcattacgagctgaagacacagcagtatattattgttcaagatggggtggcgatggattttatgccatggattactggggacaaggcaccctcgtaacggtaagctcagcatctacaaaaggaccatccgtcttcccattagcaccatcttcaaaatcaacttcaggaggcacagcagcactaggatgtctagtaaaagactacttccccgaaccagtaacagtatcatggaattcaggagccctaacctctggagttcacacattcccagcagtattacaatcatccggactatactctctatcaagtgtagtcaccgtaccaagctcatcactaggaacacaaacatatatatgcaatgtaaatcacaaaccatcaaatacaaaagttgacaaaaaagtagaaccaaaatcatgcgataaaacccatacatgtccaccatgtccagcacctgaattattaggcggaccatctgtatttttatttccaccaaaaccaaaagatacattaatgatatccagaactccagaagtaacatgcgtagtagtagatgtttcacacgaagacccagaagtaaaatttaattggtacgtagacggagtagaagttcataatgctaaaactaaaccacgagaagaacaatacaattcaacatatcgcgtagtctccgtacttactgtattacaccaagattggcttaacggaaaagaatacaaatgtaaagtaagcaacaaagcattacccgcacccatcgaaaaaacaatctctaaagcaaaagggcaaccccgagaaccacaagtatatacactaccaccatctagagaagaaatgactaaaaatcaagtaagcctaacatgtttagtaaaaggtttttacccatctgacatagccgtagaatgggaatccaacggccaaccagaaaacaactataaaacaacacctcccgtactagattcagatggatctttcttcctatacagtaaactaacagtcgacaaatcaagatggcaacaaggaaacgtattttcatgctcagtaatgcatgaagccctacataaccactatacacaaaaatcactaagcttaagcccaggaaaa

SEQ ID NO: 46601 - RNA, 1350 nt, synthetic construct
  misc_feature 1..1350: note = derived and/or modified sequence opt6 from rhuMab_HER2_gamma1-Chain_variant2
  source 1..1350: mol_type = other RNA
gaagtacaattagtagaatcaggaggtggactagttcaaccaggcggaagcctccgattatcatgcgccgcatcaggcttcaatataaaagacacatacatacactgggtccgacaagcaccaggtaaaggactagaatgggtagcaagaatataccctactaacggatatacaagatatgcagattcagttaaaggcagatttacaatatccgcagacacaagcaaaaatactgcatatttacaaatgaattcattaagagcagaagacaccgcagtatattactgctcacgatggggaggagatggattttatgcaatggactactggggacaaggtaccttagtaacagtatcttcatgttcaacaaaaggaccatcagtattcccactcgcaccctcatcaaaatcaacatcaggaggaacagcagcacttggatgtcttgtcaaagactacttcccagaaccagtaacagtatcatggaattcaggtgcacttacatcaggcgtacatacatttccagccgtactacaatcatcaggattatattcactatcttcagttgttacagtaccaagctcaagcttaggaacacaaacatacatatgcaacgtaaaccataaaccatcaaacacaaaagtagacaaaaaggtagaacctaaatcatgcgacaaaacccatacatgcccaccttgccctgccccagagttattaggagggccctcagtatttctattcccaccaaaacctaaagatacactaatgatatcaagaacaccggaagtcacatgtgtagtcgtagatgtctcacacgaagacccagaagttaaatttaactggtacgtagacggagtagaagtacataacgctaaaaccaaaccaagagaagaacaatacaattcaacatatagagtagtatccgtattaaccgtactacatcaagactggctcaatggaaaagaatacaaatgcaaagtaagcaataaagccttaccagctccaatagaaaaaacaatctcaaaagcaaaaggacaacctagagaaccccaagtatacacactaccaccttccagggaagaaatgacaaaaaatcaagtatccctaacatgtttagtcaaaggtttctatccaagtgacatagcagtagaatgggaatcaaacggacaaccagaaaataactacaaaacaacacccccagtactagactcagacggatcattcttcttatactcaaaacttacagtagataaatctagatggcaacaaggaaacgtattttcatgttcagtaatgcatgaagcactacacaaccactacacacaaaaatcactatcactcagtcccggaaaa

SEQ ID NO: 46602 - RNA, 1350 nt, synthetic construct
  misc_feature 1..1350: note = derived and/or modified sequence opt6 from rhuMab_HER2_gamma1-Chain_variant3
  source 1..1350: mol_type = other RNA
gaagtacaactagtagaatcaggaggcggattagttcaaccaggaggatcattaagactttcctgcgcagcatctggattcaacataaaagatacatacatacattgggtcagacaagcacctggaaaaggattagaatgggttgcccgaatttacccaaccaatggatatacaagatatgcagattcagtcaaaggaagatttacaatttcagcagacacatctaaaaatacagcatacttacaaatgaattcattacgatgcgaagacacagcagtatattactgctccagatggggaggcgacggattctacgccatggactattggggacaaggaacattagtaactgtctcttcagcatcaaccaaaggtccatcagtatttccactcgcaccatcatccaaatctacctctggaggaacagctgccttaggatgcctagtcaaagactactttccagaaccagtaacagtaagctggaattcaggtgcactaacatcaggagtacacacattcccagctgtcctacaatcctcaggactatattcactatcatcagtagtaactgtaccatcttcatcattaggaacacaaacatacatatgcaacgtaaaccataaaccatccaacacaaaagttgataaaaaagtagaaccaaaatcatgtgacaaaacccatacatgcccaccatgcccagcaccagaattactaggaggcccatcagtattcttattcccaccaaaacctaaagatactttaatgatatcaagaactccagaagtcacatgtgtagtagtagatgtatcacatgaagatccagaagtaaaattcaactggtacgtcgatggcgtagaagtacacaatgcaaaaacaaaaccaagagaagaacaatacaattctacatacagagtagtttcagtactaacagttttacatcaagactggctaaatggtaaagaatacaaatgcaaagtctccaacaaagcacttccagcacccatagaaaaaaccatctcaaaagccaaaggacaaccaagagaaccacaagtatacacattacccccctcaagagaagaaatgacgaaaaaccaagtcagccttacttgcttagtaaaaggattctacccttcagacatagcagtagaatgggaatcaaatggtcaacctgaaaacaactacaaaacaacaccaccagtattagactcagacggatcatttttcctctactctaaactaacagtagacaaatctcgttggcaacaaggaaacgtcttttcatgctcagtaatgcacgaagcactacataaccactacacccaaaaaagcctatcactatccccaggtaaa

SEQ ID NO: 46603 - RNA, 360 nt, synthetic construct
  misc_feature 1..360: note = derived and/or modified sequence opt6 from rhuMab_HER2_gamma1-Chain_V-Region
  source 1..360: mol_type = other RNA
gaagtacaattagtagaaagcggaggaggattagtacaaccaggaggaagtttaagattaagttgtgcagcaagtggatttaatataaaagatacatatatacactgggtaaggcaagcaccaggaaaaggactagaatgggtagcaagaatatatccaacaaatggatatacaagatatgcagatagtgtaaaaggaagatttacaataagtgcagatacaagtaaaaatacagcatatttacaaatgaatagtttaagagcagaagatacagcagtatattattgtagtagatggggaggagatggattttatgcaatggattattggggacaaggaacattagtaacagtaagttca

SEQ ID NO: 46604 - RNA, 1359 nt, synthetic construct
  misc_feature 1..1359: note = derived and/or modified sequence opt6 from rhuMAb-VEGF_HeavyChain1
  source 1..1359: mol_type = other RNA
gaagtacaattagtagaatcaggtggaggactagtacaaccaggaggatcattaagattatcatgcgccgcatcgggttatacattcacaaactacggaatgaactgggttcgacaagcaccaggaaaaggattagaatgggtcggatggatcaatacatatacaggagaacccacatacgcagcagatttcaaacgaagattcacgttttcactcgacacatctaaatcaacagcatacttacaaatgaattcactacgagctgaagatacagccgtttactactgtgcaaaatacccacactattatggatcatcacactggtactttgacgtatggggccaaggaacattagtaaccgtaagttcagcatcaaccaagggaccaagtgtattcccactagcaccctcatcaaaatcaacaagtggcggaaccgcagccttaggatgcttagtcaaagattacttcccagaaccagttacagtttcatggaactcaggagctctcacatctggagtacacacatttccagccgtattacaatcatccggtctatattctctttcatccgtagttacagttccatcttcttcacttggaacacaaacatacatatgtaatgtaaaccacaaaccatcaaatacaaaagtagataaaaaagtagaaccaaaaagctgcgacaaaacacacacatgtcctccatgtcccgcaccagaactactaggaggaccatcagtatttctattcccaccaaaaccaaaagacactctaatgatatcaagaaccccagaagtaacatgcgtagtagtagatgtatcacacgaagacccagaagtaaaattcaactggtatgtagacggagtagaagtccataatgcaaaaacgaaaccacgagaagaacaatacaactcaacatacagagtcgtttcagtactcacagtattacatcaagactggctaaatggaaaagaatacaaatgcaaagtatcaaataaagccctcccagcacctatagaaaaaacaatatcaaaagccaaaggtcaaccacgagaaccccaagtatacacacttccaccctcccgagaagaaatgacaaaaaaccaagtaagtttaacttgtcttgtaaaaggattctacccctcagatatcgcagtagaatgggaatcaaacggacaaccagaaaataattacaaaacaactccaccagtattagattctgacggatcattttttctatatagtaaactaacagttgacaaatcaagatggcaacaaggaaatgtattcagctgctctgtaatgcacgaagcattacacaaccattacacacaaaaatccctatcattatcccccggcaaa

SEQ ID NO: 46605 - RNA, 642 nt, synthetic construct
  misc_feature 1..642: note = derived and/or modified sequence opt6 from rhuMAb-VEGF_LightChain1
  source 1..642: mol_type = other RNA
gacatacaaatgacacaatccccctcatcactatcagcatcagtcggagacagagtaacaatcacatgctccgcatcacaagacatctcaaactacctaaactggtaccaacaaaaaccaggaaaagcaccaaaagtcctaatatacttcacatcatcactacattccggcgtaccatcaagattctcaggatcaggatcaggaacagacttcacactaacaatatcatcactacaaccagaagatttcgcaacatactactgccaacaatactcaacagtaccatggacattcggacaaggaacaaaagtagaaataaaacgaacagtagcagcaccatccgtattcatattcccaccatcagacgaacaactaaaatcaggcacagcatcagttgtatgcctactaaacaatttctacccaagagaagcaaaagtccaatggaaagtcgacaacgcattacaatcaggaaactcacaagaatcagtaacagaacaagactcaaaagactctacatactcactatcatcaaccctaacactaagtaaagcagactacgaaaaacacaaagtatacgcatgcgaagtcacacaccaaggactatcatcaccagtaaccaaatccttcaacagaggagaatgc

SEQ ID NO: 46606 - RNA, 642 nt, synthetic construct
  misc_feature 1..642: note = derived and/or modified sequence opt6 from rhuMAb-VEGF_LightChain
  source 1..642: mol_type = other RNA
gacatacaaatgacacaatccccatcatccctatcagcatcagtaggagacagagtaacaataacctgctcagcatcacaagacatatcaaactacttaaactggtaccaacaaaaaccaggaaaagcaccaaaagtactaatatactttacatcctctttacactcaggagtaccatcacgattctcaggatcaggatcaggaacagacttcacattaacaataagctcactacaaccagaagacttcgcaacatactactgccaacaatactccacagtcccatggacattcggacaaggaacaaaagtagaaataaaacgaacagtagcagcaccatcagtattcatattcccaccatccgacgaacaactaaaatctggaacagcatctgtagtatgcctactaaacaacttctacccaagagaagcaaaagtccaatggaaagtcgacaacgcactacaatcaggaaactcacaagaatcagtaacagaacaagactcaaaagactcaacatactcactatcatcaacattaacactatctaaagccgactacgaaaaacacaaagtatacgcatgcgaagtaacacaccaaggactatcatcaccagtcacaaaatccttcaacagaggcgaatgt

SEQ ID NO: 46607 - RNA, 321 nt, synthetic construct
  misc_feature 1..321: note = derived and/or modified sequence opt6 from rhuMAb-VEGF_LightChain__VG-Region
  source 1..321: mol_type = other RNA
gacatacaaatgacacaatcaccatcatcactatcagcatcagtaggagacagagtaacaataacatgctcagcatcacaagacatatcaaactacctaaactggtaccaacaaaaaccaggaaaagcaccaaaagtactaatatacttcacatcatcactacactcaggagtaccatcaagattctcaggatctggatcaggaacagacttcacactaacaatatcatcactacaaccagaagacttcgcaacatactactgccaacaatactcaacagtaccatggacattcggacaaggaacaaaagtagaaataaaa

SEQ ID NO: 46608 - RNA, 1359 nt, synthetic construct
  misc_feature 1..1359: note = derived and/or modified sequence opt6 from rhuMAb-VEGF_gamma1-Chain
  source 1..1359: mol_type = other RNA
gaagtacaactagtagaatcaggtggaggtttagtacaaccaggcggatcactacgtctatcttgcgcagcatcaggatatacattcacaaactacggaatgaactgggtaagacaagctccaggaaaaggattagaatgggtaggatggataaacacctacacaggtgaaccaacatacgcagcagacttcaaacgtagattcacattctccctagatacatcaaaatcaacagcatacttacaaatgaacagtctcagagcagaagacacagcagtatattactgcgcaaaatatccccactactacggatcatcacactggtacttcgatgtatggggacaaggcacattagtaacagtatcctcagcttcaaccaaaggtccatcagtattcccattagctccctcttccaaatcaacatcaggaggaacagcagcattaggttgccttgtcaaagactacttcccagaaccagtaacagtatcatggaattcaggagcattaacctctggagtacacactttcccagcagtactacaatcatcaggactatactctctatcttctgtcgtaacagtaccttcatcatcactcggcacacaaacttatatttgcaacgtaaaccacaaaccatcaaataccaaagtagataaaaaagtagaacctaaatcttgtgacaaaacacacacctgccccccatgtccagccccagaattactaggaggaccatcagtttttttattcccaccaaaacccaaagacacactaatgataagcagaaccccagaagtaacatgcgtcgtagtagatgtctctcacgaagatccagaagtaaaatttaattggtatgttgacggtgtagaagtacacaatgcaaaaactaaacccagagaagaacaatacaactcaacttacagagtagtttccgtactaacagtattacaccaagactggcttaacggaaaagaatacaaatgcaaagtttccaataaagcactaccagcaccaatagaaaaaacaatctcaaaagctaaaggacaaccaagagaaccacaagtatatacattaccaccatctcgagaagaaatgacaaaaaaccaagtatccttaacttgtctagtaaaaggattttatccttcagatatcgccgtagaatgggaatcaaatggacaacccgaaaataactacaaaactactcccccagtactagattcagacggatcattctttctatactcaaaattaacagtagacaaatcaagatggcaacaaggcaacgtattttcatgctcagtaatgcacgaagccctacacaatcactatacacaaaaatcactgtctctaagcccaggaaaa

SEQ ID NO: 46609 - RNA, 369 nt, synthetic construct
  misc_feature 1..369: note = derived and/or modified sequence opt6 from rhuMAb-VEGF_gamma1-Chain_VDG-Region
  source 1..369: mol_type = other RNA
gaagtacaattagtagaaagtggaggaggattagtacaaccaggaggaagtttaagattaagttgtgcagcaagtggatatacatttacaaattatggaatgaattgggtaagacaagcaccaggaaaaggattagaatgggtaggatggataaatacatatacaggagaaccaacatatgcagcagattttaaaagaagatttacatttagtttagatacaagtaaaagtacagcatatttacaaatgaatagtttaagagcagaagatacagcagtatattattgtgcaaaatatccacattattatggaagtagtcattggtattttgatgtatggggacaaggaacattagtaacagtaagtagt

SEQ ID NO: 46610 - RNA, 1338 nt, synthetic construct
  misc_feature 1..1338: note = derived and/or modified sequence opt6 from Rilotumumab_HeavyChain1
  source 1..1338: mol_type = other RNA
caagtacaattacaagaatcaggaccaggattagtaaaaccatcagaaacactctcactaacatgtacagtctcaggaggctcaatatcaatatactactggtcctggataagacaaccaccaggaaaaggattagaatggataggatacgtatactactcaggatcaacaaactataacccttcattaaaatcacgagtaacaatatcagtagacacatcaaaaaatcaattctctctaaaactaaatagtgtaacagcagcagacacagcagtatattattgtgccagaggaggctacgatttctggagcggctatttcgactactggggacaaggaacattagtaacagtatcatcagcctccacaaagggaccttcagtatttccattagcaccatgctcaagatccacatcagagtcaacagcagccttaggatgtctagtaaaagactactttccagaacccgtaacagtcagctggaattcaggagctctaacatcaggagttcacacatttcccgcagttttacaatcatctggactatactcactatcatcagttgttaccgttccctcatcaaacttcggcactcaaacatatacttgtaatgtagaccataaaccctccaatactaaagtcgataaaacagtagaaagaaaatgctgcgttgaatgtccaccatgccctgccccaccagtagcaggaccaagtgtttttctatttccaccaaaaccaaaagataccctcatgatttcaagaacacccgaagtaacctgcgtagtagtagatgtatctcacgaagatccagaagtacaatttaactggtacgtcgacggtgtagaagtacataacgcaaaaacaaaaccaagagaagaacaatttaactcaacattcagggtagtatctgtactaacagtagtacatcaagattggctaaacggcaaagaatacaaatgtaaagtttcaaacaaaggactacccgcccccatagaaaaaacaatatcaaaaacaaaaggacaaccaagggaaccccaagtatacaccctaccaccatcaagagaagaaatgacaaaaaaccaagtatcactaacatgcttagtaaaaggcttttatccatcagacattgcagtagaatgggaatctaacggacaacccgaaaacaactataaaacaacaccaccaatgcttgactcagacggttctttcttcctctactccaaactaacagttgacaaaagcagatggcaacaaggtaacgtattttcatgctcagtaatgcacgaagcactacataaccactacacacaaaaatcactaagcctatctcccggaaaa

SEQ ID NO: 46611 - RNA, 645 nt, synthetic construct
  misc_feature 1..645: note = derived and/or modified sequence opt6 from Rilotumumab_LightChain1
  source 1..645: mol_type = other RNA
gaaatagtaatgacacaatcaccagccacactatcagtatcaccaggagaaagagcaacattatcatgccgagcatcacaatccgtagactcaaacctagcatggtacagacaaaaaccaggacaagcaccaagactactaatatacggagcatcaacaagagcaacaggaataccagcaagattctcaggatcaggatcaggaacagaattcacattaacaatatcatcattacaatcagaagacttcgcagtatactactgccaacaatacataaactggccaccaataacattcggacaaggaacaagactagaaataaaaagaacagtagcagcaccatcagtattcatatttccaccatccgatgaacaactaaaatcaggcacagcatcagtagtatgcctattaaacaacttctacccaagagaagcaaaagtacaatggaaagtagacaacgcattacaatcaggaaactcacaagaatcagtaacagaacaagactcaaaagactcaacatactcattatcctcaacactaacactatccaaagcagactacgaaaaacacaaagtatacgcctgcgaagtaacacaccaaggactatcatcaccagtaacaaaatcatttaacagaggtgaatgc

SEQ ID NO: 46612 - RNA, 1071 nt, synthetic construct
  misc_feature 1..1071: note = derived and/or modified sequence opt6 from Rilotumumab_scFv-CH_chain
  source 1..1071: mol_type = other RNA
gaagtacaattattagaatcaggcggaggactagtccaacctggaggatctttaagattatcatgcgcagcatcaggatttacatttagctcattctcaatgtcatgggtaagacaagcaccaggcaaaggactagaatgggtatcatcaatatcaggatcttcaggaacaacatattatgcagactcagtaaaaggaagatttacaatatcaagagacaattcaaaaaatacattatacctacaaatgaactcattaagagcagaagatacagcagtttattattgcgcaaaaccatttccatattttgattattggggacaaggaacattagtaacagtatcatcaggagacggaagttcaggtggaagtggaggcgcaagtgaaattgtgttaacacaaagtccaggaacattaagcttatcaccaggtgaaagagctacattatcttgtagggcaagtcaatccgtatcaagttcatttttagcatggtatcaacaaaaacctggtcaagcacccagactccttatatattatgcatcatcacgagcaacaggaataccagatagatttagcggaagtggaagtggaacagatttcacactaacaatatcaagattagaaccagaagatttcgcagtatattattgtcaacaaacaggaagaataccaccaacctttggacaaggaaccaaagtagaaataaaatctggaggttcaggaggaccaagagcagcaccagaagtctatgcttttgctacaccagaatggccaggaagcagagataaaagaacattagcttgtttaatacaaaattttatgccagaagatatctcagtacaatggttacataacgaagtacaattaccagatgccagacactcaactacacaaccaagaaaaacaaaaggatctggatttttcgtattttcaagattagaagttacacgagcagaatgggaacaaaaagatgaatttatttgtagagcagtacatgaagccgcatcaccaagccaaacagtacaaagagccgtatcagtaaacccagaatcaagtagaagaggaggatgt

SEQ ID NO: 46613 - RNA, 1347 nt, synthetic construct
  misc_feature 1..1347: note = derived and/or modified sequence opt6 from Rinucumab_HeavyChain1
  source 1..1347: mol_type = other RNA
caactccaactacaagaatcaggcccaggactggtaaaaccatcagaaactttatcactaacatgtaccgtttcaggcggatcaataacatcatcttcttactattggggatggatcagacaaccacccggtaaaggactagaatggatcggaagtatatactacagaggttctacaaactacaatccctccttaaaatcacgagttacaatatcagtcgactctagcaaaaaccaattttatctaaaagtatcctccgtcacagcagtagacacagcagtctactactgtgcaagacaaaacggagcagctagaccatcctggttcgacccatggggacaaggaacactagttacagtttcatcagcatctacaaaaggaccatcagtattccccctagcaccatgctctcgctccacatctgaatctacagcagcactaggatgcctagtaaaagactacttcccagaaccagtaacagtctcatggaattcaggagctctaacatcaggcgtacacacattccctgccgtacttcaatcatcaggactatactcactaagttccgtagtaacagtaccatcatcatcattaggaacaaaaacatacacatgcaacgtcgaccataaaccctcaaacacaaaagtagacaaaagagtagaatcaaaatatggcccaccatgcccaccctgcccagcccccgaattcctaggaggaccatcagtatttttatttccaccaaaacccaaagacacactaatgatatccagaactccagaagtcacttgtgtagttgtagatgtctctcaagaagatccagaagttcaattcaactggtatgttgacggagttgaagtacacaatgcaaaaacaaaaccacgagaagaacaattcaactcaacttatcgagtagtaagtgtattaacagttttacaccaagactggttaaatggtaaagaatacaaatgtaaagtatcaaacaaaggactaccatcatctatagaaaaaacaatatccaaagccaaaggacaaccaagagaaccacaagtatacacattaccaccatcacaagaagaaatgaccaaaaaccaagtctcactaacatgcctagtcaaaggattttacccatcagacattgcagtagaatgggaaagcaacggacaaccagaaaataattacaaaacaacaccacccgtactagactcagacggaagcttcttcctctactccagactaacagttgacaaatcaagatggcaagaaggtaatgtcttctcttgctcagtcatgcatgaagcattacataaccattatactcaaaaatctctatcactatcactaggaaaa

SEQ ID NO: 46614 - RNA, 1344 nt, synthetic construct
  misc_feature 1..1344: note = derived and/or modified sequence opt6 from Rinucumab_HeavyChain
  source 1..1344: mol_type = other RNA
caattacaattacaagaatcaggaccaggattagtaaaaccatcagaaaccctatccctaacatgcacagtatcaggaggatcaataacatcatcctcctactactggggatggatacgacaaccacccggaaaaggactagaatggattggttcaatctactacagaggatcaaccaactacaacccatcactaaaaagccgcgtaacaatatcagtagacagttcgaaaaatcaattttacctaaaagtatcctcggtaacagcagtcgatacagcagtatattactgcgcccgacaaaacggagctgcaagaccctcctggttcgatccttggggacaaggtactctagtaacagtatcatctgcatcaacaaaaggcccttcagtattcccattagcaccatgctcaagatcaacatccgaaagtacagcagcacttggatgtctagtaaaagactacttcccagaaccagtaactgtcagttggaattctggagcactaacctctggtgttcacacattcccagcagtacttcaaagtagtggcttatattcactatcatccgtagtaacagtaccatcatcatccttagggacaaaaacatacacctgtaacgtagaccataaaccatcaaatacgaaagtagataaaagagtagaatccaaatacggaccaccatgccctccatgcccagcacctgaatttttaggtggaccatccgtattcctattcccccccaaaccaaaagatacactaatgatttcaagaacaccagaagtaacctgcgtcgttgtcgatgtatcacaagaagaccctgaagtacaatttaattggtacgtagacggagtagaagtacacaacgcaaaaacaaaacccagagaagaacaatttaactcaacataccgagttgtatcagtacttacagtattacaccaagattggctaaacggaaaagaatacaaatgtaaagtatcaaataaaggacttccatcatcaatagaaaaaacaatatctaaagcaaaaggccaaccacgagaaccacaagtatacacactaccaccatcacaggaagaaatgacaaaaaaccaagtatcacttacttgcctagttaaaggattttacccatcagacatcgcagttgaatgggaatcaaacggccaaccagaaaataactataaaacaacaccaccagtactagactcagatggatccttctttttatactcaagactaacagtagataaatcaagatggcaagaaggaaacgtattttcttgttcagtcatgcacgaagcactacataaccattacacacaaaaatcattatcactatcattagga

SEQ ID NO: 46615 - RNA, 645 nt, synthetic construct
  misc_feature 1..645: note = derived and/or modified sequence opt6 from Rinucumab_LightChain1
  source 1..645: mol_type = other RNA
gaaatagtactaacacaatcaccagacacaatatcactctcaccaggagaaagagccacactatcatgcagagcatcacaatcaatatcatcaatatacctagcctggtaccaacaaaaacccggccaagccccaagactattaatatatggagcctcatcacgagtaacaggaataccagacagattctcagtctcaggatcaggaacagatttcaccctaacaatatcaagactagaaccagaagacttcgcagtatactattgccaacattacggaatatcaccattcacattcggacccggaacaaaagtagacataagaagaacagtcgcagcaccttcagtattcatattcccaccatctgacgaacaactaaaatcaggaacagcatcagtagtatgcttactaaacaatttctacccaagagaagcaaaagtacaatggaaagtagacaacgcattacaatcaggaaactcacaagaatcagtcacagaacaagactcaaaagactcaacctactccctatcatcaaccctaacattatcaaaagcagactacgaaaaacacaaagtatacgcatgcgaagtaacacaccaaggattatcatcaccagtaacaaaatcatttaacagaggagaatgc

SEQ ID NO: 46616 - RNA, 1347 nt, synthetic construct
  misc_feature 1..1347: note = derived and/or modified sequence opt6 from Risankizumab_HeavyChain1
  source 1..1347: mol_type = other RNA
caagtacaactagttcaatcaggagcagaagtcaaaaaaccaggatcctcagtcaaagtatcatgcaaagcttcaggatacactttcacagaccaaacaatacactggatgcgacaagccccaggccaaggattagaatggataggatatatatacccccgcgacgatagcccaaaatataatgaaaacttcaaaggaaaagtaacaataacagccgacaaatcaacctcaacagcctacatggaactatctagcctaagaagcgaagacacagcagtctactattgtgcaatcccagacagatcaggatacgcatggttcatatactggggacaaggaacactagtaactgtttcttccgcttcaacaaaaggaccatcagtattcccattagcaccatcatcaaaatcaacatctggcggtacagccgcactaggatgcttagtaaaagactacttcccagaaccagtcaccgtatcatggaactcaggtgcattaacatcaggagtacatacattccccgcagtattacaatcatcaggactatactccctatcatccgtagtaactgtaccatcatcatcactaggaacacaaacttacatttgcaacgtaaaccacaaaccgtcaaacacaaaagtagacaaaagagttgaaccaaaatcatgcgacaaaacacatacatgcccaccctgccccgcaccagaagccgcaggaggaccatcagtattcctattcccaccaaaaccaaaagacacactaatgatatcaagaacacctgaagtaacctgcgtagtagtcgacgtatcccacgaggatccagaagtaaaatttaattggtacgtcgatggtgtagaagtacataatgcaaaaaccaaacccagagaagaacaatacaattccacataccgagtagtatcagtcctaacagtcctgcaccaagactggttaaatggcaaagaatacaaatgcaaagtctcaaacaaagcattaccagcaccaatagaaaaaaccatatcaaaagcaaaaggccaacctcgagaaccccaagtttacacattacctccatcaagagaagaaatgacaaaaaatcaagtttcattaacatgcttagtaaaaggattctatccctcagacatagcagtagaatgggaatccaatggtcaaccagaaaacaattacaaaacaacaccaccagttctagactcagacggttcatttttcctatactcaaaactaacagtcgataaatccagatggcaacaaggaaatgtattttcatgttccgtaatgcatgaagcactccacaaccactatactcaaaaatcactaagcctatcacccggt

SEQ ID NO: 46617 - RNA, 642 nt, synthetic construct
  misc_feature 1..642: note = derived and/or modified sequence opt6 from Risankizumab_LightChain1
  source 1..642: mol_type = other RNA
gatatacaaatgacacaatcaccatcatcattatcagcttcagtaggagatagagtcacaataacatgtaaagcatcaagagacgtagcaatagccgtagcctggtaccaacaaaaaccaggcaaagtaccaaaattactaatatactgggcatcaacacgccacacaggagtaccatccagattctcaggatcaggatcaagaacagacttcacattaaccatatcatctctacaacccgaagacgtagcagattacttctgccatcaatattcatcatacccattcacattcggatcaggaacaaaattagaaataaaaagaacagtagcagcaccatcagtattcatattcccaccctcagacgaacaattaaaatcaggaacagcatcagtagtatgcctactaaacaacttctacccaagagaagcaaaagtacaatggaaagtagacaacgcactccaatcaggaaactcacaagaatcagtaacagaacaagactcaaaagactcaacttactcattatcatccaccttaacactatcaaaagcagactacgaaaaacacaaagtatacgcatgcgaagtaacacatcaaggactatcatcaccagtaacaaaatcattcaatagaggagaatgt

SEQ ID NO: 46618 - RNA, 1353 nt, synthetic construct
  misc_feature 1..1353: note = derived and/or modified sequence opt6 from Rituximab_HeavyChain
  source 1..1353: mol_type = other RNA
caagtacaattacaacaaccaggagccgaactagtaaaacccggagcatcagtaaaaatgtcatgtaaagcaagtggatatactttcacatcctacaatatgcattgggtaaaacaaacaccaggaagaggactcgaatggatcggcgccatataccccggaaatggcgacacatcatacaaccaaaaatttaaaggaaaagcaacattaacagcagacaaatcttcatcaaccgcatacatgcaattatcatcattaacatctgaagattcagcagtctattactgtgcacgctcaacatactacggaggcgattggtattttaacgtatggggcgcaggtacaacagtaacagtatcagccgcctcaacaaaagggccctctgtattcccacttgccccctcaagtaaatcaacatctggaggaacagcagcattaggatgcttagtaaaagattacttccccgaacccgtaacagtatcatggaattccggagcactcacctcaggagttcacacattcccagccgtactccaatcatcaggtctatactcactctcatccgtcgttacagttccttcctcatctttaggaacacaaacatatatatgcaacgttaatcataagccatcaaacacaaaagtagataaaaaagtcgaaccaaaatcatgtgacaaaacccatacatgtcccccatgcccagcaccagaattactaggagggcccagtgtatttctattcccacccaaaccaaaagacacactcatgatatcaagaactccagaagtaacttgcgtagtagtagacgtttcacacgaagacccagaagtcaaatttaactggtatgtagatggagtagaagtacacaacgcaaaaacaaaacctagagaagaacaatataactcaacatacagagtagtatcagtactaacagtactccaccaagactggctaaacggaaaagaatataaatgcaaagtatcaaacaaagccctaccagcaccaatagaaaaaacaatatcaaaagcaaaaggccaaccaagggaaccacaagtctacacactacctccctctagagatgaactaacaaaaaaccaagtatccctcacatgcctagtaaaaggattttacccttcagacatagcagtagaatgggaatcaaacggccaaccagaaaacaactacaaaacaacaccaccagtactagactcagacggctcattcttcctatattccaaattaacagtagacaaatcaagatggcaacaaggcaacgtattctcatgttctgtaatgcatgaagctctacacaaccattatactcaaaaaagcctatcattaagtccaggtaaa

SEQ ID NO: 46619 - RNA, 1353 nt, synthetic construct
  misc_feature 1..1353: note = derived and/or modified sequence opt6 from Rituximab_HeavyChain_variant
  source 1..1353: mol_type = other RNA
caagtacaattacaacaacctggagcagaactagtaaaacccggagcctcagtcaagatgtcatgcaaagcatctggatatacatttacatcctacaacatgcattgggtaaaacaaacaccaggacgaggactagaatggataggtgcaatttatcctggcaacggagacacctcatataaccaaaaattcaaaggaaaagcaacactaacagccgataaatcaagctcaacagcatacatgcaattatcatcactcacttcagaggattcagcagtctactactgcgcacgatccacctactatggcggcgactggtactttaatgtatggggcgcaggaaccacagtaacagtcagcgccgcatcaacaaaaggaccctcagtattccctctagccccatcaagcaaatcaacatcaggaggaactgcagcacttggatgtttagtcaaagattacttccccgaacccgtaaccgtatcatggaactcaggagctttaacttcaggcgtacacacattccccgctgtcttacaaagttcaggactatactcactatcatcagtagtaacagtacccagttcatcattaggcacacaaacttacatttgcaacgtcaaccataaaccatcaaacacaaaagtagataaaaaagcagaaccaaaatcttgcgataaaacccacacatgcccaccatgcccagcaccagaactcctaggaggaccatcagtattcctattccccccaaaaccaaaagacacattaatgatatccagaacacctgaagttacatgtgtagtagtagatgtctcacacgaagacccagaagtaaaatttaattggtacgtagacggagtagaagtccacaacgcaaaaaccaaacctcgagaagaacaatacaactcaacatacagagtagtatctgtactaacagtactccaccaagactggctcaacggaaaagaatataaatgcaaagtatcaaacaaagcactacctgcaccaatcgaaaaaacaatatctaaagcaaaaggacaaccaagagaaccccaagtatacacattaccaccaagccgagacgaactaactaaaaaccaagtatcacttacatgcttagtaaaaggattctacccatcagatatagcagtagaatgggaatcaaacggacaaccagaaaataactacaaaacaacaccaccagtactcgattccgacggatcattttttctatactcaaaactaaccgtagacaaatcaagatggcaacaaggaaatgtattctcatgctcagtaatgcatgaagcattacataaccactacacacaaaaatcactatcactatcaccaggaaaa

SEQ ID NO: 46620 - RNA, 639 nt, synthetic construct
  misc_feature 1..639: note = derived and/or modified sequence opt6 from Rituximab_LightChain
  source 1..639: mol_type = other RNA
caaatagtattatcacaatcacccgccatactatcagcatcaccaggcgaaaaagtaacaatgacatgcagagcatcatcatcagtatcatacatacactggttccaacaaaaaccaggatcatcaccaaaaccatggatatacgcaacatcaaacttagcatcaggagtaccagtaagattctcaggatcaggctcaggaacatcatactcactaacaatatcaagagtagaagcagaagacgcagcaacatactactgccaacaatggacaagcaatccaccaacattcggaggaggaacaaaacttgaaataaaaagaacagtagcagcaccatcagtatttatatttccaccatcagatgaacaactaaaatccggaacagcatcagtagtatgcctactaaacaacttctaccctagagaagcaaaagtacaatggaaagtagacaatgcactacaatcaggaaactcacaagaatcagtaacagaacaagactcaaaagactcaacctactcattatcatcaacactaacactatcaaaagccgactacgaaaaacacaaagtatacgcatgcgaagtaacacaccaaggcctatcatccccagtaacaaaatccttcaacagaggagaatgc

SEQ ID NO: 46621 - RNA, 714 nt, synthetic construct
  misc_feature 1..714: note = derived and/or modified sequence opt6 from Rivabazumab_pegol_HeavyChain1
  source 1..714: mol_type = other RNA
gaagtacaactagtagaatcaggaggtggagtagtacaaccaggcagatcactacgactatcatgcgcagccagtggattcacattctcaaattacccaatgcactgggtaagacaagcaccaggaaaaggcttagaatgggtagcagttatatcatatgacggatcagaaaaatggtacgcagactcagtaaaaggaagatttacaatatcaagagataatagcaaaaacacattatacttagaaatgaactcattaagaccagaagatacagcagtatattattgcgccagaaacagaggagacatatactatgactttacatatgcaatggacatatggggccaaggaacaactgtaacagtaagcagcgcatcaacaaaaggaccatcagtatttccactagcaccttcatcaaaatcaacaagcggcggaacagcagcactaggatgtttagtcaaagactatttcccagaaccagtaacagtatcatggaacagcggagcactaacatcaggagtacatacatttccagctgtactacaatcatcaggtctatattcattatcaagtgtagtaacagttccatcatcaagtttaggaacccaaacatacatatgtaacgtaaaccataaaccaagcaacacaaaagtagacaaaaaagtcgaaccaaaatcaagtgacaaaacacatacatgtcccccatgcccagca

SEQ ID NO: 46622 - RNA, 642 nt, synthetic construct
  misc_feature 1..642: note = derived and/or modified sequence opt6 from Rivabazumab_pegol_LightChain1
  source 1..642: mol_type = other RNA
gatattcaactaacacaatcaccatcaacactaagcgcaagcgtaggagatagcgtaacaataacatgcagagcaagtgaaggagtagacagatggctagcatggtaccaacaaaaaccaggaagagctccaaaactcctaatatatgacgcatcaacactacaaagcggagtaccatcaagattctcaggatcaggatcaggaacagaatttagcctaaccataagttcactccaaccagatgacgtagcaacatactattgccaacacttttggggaacaccatacacattcggacaaggaacaaaactagaaataaaaagaacagtagcagcaccatcagtattcatattcccaccatcagacgaacaattaaaatcaggcacagcatcagtagtatgcttactaaacaacttttacccaagagaagccaaagtccaatggaaagtcgataacgcactacaatcaggaaactcacaagaatccgtaacagaacaagacagcaaagactcaacatacagcctatcatcaacattaacattaagcaaagccgattacgaaaaacataaagtatacgcatgcgaagtaacacaccaaggattatcatctccagtaacaaaatcatttaacagaggagaatca

SEQ ID NO: 46623 - RNA, 1344 nt, synthetic construct
  misc_feature 1..1344: note = derived and/or modified sequence opt6 from Robatumumab_HeavyChain1
  source 1..1344: mol_type = other RNA
gaagttcaactagtccaatcaggaggaggattagtaaaacccggaggatcacttagattatcatgcgcagctagtggatttactttttcatcattcgcaatgcattgggtaagacaagccccaggcaaaggattagaatggatatcagttatagatacaagaggtgcaacatactatgccgactcagtaaaaggcagattcacaatttcacgagataacgccaaaaattctttatacttacaaatgaactcactacgagccgaagacacagccgtttactactgcgcaagactaggaaacttctactatggcatggatgtttggggacaaggcacaacagttacagtatcctcagcttccaccaaaggaccatctgtttttcctctagccccatcatcaaaatcaacatcaggaggaacagccgcactaggttgcttagttaaagactatttcccagaaccagttacagtatcttggaatagcggtgctttaacttccggtgtacatacattcccagccgtcttacaatcctctggcctatactcactatcatccgtagttacagtaccatcctcctcactaggaacacagacatacatatgcaacgttaaccataaaccatcaaacacaaaagtcgacaaaaaagtagaacctaaatcctgtgataaaacacacacctgtcccccatgtccagcacccgaactattaggaggaccatccgtatttctatttccaccaaaaccaaaagacacattaatgatatcaagaacaccagaagtaacatgtgtagtagtagacgtatcacatgaagaccccgaagtaaaattcaactggtacgtagacggagtagaagtacataacgcaaaaacaaaacccagagaagaacaatataactcaacatatagagttgtatcagtattaacagtacttcaccaagactggctcaacggtaaagaatataaatgcaaagtctcgaacaaagcattacctgcacctatagaaaaaacaatatcaaaagctaaaggacaaccaagagaaccacaggtctatacactcccaccaagcagagacgaattaactaaaaatcaagtttcacttacttgtcttgtaaaaggattctatccatcagacattgcagtagaatgggaatcaaacggacaaccagaaaacaattacaaaacaacaccccctgtactagactcagacggttccttcttcctatactctaaattaacagtagataaatcaagatggcaacaaggcaacgtcttctcttgttcagtcatgcatgaagccctccacaaccattacactcaaaaatccttatcactctctccaggaaaa

SEQ ID NO: 46624 - RNA, 642 nt, synthetic construct
  misc_feature 1..642: note = derived and/or modified sequence opt6 from Robatumumab_LightChain1
  source 1..642: mol_type = other RNA
gaaatagtactaacacaatcaccaggaacactatcagtatcaccaggagaaagagcaacactatcatgccgagcatcacaatcaataggatcatcactacactggtaccaacaaaaaccaggacaagcaccaagattattaatcaaatacgcatcacaatcactatcaggaataccagacagattctcaggatcaggatcaggaacagacttcaccttaaccatatccagactagaaccagaagacttcgcagtatactactgccaccaatcaagccgactaccacacacattcggacaaggaacaaaagtcgaaataaaacgaacagtagcagccccatctgtattcatattcccaccatcagacgaacaactaaaatcaggaacagcatcagtagtatgcctattaaacaacttctacccaagagaagcaaaagttcaatggaaagtagacaacgcactacaatcaggaaactcacaagaatcagtaaccgaacaagactcaaaagactcaacatactcactaagttcaacattaacactatcaaaagccgactacgaaaaacacaaagtatacgcatgcgaagtaacacaccaaggactatcatcaccagtaacaaaatcattcaacagaggagaatgc

SEQ ID NO: 46625 - RNA, 1368 nt, synthetic construct
  misc_feature 1..1368: note = derived and/or modified sequence opt6 from Roledumab_HeavyChain1
  source 1..1368: mol_type = other RNA
caagtacaactagtagaatcaggtggcggtgttgtgcaaccaggaagatctcttagattatcatgtacagcatccggattcactttcaaaaactatgcaatgcactgggtacgacaagcaccagcaaaaggactagaatgggtagcaacaattagttatgacggaagaaacatacaatacgcagattcagtaaaaggaagattcacattctcaagagacaactcacaagacacattatatctacaattaaacagtctaagacccgaagatactgcagtctattactgcgcaagaccagtaagatcaagatggctccaattaggattagaagatgcattccacatctggggacaaggaacaatggtaacagtgtcttccgcatcaactaaaggacccagtgtattcccattagcaccatcatcaaaatcaacttccgggggtactgcagcactaggatgtctagtaaaagattattttccagaaccagtaacagtatcatggaattcaggagcactaacatcaggagtacatacattccctgcagtcctacaatcatctggactctactctttatcatcagtcgtaactgtaccatccagttcattaggtactcaaacatacatatgcaatgtaaaccacaaaccatctaatacaaaagttgacaaaaaagtagaaccaaaatcatgtgacaaaacacatacatgcccaccatgccccgcaccagaattattaggcggaccatcagtattcttattccccccaaaaccaaaagatacattaatgatttcaagaacaccagaagtaacttgtgtagttgtcgatgtatcacacgaagacccagaagtcaaattcaactggtacgtagatggagtagaagtacataacgctaaaacaaaaccccgagaagaacaatacaactccacttacagagtcgtcagtgtactaacagtactacaccaagactggctaaacggaaaagaatataaatgtaaagtctcaaacaaagcattaccagcaccaatagaaaaaacaatatccaaagctaaaggtcaaccacgagaaccacaagtatacacactaccaccatcaagagacgaattaacaaaaaaccaagtatcattaacatgtttagtaaaaggattttatccatcagacatagcagtagaatgggaatcaaacggacaaccagaaaataactataaaacaacaccacctgtattagacagcgacggatccttctttttatactctaaactaacagtagacaaaagcagatggcaacaaggaaatgtattctcttgctcagtaatgcatgaagcattacacaatcactacacacaaaaatccttatcactatcccctggaaaa

SEQ ID NO: 46626 - RNA, 642 nt, synthetic construct
  misc_feature 1..642: note = derived and/or modified sequence opt6 from Roledumab_LightChain1
  source 1..642: mol_type = other RNA
gccatcagaatgacacaatcaccatcatcattctccgcatcaacaggagacagagtaaccataacatgccgcgcatcacaagatatacgaaactacgtagcatggtatcaacaaaaatccggaaaagcacccaaattcctaatatacgcagcatcaacactacaatccggagtaccatctagattctcaggatcaggatcaggaacagactttacattaacaataaactcactacaatcagaagacttcgccacatactactgccaacaatactacaactcaccaccaacattcggacaaggaaccagagtcgaaataacaagaacagtagcagcaccatcagtattcatattcccaccatcagacgaacaactaaaatcaggaacagcatcagtagtatgcctactaaataacttctacccaagagaagcaaaagtacaatggaaagtcgacaatgcactacaatccggaaactcacaagaatcagtaacagaacaagactcaaaagactcaacatacagcctttcatcaaccctaaccctaagcaaagcagactacgaaaaacacaaagtatacgcatgcgaagtaacacaccaaggactatcctcaccagtcacaaaatcattcaacagaggagaatgc

SEQ ID NO: 46627 - RNA, 639 nt, synthetic construct
  misc_feature 1..639: note = derived and/or modified sequence opt6 from Romosozumab_fab_fragment
  source 1..639: mol_type = other RNA
gatatacaactaacacaatcaccatcttcactatcagcaagcgtaggcgaccgagtaacaataacctgctcagcatcacaagacatatcaaactacttaaactggtaccaacaaaaacccggaaaagcacctaaagtattaatatacttcacatcatcactacactcaggcgtaccatcaagattctcaggatcaggatcaggcacagacttcaccctaacaatatcctcactacaaccagaagacttcgccacatactactgccaacaatactccacagtaccatggacattcggacaaggaacaaaagtagaaataaaaagaacagtagcagccccatcagtattcatattcccaccatcagacgaacaactaaaatcaggaacagcatcagtagtatgcctattaaacaacttctacccaagagaagcaaaagtacaatggaaagtagacaacgcactacaaagcggaaactcacaagaatcagtaacagaacaagactcaaaagactctacatacagcctatcatcaacactaacactatcaaaagcagactacgaaaaacacaaagtatacgcatgcgaagtaacacaccaaggactatcatcaccagtaacaaaatcatttaacagaggagaa

SEQ ID NO: 46628 - RNA, 1347 nt, synthetic construct
  misc_feature 1..1347: note = derived and/or modified sequence opt6 from Romosozumab_HeavyChain1
  source 1..1347: mol_type = other RNA
gaagtacaactagtacaaagcggagcagaagttaaaaaaccaggagcatcagtcaaagtatcctgtaaagcatcaggatacacatttacagattacaatatgcactgggtcagacaagcaccaggacaaggactagaatggatgggagaaataaatccaaactccggaggagcaggctataaccaaaaatttaaaggaagagtaactatgacaacagacacaagcacttcaactgcctatatggaacttagatccttaagatctgacgacacagctgtatattactgcgcaagactaggatatgacgatatatacgatgactggtattttgacgtatggggacaaggaacaacagtcactgtttcaagcgcatcaaccaaaggtccatcagtatttccactagcaccatgctcaagatcaacatcagaatcaactgcagcacttggctgcttagtcaaagactacttcccagaacctgtaactgtatcatggaactccggagcactaacaagcggagtccatacattccctgcagtactacaatcgagcgggctatattccttatcatcagtagtaacagtaccatcaagtaattttggaacacaaacatacacatgtaatgtagatcataaaccatcaaatacaaaagtagataaaacagttgaacgtaaatgctgtgtagaatgtccaccatgtccagcaccaccagtagcaggaccaagtgtattcttattcccacccaaaccaaaagatacactaatgatatcaagaacaccagaagtaacttgcgtagtagtagatgtaagtcatgaagatcctgaagtacaattcaattggtatgtcgatggtgttgaagtacacaacgcaaaaacaaaaccacgtgaagaacaatttaactcgacatttagagtagtatcagtcctaacagtagtacaccaagactggctaaacggtaaagaatacaaatgtaaagtatctaacaaaggactaccagcacctatagaaaaaacaatatcaaaaacaaaaggacaaccaagagaaccacaagtatatactttacccccatctagagaagaaatgaccaaaaatcaagtatcactaacatgcctagtaaaaggattttacccatccgatatagcagtagaatgggaatcaaatggacaaccagaaaacaattacaaaacaacaccaccaatgttagactccgatggaagttttttcttatactcaaaactaacagtagacaaaagccgatggcaacaaggaaacgttttcagctgttcggtaatgcatgaagcactacataaccattacacacaaaaatcactatcactatcacccggaaaa

SEQ ID NO: 46629 - RNA, 642 nt, synthetic construct
  misc_feature 1..642: note = derived and/or modified sequence opt6 from Romosozumab_LightChain1
  source 1..642: mol_type = other RNA
gacatacaaatgacacaatcaccatcatcactaagcgcatcagtaggagaccgtgtaaccataacatgcagagcatcccaagacataagcaactacctaaactggtaccaacaaaaaccaggaaaagcaccaaaactattaatatactacacatcaagactattatccggagtaccatcaagattctcaggatcaggatcaggaacagactttacactaacaatatcatcactacaaccagaagacttcgcaacatactattgccaacaaggagacacactaccatacacattcggaggcggaacaaaagttgaaataaaaagaacagtagcagcaccaagcgtattcatattcccaccctcagacgaacaactaaaatcaggaacagcctcagtagtatgtttacttaataacttctacccaagagaagcaaaagtacaatggaaagtagacaacgcactacaaagcggaaactcccaagaatcagttacagaacaagactctaaagattcaacatacagcctaagctcaacactaacactaagcaaagcagactacgaaaaacacaaagtatacgcatgtgaagtaacacaccaaggactatcctcaccagtaacaaaaagcttcaacagaggagaatgc

SEQ ID NO: 46630 - RNA, 1326 nt, synthetic construct
  misc_feature 1..1326: note = derived and/or modified sequence opt6 from Rontalizuab_HeavyChain1
  source 1..1326: mol_type = other RNA
gaagtacaactcgtcgaatctggaggaggactagtacaaccaggaggatcactaagactaagttgtgcaactagcggatatacatttacagaatacattatacattgggtaagacaagcacccggcaaaggacttgaatgggtagcatcaataaacccagactacgacatcaccaactacaatcaacgattcaaaggaagattcactatatcattagacaaatccaaacgcacagcctacttacaaaactccttaagagcagaagatacagctgtctactattgtgcatcatggatatcagatttttttgactattggggacaaggaaccctagtaacagtatcatcagcatcaacaaaaggacccagtgtattcccacttgccccatcatcaaaatcaacttctggaggaacggccgcactaggatgcctagtcaaagactacttccctgaaccagtaacagtatcatggaactcaggagccctaacatccggagtacatacttttccagcagtactacaatcatcaggcctatactcattatcatccgtagtcacagtaccatcatcttcactaggtacccaaacttatatatgtaatgtaaatcacaaaccctcaaacaccaaagtagacaaaaaagtagaaccaaaatcatgcgataaaacacacacctgtccaccttgtccagcaccagaactattaggaggcccatcagtattcctattccctcctaagccaaaagatacactaatatcccgaacaccagaagtcacatgcgtagtagtagacgtctctcacgaagacccagaagtaaaattcaactggtacgtcgatggagtcgaagtacataatgccaaaaccaaacctagagaagaacaatataattcaacatacagagttgtatcagtacttacagtactacaccaagactggttaaacggtaaagaatacaaatgtaaagtatccaataaagccttaccagcaccaatagaaaaaacaatatcaaaagccaaaggtcaaccaagagaaccacaagtctacacactacccccatcaagagaagaaacaaaaaatcaagtttcactaacatgtctagtaaaaggtttctacccatccgacatagccgtagaatgggaatccaacggacaaccagaaaataactacaaaacaacaccaccagtattagattcagacggaagtttctttctatattcaaaattaacagtagacaaatcacgctggcaacaaggaaacgtcttctcatgctctgtacacgaagcactacataatcattacacacaaaaatctctttccctctcacctgga

SEQ ID NO: 46631 - RNA, 648 nt, synthetic construct
  misc_feature 1..648: note = derived and/or modified sequence opt6 from Rontalizuab_LightChain1
  source 1..648: mol_type = other RNA
gatatacaaacacaatcaccatcatcactatcagcatcagtaggcgacagagtaacaataacatgcagagcatcacaatcagtatcaacatcatcatactcataccactggtaccaacaaaaacccggaaaagcaccaaaagtactaatatcatacgcatcaaacctagaatcaggcgtaccatcaagattctccggatccggatcaggaacagacttcacactaacaatatcctcactacaaccagaagacttcgcaacatactactgccaacactcctggggaataccaagaacattcggacaaggaacaaaagtagaaataaaacgaacagtagcagcaccatccgtattcatattcccaccatcagatgaacaactaaaatcaggaacagcatctgtagtatgcctacttaacaacttctacccaagagaagcaaaagtacaatggaaagtagacaacgcactacaatctggaaactcacaagaatcagtaacagaacaagactccaaagactccacatactcattatcatcaacactaacattatcaaaagcagactacgaaaaacacaaagtatacgcatgcgaagtaacacaccaaggactatcatcaccagtaacaaaatcatttaacagaggcgaatgc

SEQ ID NO: 46632 - RNA, 1341 nt, synthetic construct
  misc_feature 1..1341: note = derived and/or modified sequence opt6 from Rontalizumab_HeavyChain1
  source 1..1341: mol_type = other RNA
gaagttcaactagtcgaatcaggaggcggattagttcaaccaggaggatcactaagactctcatgcgccacatcaggatacacattcacagaatatataatccactgggtaagacaagcacctggaaaaggactagaatgggtagccagcataaacccagactacgacataaccaactacaatcaaagatttaaaggtagattcacaatctccttagacaaatccaaacgtacagcatacctccaaatgaatagcctaagagcagaagacacagccgtatattactgcgcatcttggatatcagactttttcgattactggggacaaggaacccttgtcacagtaagctccgcctcaacaaaaggaccaagtgtattcccattagcaccctcatcaaaatcaacctccggaggaaccgccgcacttggctgtttagtaaaagattacttccccgaacctgtaacagtaagttggaacagcggagcacttacatctggagtacatactttcccagcagtactacaatcatccggcctctacagtctatcttcagttgtaaccgtaccatcatcatcactaggaacccaaacatatatctgcaatgtaaaccacaaaccatcaaacacaaaagtagacaaaaaagtagaaccaaaatcatgcgacaaaacacacacctgcccaccatgccccgcccccgaattacttggaggtccaagtgtattcttatttccacccaaaccaaaagacaccttaatgatttcaagaacaccagaagtaacatgtgtagttgtagacgtctcacacgaagacccagaagtaaagtttaactggtacgtagacggtgtagaagtccacaatgcaaaaacaaaaccaagagaagaacaatacaattcaacctacagagttgtcagcgtattaaccgtacttcatcaagactggctaaacggaaaagaatacaaatgtaaagtatcaaacaaagcattacccgcccccatcgaaaaaacaataagcaaagctaaaggccaaccacgagaacctcaagtatacacattaccaccctcaagagaagaaatgacaaaaaaccaagtatcactaacatgcctagtaaaaggcttctacccctcagatatcgcagtcgaatgggaatctaacggacaaccagaaaacaattataaaacaacaccacccgtactagacagtgatggctcattttttctatattcaaaattaaccgtagataaatctcgatggcaacaaggaaacgtattctcatgctcagtcatgcacgaagcactacacaatcattacacacaaaaatcactatcactttcacccggaaaa

SEQ ID NO: 46633 - RNA, 654 nt, synthetic construct
  misc_feature 1..654: note = derived and/or modified sequence opt6 from Rontalizumab_LightChain1
  source 1..654: mol_type = other RNA
gacatacaaatgacacaatcaccctcatcattatccgcatcagtaggagacagagtaacaataacatgcagagcaagccaaagtgtatcaacatcatcatactcatacatgcactggtaccaacaaaaaccaggaaaagcaccaaaagtactaatatcatacgcatcaaacctcgaatcaggagtaccatcaagattctcaggatcaggatcaggaacagacttcacactaacaatatcatcactacaaccagaagatttcgcaacatattactgccaacactcatggggcataccaagaacattcggacaaggaacaaaagtagaaataaaaagaacagtagcagcaccatcagtattcatattcccaccatcagacgaacaactaaaatcaggaacagcatcagtcgtctgcctactaaacaacttctacccaagagaagcaaaagtccaatggaaagtagacaacgcactacaatcaggaaactcccaagaatctgtaacagaacaagacagcaaagactcaacatacagcttaagctcaacactaacactatcaaaagcagactacgaaaaacacaaagtatacgcatgcgaagtaacacaccaaggattatcatcaccagtaaccaaatcatttaacagaggagaatgc

SEQ ID NO: 46634 - RNA, 1341 nt, synthetic construct
  misc_feature 1..1341: note = derived and/or modified sequence opt6 from Rovalpituzumab_tesirine_HeavyChain1
  source 1..1341: mol_type = other RNA
caagtacaactagtacaatcaggagcagaagtaaaaaaaccaggcgcaagcgtaaaggtatcttgcaaagcatcaggttacacatttacaaactacggaatgaattgggtaagacaagcaccaggacaaggactagaatggatgggctggataaacacctacacaggagaacccacttatgcagacgattttaaaggaagagtaacaatgacaaccgacacatccacatccaccgcatatatggaactaagatcactaagatctgatgacacagccgtatactactgtgcaagaatcggagactcatcaccctcagactattggggacaaggaacactagtaacagtttcatcagcttcaacaaaaggaccatcagtattcccactagcaccctctagtaaatcaacatctggcggaacagcagcactaggatgtttagtaaaagactacttcccagaaccagtaactgtatcatggaactcaggagctctaacatccggcgtccacacattcccagcagttttacaatcatcaggactatactccctctcatcagtagtaacagtaccatccagctctttaggcacccaaacatatatatgcaacgtaaaccataaaccatctaacacaaaagtcgacaaaaaagtagaaccaaaatcatgcgataaaacccacacctgcccaccatgcccagccccagaactactaggtggaccatcagtttttctcttcccaccaaaaccaaaagacaccttaatgatatcacgcacccctgaagtaacatgcgtagtagtagacgtatcacatgaagacccagaagtaaagttcaactggtacgtagatggagtagaagtacacaatgcaaaaaccaaaccaagagaagaacaatataattcaacatacagagtagtctcagtactaacagtattacatcaagactggttaaacggaaaagaatacaaatgcaaagtatcaaataaagcactaccagcaccaatagaaaaaactatatcaaaagctaaaggtcaaccaagagaaccacaagtatacacattaccacccagtagagatgaattaacaaaaaaccaagtatcactcacatgcctagttaaaggattttacccctctgacatagcagtagaatgggaatcaaacggacaaccagaaaacaactataaaacaacaccaccagtattagattcagatggatcttttttcttatattctaaactaacagtagacaaatcacgctggcaacaaggtaatgtttttagctgctcagttatgcacgaagcactacacaatcactacacccaaaaatcactatcactctcacccgga

SEQ ID NO: 46635 - RNA, 642 nt, synthetic construct
  misc_feature 1..642: note = derived and/or modified sequence opt6 from Rovalpituzumab_tesirine_LightChain1
  source 1..642: mol_type = other RNA
gaaatagtaatgacacaatcaccagcaacactatcagtatcaccaggagaacgagcaacactatcctgcaaagcatcacaatcagtatccaacgacgtcgtatggtatcaacaaaaaccaggacaagcaccaagactactaatatactacgcatccaacagatacacaggaatacctgcaagattctccggctcaggatcaggaacagaattcacattaacaatatcctctctccaatccgaagacttcgccgtatactactgccaacaagactacacatcaccatggacattcggacaaggaaccaaactcgaaataaaacgaacagtagcagcaccatccgtattcatattcccaccatcagacgaacaactaaaatcaggaacagcttcagtcgtatgcttattaaacaacttctacccaagagaagcaaaagtacaatggaaagtagacaacgcactacaatcaggaaattcacaagaatcagtaacagaacaagactcaaaagactcaacatactcactatcatcaaccctaacactatccaaagcagactacgaaaaacacaaagtatacgcatgcgaagtaacacaccaaggattatcatcaccagtaacaaaatcattcaacagaggagaatgt

SEQ ID NO: 46636 - RNA, 1341 nt, synthetic construct
  misc_feature 1..1341: note = derived and/or modified sequence opt6 from Rovelizumab_HeavyChain1
  source 1..1341: mol_type = other RNA
caagttcaactagtacaatcaggagccgaagtaaaaaaaccaggagcatccgtaaaagtaagctgtaaagccagtggttatacattcacaaataattggatgcaatgggtaagacaagcgcctggacaaggattagaatggatgggagcaatttttcccggagacgatgaaacaagatatacacaaaaatttagaggcaaagcaactataacagcagacacatcaacgtcaacagcatatatggaactttcaagccttagatcagaagacacagcagtatattactgtggaagaggtggaaaactaagaccattcgctttagattactggggccaaggtacactagtaacagtatcttccgctagtacaaaaggtccatccgtgtttccactagcaccatgctcaagatcaacatcagaatcaactgcagcattaggttgcctagtaaaagactactttccagaaccagtaacagtatcttggaatagcggagctctaacaagcggcgtacacacatttccagcagtactccaatcatcaggattatactccttaagcagcgtagtaacagtaccaagctcatcattaggaacaaaaacatatacatgtaacgtagatcacaaaccatcaaatacaaaagtcgataaaagagtagaatcaaaatatggaccaccatgcccttcatgccctgctccagaattcctaggtggtccaagtgtattcttattccccccaaaaccaaaagacacattaatgatatctcgtacaccagaagtaacatgcgtagtcgtagatgtaagtcaagaagatcctgaagtccaatttaactggtatgttgacggcgtagaagtacataacgcaaaaacaaaacctagagaagaacaattcaactcaacatatagagtagtctcagtattaaccgtactacaccaagattggttaaacggaaaagaatacaaatgtaaagtctcaaataaaggtttaccatcatcaatcgaaaaaaccatatcaaaagctaaaggtcaacccagagaaccacaagtatatacactaccaccttcccaagaagaaatgactaaaaaccaagtctcactaacatgcctagtaaaaggattttatccgagtgacatagccgtagaatgggaatccaacgggcaaccagagaataattataaaacaactccaccagtattagactcagatggcagtttttttctatattcacgcctcaccgtagataaaagtagatggcaagaaggaaatgtattttcatgctcagtaatgcacgaagccttacacaaccattacacacaaaaatcattatccctatcactaggaaaa

SEQ ID NO: 46637 - RNA, 654 nt, synthetic construct
  misc_feature 1..654: note = derived and/or modified sequence opt6 from Rovelizumab_LightChain1
  source 1..654: mol_type = other RNA
gacatacaaatgacacaatcaccatcatccctatccgcatccgtaggagacagagtaacaataacatgccgagcatccgaatcagtagaatcatacggaaacaacttcatgtactggtaccaacaaaaaccaggaaaagcaccaaaactcttaatatacctagcatcaaacttagaatcaggcgtaccatcaagattctcaggatcaggatcaggcaccgacttcacactaacaatatcatcactacaaccagaagactttgcaacatactactgccaccaagacaatgaagacccaccaacattcggacaaggaaccaaactcgaaataaaacgaacagtagcagcaccatcagtattcatattcccaccatctgacgaacaattaaaatcaggcacagcatcagtagtctgcctactaaacaacttctacccaagagaagccaaagtccaatggaaagtagacaacgcactacaatcaggaaactcccaagaatcagtaacagaacaagattcaaaagactcaacttactcactatcatcaacactaaccctatcaaaagcagactatgaaaaacacaaagtatacgcatgcgaagtcacacaccaaggactatcatccccagtaacaaaatcattcaacagaggagaatgc

SEQ ID NO: 46638 - RNA, 1341 nt, synthetic construct
  misc_feature 1..1341: note = derived and/or modified sequence opt6 from Ruplizumab_HeavyChain1
  source 1..1341: mol_type = other RNA
caagtacaactagtccaatcaggagcagaagtagtaaaaccaggagcatccgtaaaactatcatgcaaagcatcaggatatatctttacaagctattacatgtactgggtcaaacaagccccaggccaaggattagaatggataggcgaaataaacccctctaatggagacacaaacttcaatgaaaaatttaaatccaaagcaactctaaccgtagacaaaagcgcatcaacagcatatatggaattatctagcttaagatcagaagatacagccgtatactattgtacaagatcagacggaagaaacgacatggatagctggggccagggcacactcgtaacagtttcatcagcatccactaaaggcccatcagtattcccactagcacctagctctaaatcaacatcaggaggaacagcagcactcggatgtttagtcaaagactatttcccagaaccagtaacagtttcatggaattccggagccttaacttcaggagtacacacattcccagccgtattacaatcaagcggactatattcactatcttccgtagtcacagtaccatcatcatcattaggtactcaaacatacatatgcaacgtaaatcacaaacccagtaacaccaaagtagataaaaaagtagaaccaaaatcatgtgacaaaacacacacatgtcctccatgtccagctccagaactattaggaggcccatcagtatttctatttccacctaaacccaaagacacactaatgatctcaagaacacctgaagtaacatgcgtagtagtagatgtatcccacgaagatccggaagtcaaattcaattggtacgtagatggcgtagaagtacataacgccaaaacaaaaccaagagaagaacaatataattcaacctaccgagtagtcagcgtactaacagtcctacaccaagactggctcaacggaaaagaatataaatgtaaagtttcaaacaaagcattaccagcccccatagaaaaaacaatttctaaagcaaaaggacaaccaagagaacctcaagtatacacactacctccttcaagagacgaactaacaaaaaaccaagtatccctaacatgcctagttaaaggcttctacccaagcgacatcgctgtcgaatgggaatcgaacggacaaccagaaaataactacaaaaccacaccaccagtactagactccgacggatcatttttcctatattcaaaactaacagtcgacaaatcaagatggcaacaaggtaatgtattctcatgctccgtaatgcacgaagcacttcacaaccactacactcaaaaatctctatcattatcccccgga

SEQ ID NO: 46639 - RNA, 654 nt, synthetic construct
  misc_feature 1..654: note = derived and/or modified sequence opt6 from Ruplizumab_LightChain1
  source 1..654: mol_type = other RNA
gacatagtactcacacaatcaccagcaacattatcagtatcaccaggagaaagagcaacaatatcctgcagagcatcacaacgagtatcatcatcaacatactcatacatgcactggtaccaacaaaaacccggccaaccaccaaaattactaataaaatacgcatccaacctagaatccggagtaccagctagattctcaggatcaggatcaggcacagacttcacactaacaatatcctcagtagaaccagaagacttcgccacatactactgccaacactcatgggaaataccaccaacattcggaggaggaaccaaactcgaaataaaacgcacagttgcagccccatcagtatttatattcccaccatccgacgaacaactaaaatcaggaacagcatcagtagtctgcctactcaataacttctacccaagagaagcaaaagtccaatggaaagtagacaacgcactacaatcaggaaactcacaagaatcagtaacagaacaagattcaaaagattcaacatactcactatcatcaacattaacattatcaaaagcagactatgaaaaacacaaagtatacgcatgcgaagtaacacatcaaggactatcatcaccagtaacaaaatcattcaacagaggagaatgc

SEQ ID NO: 46640 - RNA, 1353 nt, synthetic construct
  misc_feature 1..1353: note = derived and/or modified sequence opt6 from Sacituzumab_govitecan_HeavyChain1
  source 1..1353: mol_type = other RNA
caagtacaactacaacaatcaggatccgaactcaaaaaaccaggcgcatcagtaaaagtatcatgtaaagcatcaggatacacatttacaaactatggcatgaactgggtaaaacaagcacccggacaaggactaaaatggatgggatggataaacacatataccggagaaccaacatacactgacgacttcaaaggaagattcgctttttcactagatacttccgtatcaacagcataccttcaaataagttcattaaaagcagacgacacagcagtatacttctgcgcaagaggcggcttcggatcttcatattggtactttgacgtctggggacaaggatcactagtaacagtatcaagtgcctcaacaaaaggaccctcagtatttccactagccccaagctctaaatcaacctcaggaggaacagcagcactaggatgtttagtaaaagactatttcccagaaccagtaaccgtatcatggaattcaggagcactaacatctggagtacacacattccctgcagtactacaatcatcaggcctatactcactatcatcagtagtaactgtcccatcatcttctctcggaacacaaacatatatatgcaatgttaaccataaaccctcaaataccaaagtagacaaaagagtagaaccaaaatcatgcgataaaacacatacatgcccaccttgcccagcccctgaactacttggaggcccttctgtattcctctttccaccaaaaccaaaagacacattaatgatatcaagaacccctgaagtaacatgtgtagtagtagacgtatcacatgaagacccagaagtaaaatttaattggtacgtcgacggagtcgaagtacacaatgctaaaacaaaaccaagagaagaacaatataactcaacatatagagtagtatcagttttaaccgtactccatcaagattggttaaatggcaaagaatacaaatgtaaagtatcaaataaagcactacctgcaccaatcgaaaaaacaatatccaaagcaaaaggacaaccaagagaaccccaagtatacacactccccccctcaagagaggaaatgacaaaaaaccaggtctccttaacatgtttagtcaaaggcttttatccatctgacattgcagtagaatgggaatccaatggacaaccagaaaacaattacaaaacaacacccccagtactagattcagatggatcatttttcctatattctaaactaacagtagataaatctagatggcaacaaggaaacgtattttcatgctctgtcatgcacgaagcactacacaaccactatacacaaaaatctctctccttatcaccaggaaaa

SEQ ID NO: 46641 - RNA, 642 nt, synthetic construct
  misc_feature 1..642: note = derived and/or modified sequence opt6 from Sacituzumab_govitecan_LightChain1
  source 1..642: mol_type = other RNA
gacatacaactcacacaatcaccatcatccctatcagcatcagtaggagacagagtatccataacatgcaaagcatcacaagacgtatccatagcagtagcatggtaccaacaaaaaccaggaaaagcaccaaaactattaatatactcagcatcatacagatacacaggagtaccagacagattttcaggatctggatcaggcacagacttcacactaacaatatcatcactacaaccagaagacttcgcagtatactactgccaacaacactacataacaccactaacattcggagcaggaacaaaagtagaaataaaaagaacagtagcagccccatcagtattcatattcccaccatcagacgaacaattaaaatcaggaacagcatctgtcgtatgcctactcaacaatttctacccaagagaagcaaaagtccaatggaaagtagacaacgcactacaatcaggaaactcacaagaatccgtaacagaacaagactcaaaagactcaacatactcactatcctcaacactaacactatcaaaagcagactacgaaaaacacaaagtatacgcatgcgaagttacacaccaaggattatcctctccagtaacaaaatcatttaacagaggcgaatgc

SEQ ID NO: 46642 - RNA, 1326 nt, synthetic construct
  misc_feature 1..1326: note = derived and/or modified sequence opt6 from Samalizumab_HeavyChain1
  source 1..1326: mol_type = other RNA
caagtccaattacaacaatcaggaagcgaactaaaaaaaccaggtgctagcgttaaaattagctgtaaagcatcaggatactccttcacagactatattatactttgggtcagacaaaatcccggaaaaggactcgaatggataggccacattgacccatattacggatcctcaaattacaacttaaaattcaaaggtcgcgtcaccatcacagcagatcaatcaacaaccacagcatatatggaactatcaagcctaagatcagaagatacagcagtctactactgtggaagaagtaaaagagattactttgactattggggacaaggaaccacattaacagtatcatcagcatcaaccaaaggtccttcagtatttccacttgcaccgtgctcacgatcaacatcagaatcaacagcagctctaggatgtctcgtaaaagattactttccagaaccagtaacagtatcatggaactcaggagcattaacaagcggagtacacacctttccagcagtactacaatcaagcggactctattcattaagctccgtagtaacagtaccatcttcaaactttggaacacaaacatatacatgcaacgtagaccataaacctagtaatacaaaagtcgataaaacagtagaaagaaaatgctgtgtagaatgccctccttgtccagccccaccagtagcaggtccaagcgtatttttattcccacccaaacccaaagatacactaatgatctcaagaactcctgaagtaacatgcgtagtagtagatgtatcacaagaagacccagaagtccaatttaactggtatgtcgatggcgtagaagtccacaatgcaaagaccaaacctagagaagaacaatttaattctacatacagagtagtctctgtattaacagtcctacatcaagactggttaaacggaaaagaatacaaatgcaaagtatcaaacaaaggattaccaagttcaatagaaaaaactatatcaaaagccaaaggccaaccaagagaaccacaagtatatacactaccaccatctcaagaagaaatgaccaaaaaccaagtatcactaacatgcttagtcaaaggattttacccctcagatatagccgtagaatgggaaagcaatggccaacccgaaaataattacaaaactactccacccgtattagactctgacggatcattttttttatattctagattaacagtagacaaaagtagatggcaagaaggaaacgttttctcatgctcagtcatgcatgaagcactacacaatcactatactcaaaaatcactatccttatcactaggc

SEQ ID NO: 46643 - RNA, 642 nt, synthetic construct
  misc_feature 1..642: note = derived and/or modified sequence opt6 from Samalizumab_LightChain1
  source 1..642: mol_type = other RNA
gacatacaaatgacacaatcaccatcatcactatcagcatcaataggagacagagtaaccataacatgcaaagcatcacaagacataaattcatacttatcatggttccaacaaaaaccaggaaaagcaccaaaattactaatataccgagcaaacagactagtagacggagtaccaagcagattttcaggatcaggatcaggaacagactacactctaacaatatcatcactacaaccagaagatttcgccgtatactattgcctacaatacgacgaattcccatacacattcggaggaggaacaaaactagaaataaaaagaacagtagcagcaccatcagtattcatattcccaccatcagacgaacaattaaaatcaggaacagcatcagtagtatgcttattaaataacttctacccaagagaagcaaaagtacaatggaaagtagacaacgcactacaatcaggaaactcacaagaatcagtaacagaacaagactcaaaagactcaacatactccctatcatcaaccctaacactatcaaaagccgactacgaaaaacacaaagtatacgcctgtgaagtaacacaccaaggactatcatcaccagtaacaaaatcattcaacagaggagaatgc

SEQ ID NO: 46644 - RNA, 1338 nt, synthetic construct
  misc_feature 1..1338: note = derived and/or modified sequence opt6 from Sarilumab_HeavyChain1
  source 1..1338: mol_type = other RNA
gaagttcaactagtagaatcaggtggaggtttagtacaaccaggccgatcactaagactatcatgcgcagcctcacgatttacttttgatgattacgccatgcattgggtacgccaagccccaggtaaaggactagaatgggtctccggtataagttggaattcaggaagaataggatacgccgactccgtaaaaggacgatttacaatctcaagagacaatgcagaaaactcattattcctacaaatgaacggtttaagagctgaagatacagccttatattattgcgcaaaaggacgagactctttcgatatatggggacaaggaacaatggtaaccgtatcatcagcatcaacaaaaggcccatcagtcttcccattagccccatcaagtaaatctacatctggtggaacagcagcattaggctgtctagtaaaagactacttccctgaacccgtaacagtatcttggaactcgggagcattaacatccggagtacacacatttcccgcagtactacaatcatcaggcttatactctctatcctcagtagtaactgtaccatcatcatcactcggaacacaaacatacatctgcaatgtaaaccataaaccatcaaatactaaggttgacaaaaaagtagaaccaaaatcatgcgacaaaacacacacatgcccaccatgtcccgccccagaactcctcggaggaccatccgtcttcttatttccaccaaaaccaaaagacacgctaatgatatcacgaacaccagaagtcacttgcgtagtagtagacgtatcccacgaagatccagaagtcaaatttaactggtacgttgatggagtagaagtacacaacgcaaaaacaaaaccacgagaagaacaatacaactcaacctaccgagtcgtaagcgttttaaccgtattacatcaagactggctaaacggtaaagaatataaatgtaaagtctccaataaagcattaccagcaccaatagaaaaaacaatcagtaaagcaaaaggccaaccaagagaaccacaagtctacacactaccaccaagcagagacgaattaacaaaaaaccaagtatcactaacatgcctagtaaaaggattttatccatcagacatagcagtagaatgggaaagtaacggccaaccagaaaataactataaaacaacaccaccagtactagactctgatggaagtttttttttatactcaaaattaacagtagacaaatcaagatggcaacaaggaaacgtattctcatgttcagtaatgcacgaagcattacacaatcattacacacaaaaatccctatcattgtcaccaggaaaa

SEQ ID NO: 46645 - RNA, 642 nt, synthetic construct
  misc_feature 1..642: note = derived and/or modified sequence opt6 from Sarilumab_LightChain1
  source 1..642: mol_type = other RNA
gacatccaaatgacacaatcaccatcttcagtaagcgcatcagtaggagacagagtaacaataacatgcagagcaagccaaggaatatcctcatggctagcatggtaccaacaaaaacccggaaaagcaccaaaactactaatatacggcgcatcatcattagaaagcggagtcccatcaagattctcaggatcaggatctggaacagacttcacactaacaataagctcactacaaccagaagactttgcatcatactactgccaacaagcaaactcattcccatacacattcggacaaggaacaaaactagaaataaaaagaacagtagcagcaccatcagtattcatattcccaccatcagacgaacaactaaaatcaggaaccgcatcagtagtatgcctactaaacaacttctacccaagagaagcaaaagtacaatggaaagtcgacaatgcattacaaagcggaaactcacaagaatcagtaaccgaacaagactcaaaagactcaacatactcattaagctcaacattaacattaagcaaagcagactacgaaaaacacaaagtatacgcatgcgaagtcacacaccaaggattatcatcaccagtaacaaaatcattcaacagaggagaatgc

SEQ ID NO: 46646 - RNA, 1296 nt, synthetic construct
  misc_feature 1..1296: note = derived and/or modified sequence opt6 from Satumomab_pendetide_HeavyChain
  source 1..1296: mol_type = other RNA
caagtacaactacaacaatcagacgcagaactagtaaaacccggcgcatcagtaaaaatatcatgcaaagcatcaggatatacatttaccgaccacgccatacactgggccaaacaaaaaccagaacaaggcctagaatggattggctacatatccccaggaaacgacgacataaaatacaacgaaaaatttaaaggcaaagcaacattaacagcagacaaaagttcaagtacagcatatatgcaattaaattcactcacatcagaagactcagcagtctatttctgtaaaagatcatactacggacactggggacaaggaacaacactaacagtctcatctgcatccacaaaaggcccatcagtattccccctcgcaccatgctcccgcagcacatcagaatctacagcagcactaggatgcttagtaaaagactactttccagaaccggtcacagtatcatggaacagtggagcactaacatcaggtgtacacacattcccagcagtactacaatcctcaggactatattcactatcatcagtagttacagtaccatcctcatcactaggaacaaaaacctacacctgcaacgtagaccacaaaccatctaatacaaaagtagacaaaagagtatgtcccccatgcaaatgccccgcccctaacttattaggcggaccatcagtcttcatattcccacccaaaataaaagacgtcttaatgatatcattatcacctatagttacatgcgtagtagtagacgtttcagaagacgacccagacgtacaaatatcctggtttgtaaacaatgtcgaagtacacacagctcaaacacaaacacatagagaagactacaacagcacactaagagtagtaagcgcattaccaatacaacaccaagactggatgtcaggaaaagaatttaaatgcaaagtaaacaataaagacttaccagcaccaatagaaagaacaatttcaaaacccaaaggtagtgtaagagcaccacaagtatatgtcctacctccaccagaagaagaaatgacaaaaaaacaagtaacactaacctgtatggtcaccgattttatgccagaagatatatatgtagaatggacaaacaacggaaaaacagaattaaactacaaaaacacagaacccgtactcgattcagacggatcatatttcatgtattcaaaactaagagtagaaaaaaaaaattgggtagaacgaaacagttactcctgctcagtagtccatgaaggactacacaatcaccacacaacaaaaagtttctccaga

SEQ ID NO: 46647 - RNA, 630 nt, synthetic construct
  misc_feature 1..630: note = derived and/or modified sequence opt6 from Satumomab_pendetide_LightChain
  source 1..630: mol_type = other RNA
gacatacaaatgacacaatcaccagcaagtttatcagtatcagtaggagaaacagtaacaataacatgcagagcatcagaaaacatatactcaaacctagcatggtaccaacaaaaacaaggaaaatcaccacaactactagtctacgcagcaacaaatctagcagacggagtaccatcaagattctccggatcaggatcaggaacacaatacagcttaaaaataaactcactacaatcagaagacttcggatcctactactgccaacacttctggggaacaccatacacattcggaggaggaacaagactagaaatcaaaagagcagacgcagcaccaacagtattcatattcccaccatcagacgaacaattaaaatcaggaacagcatcagtagtatgcctattaaacaacttctacccaagagaagcaaaagtacaatggaaagtagacaacgcattacaatcaggaaactcacaagaatcagtaacagaacaagacagcaaagactcaacctactcattatcatcaacattaacattaagcaaagccgactacgaaaaacacaaagtatacgcatgcgaagtaacacaccaaggactatcatcaccagtaacaaaatcattcaac

SEQ ID NO: 46648 - RNA, 1371 nt, synthetic construct
  misc_feature 1..1371: note = derived and/or modified sequence opt6 from Secukinumab_HeavyChain1
  source 1..1371: mol_type = other RNA
gaagtacaactagttgaatcaggcggaggcctagtacaacctggaggctcattaagattatcatgcgcagcctccggattcacatttagcaattattggatgaactgggtaagacaagcaccaggaaaaggtctagaatgggttgcagcaataaaccaagatggatcagaaaaatactacgtaggatcagtaaaaggaagattcacaataagccgagataacgcaaaaaactccctatacttacaaatgaactcactaagagtagaagatacagcagtatactactgtgtcagagattattatgacatattaacagattattatatacactactggtatttcgacctatggggaagaggaacactagtcacagtatcttcggcctctacaaaaggaccatcagtttttccacttgccccatcatcaaaatcaacaagtggcggaacagccgctttaggatgcttagtaaaagattattttccagaaccagtaacagtttcctggaactcaggagctctaacatcaggagtacacacgttcccagctgtactacaatcatcaggtttatactcattaagttccgtagtaacagtcccctcctcatcattaggaacacaaacatatatatgcaatgtaaaccataaaccatcaaacacaaaagtagacaaaagagtagaacctaaatcatgcgataaaacccacacatgtccaccttgcccagcacctgaactactaggcggaccatcagtattcctattcccacctaaaccaaaagatacattaatgatttcccgaactccagaagtaacatgcgtcgtagtagacgtttcacacgaagaccccgaagtaaaattcaattggtatgtcgatggcgtcgaagttcacaacgctaaaactaaacccagagaagaacaatataactcaacttaccgagttgtatcagtattaacagtactacaccaagactggctaaacggcaaagaatacaaatgcaaagtatctaacaaagcactccctgcaccaatagaaaaaacaatatcaaaagccaaaggacaacctagagaaccccaagtatacacactcccaccatcacgagaagaaatgacaaaaaaccaagtatctttaacttgtcttgtaaaaggattttacccatcagatatagcagtagaatgggaatctaacggacaaccagaaaacaattataaaaccacacccccagtcttagactcagacggatcattcttcttatactccaaactaacagtagacaaatcaagatggcaacaaggaaatgtattctcatgctcagtcatgcacgaagccctacacaatcactatactcaaaaatcactatcattatccccaggaaaa

SEQ ID NO: 46649 - RNA, 645 nt, synthetic construct
  misc_feature 1..645: note = derived and/or modified sequence opt6 from Secukinumab_LightChain1
  source 1..645: mol_type = other RNA
gaaatagtactaacacaaagccccggaacactatcactatcaccaggagaaagagcaacattatcatgcagagcatcacaatcagtatcatcatcatacttagcatggtaccaacaaaaaccaggacaagccccacgactactaatatacggagcatcatcaagagcaacaggtataccagacagattttcaggatcaggatctggaacagacttcacactaacaatatcaagactagaaccagaagactttgcagtatactactgccaacaatacggctcttcaccatgcacattcggacaaggaacaagattagaaataaaaagaacagtagcagcaccatcagtattcatattcccaccatccgacgaacaactaaaatccggaacagcatcagtagtatgcctactaaacaacttttacccaagagaagcaaaagtacaatggaaagtagacaacgcattacaatcaggaaactcacaagaatcagtaacagaacaagactcaaaagactcaacatactcattatcatcaacactaacactatcaaaagcagactatgaaaaacacaaagtatacgcatgcgaagtaacacaccaaggcctatcatcaccagtaacaaaatcattcaacagaggagaatgc

SEQ ID NO: 46650 - RNA, 1335 nt, synthetic construct
  misc_feature 1..1335: note = derived and/or modified sequence opt6 from Seribantumab_HeavyChain1
  source 1..1335: mol_type = other RNA
gaagtacaactattagaatcgggaggaggtttagtacaaccaggaggatcactcagattatcctgcgcagcatctggattcacattctcacactacgtaatggcatgggtacgacaagcacctggaaaaggattagaatgggtatcatcaatatcatcttcaggaggctggactctatacgcagactcagtcaaaggaagatttacaatatcaagagacaacagtaaaaacacactatacttacaaatgaattcactacgagctgaagatacagcagtatactattgtacccgaggattaaaaatggcaacaatcttcgactattggggacaaggtacactagtcacagtatcatccgcatccaccaaaggaccaagcgtctttccattagctccttgtagtcgatctacctcagaatctacagcagccttaggatgtctagtaaaagattacttccctgaacctgttacagtatcctggaattcaggcgcactcacatcaggagtacacacattccctgcagtattacaatcatcaggattatactcattatccagtgtagtcaccgtcccatcctctaattttggaacacaaacatacacatgtaacgtagatcataaacccagcaacacaaaagttgataaaacagtcgaacgaaaatgctgcgtagaatgtcctccatgtccagcaccccctgtagcaggaccatcagtattcctattccctccaaaacctaaagacacactaatgatatcaagaacaccagaagttacatgcgtagtagtagacgtctctcacgaagatccagaagtacaattcaactggtacgtcgatggagtagaagtccacaacgcaaaaacaaaaccaagagaagaacaattcaacagtaccttcagagtagtatcagtactaacagtagtacaccaagactggttaaacggtaaagaatacaaatgcaaagtctcaaataaaggactaccagcacccatagaaaaaacaatatcaaaaacaaaaggacagccaagagaaccacaagtatatacactaccaccatcaagagaagaaatgacaaaaaaccaagtttcattaacttgcctagttaaaggattttacccatcagatatagcagtcgaatgggaatcaaatggacaaccagaaaataattacaaaacaaccccaccaatgttagactcagacggatccttcttcttatacagcaaactaacagttgacaaatccagatggcaacaaggcaacgtattctcttgttccgtaatgcatgaagctttacacaatcattatacacaaaaaagtttatcactctcaccaggaaaa

SEQ ID NO: 46651 - RNA, 651 nt, synthetic construct
  misc_feature 1..651: note = derived and/or modified sequence opt6 from Seribantumab_LightChain1
  source 1..651: mol_type = other RNA
caatcagcattaacacaacccgcatcagtatcaggatcaccaggacaatcaataacaatatcatgcacaggaacatcatcagatgtaggaagctacaacgtagtatcatggtatcaacaacacccaggaaaagcaccaaaattaataatttatgaagtatcacaaagaccatcaggagtaagcaacagattctcaggatcaaaatcaggaaacacagcctcattaacaataagcggactacaaacagaagacgaagcagactactactgctgctcatacgcaggatcatcaatattcgtaatattcggaggaggaacaaaagtaacagtattaggacaaccaaaagcagcaccaagcgtaacactattcccaccatcaagtgaagaattacaagcaaacaaagcaacactagtatgcctagtatcagacttctacccaggagctgtcacagtagcatggaaagcagacggatcaccagtaaaagtcggagtagaaacaacaaaaccatcaaaacaatcaaacaacaaatacgcagcatcatcatacttatcactaacaccagaacaatggaaatcacacagatcatactcatgcagagtaacacatgaaggatccacagtagaaaaaacagtagcaccagcagaatgctca

SEQ ID NO: 46652 - RNA, 1353 nt, synthetic construct
  misc_feature 1..1353: note = derived and/or modified sequence opt6 from Setoxaximab_HeavyChain1
  source 1..1353: mol_type = other RNA
gaagtacaactacaacaaccaggacctgaattagaaaaaccaggagcatcagtcaaactctcatgcaaagcctcaggatactcatttacagactacaacatgaactgggtaaaacaaaacaacggagaatctctagaatggataggaaaaatagacccctactacggaggtccatcctacaaccaaaaatttaaagacaaagcgacattaactgtagacaaaagttcctcaacagcatatatgcaactaaaatcactaacatcagaagactcagcagtatattactgtaccagaggaggaaacagagactggtacttcgacgtatggggagcaggtacaacactaacagtaagtgcagaattcgcatctacaaaaggaccatcagtcttccccttagctccatcttcaaaatcaacatccggaggaacagcagcactcggatgtctagtaaaagactacttcccagaaccagtaacagtatcctggaattcaggagcattaacttccggcgtacacacattccctgcagtattacaatcatcaggcctatattcactatcatcagtagttaccgtaccaagctcatcactaggaacacaaacctacatatgcaacgtaaatcacaaaccatcaaatacaaaagtagacaaaaaagtagaacctaaatcatgcgacaaaacacacacatgcccaccctgtccagcaccagaactattaggaggaccatcagtatttttattcccacccaaacctaaggacactttgatgatcagtcgaacaccagaagtcacatgcgtagtagttgacgtatcacatgaagacccagaagtcaaattcaactggtacgtagatggagtagaagtacacaatgcaaaaacaaaaccacgcgaagaacaatataactcaacatacagagtagtctctgtattaacagtcttacaccaagattggctaaacggaaaagaatacaaatgcaaagtctccaacaaagcactaccagcaccaattgaaaaaacaatatctaaagctaaaggccaaccaagagaaccacaagtatatacactacctcccagtagagacgaattaacaaaaaaccaagtatcactaacatgtttagtaaaaggattttatccttcagacattgccgtagaatgggaatcaaacggtcagcccgaaaacaactataaaacaactccaccagtactagactcagacggatccttcttcttatactcaaaactaaccgtagataaatcccgttggcaacaaggcaacgtattctcctgttcagtgatgcacgaagcactacacaaccattacacacaaaaatcattatccctatcgccaggaaaa

SEQ ID NO: 46653 - RNA, 660 nt, synthetic construct
  misc_feature 1..660: note = derived and/or modified sequence opt6 from Setoxaximab_LightChain1
  source 1..660: mol_type = other RNA
gacatagtattatcacaatcaccatcatcactagtagtatcagtaggagaaaaagtaacaatgtcatgcaaatcctcacaatctttactatactcaagaaaccaaaaaaactacctagcatggtatcaacaaaaacccggacaatcaccaaaagtactaatatactgggcatcaacaagagaatcaggcgtaccagacagactaacaggatcaggatcaggaacagacttcaccctaacaatatcatcagtaaaagcagaagacctagcagtatactactgccaacaatactactcctacccattaacattcggtgcaggaacaaaactagaactaaaaagaaccgtcgcagccccatccgtattcatattcccaccatcagacgaacaactaaaatcaggcaccgcctcagtagtatgcctactaaataacttctacccacgagaagccaaagtacaatggaaagtagacaacgcactacaatcaggaaactcacaagaatcagtaaccgaacaagactccaaagattcaacatactcactatcatcaacactaacattatcaaaagccgactacgaaaaacataaagtatacgcatgcgaagtaacacaccaaggactatcctcaccagtaacaaaatcattcaacagaggagaatgc

SEQ ID NO: 46654 - RNA, 1338 nt, synthetic construct
  misc_feature 1..1338: note = derived and/or modified sequence opt6 from Sifalimumab_HeavyChain1
  source 1..1338: mol_type = other RNA
caagtacaattagtacaatcaggagcagaagtaaaaaaaccgggagcatctgtaaaagtatcatgcaaagcatcaggatacaccttcactagctattcaataagctgggttagacaagcaccaggacaaggacttgaatggatgggatggatatcagtctataacggcaacacaaactatgcacaaaaattccaaggacgagtaacaatgaccacagacacaagcacatcaaccgcatatctcgaactacgctcattaagatcagacgacacagcggtatactattgcgcaagagacccaattgctgcaggatactggggacaaggaacattagtaacagtatcatcagcatccaccaaaggaccaagcgtatttccattagctccatcctccaaatcaacctctggaggaacagcagccctaggatgtctagtaaaagactacttcccagaaccagtcacagtatcatggaattcaggagcattaacttccggagtccacacattcccagcagtactacaatcctcaggactatactcactaagttcggtagtaacagtaccatcatcatcattaggtactcaaacatacatatgcaacgtaaatcacaaaccatcaaacacaaaagtagataaaaaagtagaacctaaatcatgcgacaaaacccatacatgtccaccatgcccagcaccagaactacttggaggaccatcagtttttctattcccaccaaaaccaaaagatacattaatgatcagtaggacaccagaagtaacatgcgtagtagtagatgtttcacacgaagacccagaagtaaaatttaactggtatgtagacggagtcgaagtacataacgcaaaaacaaaacccagagaagaacaatacaattcaacttaccgagttgttagcgtattaacagtactccaccaagattggctaaacggaaaagaatataaatgtaaagtatcaaacaaagctctaccagctccaatagaaaaaactatatcaaaagcaaaaggacaaccaagagaaccacaagtatacacactcccaccctcaagagaagaaatgaccaaaaatcaagtaagtttaacatgtctagtaaaaggattttacccatccgatatagcagtagaatgggaatcaaatgggcaacctgaaaacaattacaaaaccacacctccagtacttgactccgatggttccttcttcttatacagcaaactaactgttgataaatcaagatggcaacaaggcaatgtcttttcatgtagtgttatgcacgaagcattacacaaccactatactcaaaaatcattatcattaagcccaggaaaa

SEQ ID NO: 46655 - RNA, 645 nt, synthetic construct
  misc_feature 1..645: note = derived and/or modified sequence opt6 from Sifalimumab_LightChain1
  source 1..645: mol_type = other RNA
gaaatagtactaacacaatcaccaggaacactatcactatcacccggagaaagagcaacattatcttgcagagcatcacaatcagtatcatcaacatacctagcctggtaccaacaaaaaccaggacaagcaccaagactactaatttacggagcatcatcaagagcaacaggaataccagacagattctcaggatctggatcaggaacagacttcacactaacaatatcaagactagaaccagaagacttcgctgtatactattgccaacaatatggatcctcaccaagaacattcggacaaggaacaaaagtagaaataaaaagaacagtagctgcaccatcagtatttatattccccccatcagacgaacaattaaaatcaggaactgcttcagtagtctgcttactaaacaacttctacccacgagaagcaaaagtccaatggaaagtagacaacgcactacaatcaggtaattcacaagaatcagtaacagaacaagactctaaagactcaacatactcattatcctcaacactaacactaagcaaagccgactacgaaaaacacaaagtatacgcttgtgaagtcacacaccaaggattatcatcaccagtaacaaaatcatttaatagaggcgaatgc

SEQ ID NO: 46656 - RNA, 1347 nt, synthetic construct
  misc_feature 1..1347: note = derived and/or modified sequence opt6 from Siltuximab_HeavyChain1
  source 1..1347: mol_type = other RNA
gaagtccaactagtagaatcaggaggaaaactactaaaaccaggaggatcattaaaattatcatgcgcagcatcaggcttcacattctcatcattcgcaatgagctggtttagacaatcaccagaaaaaagacttgaatgggtagcagaaatctcatccggaggcagctatacctactaccctgatacagtaacaggaagatttacaatctcaagagacaacgcaaaaaacacattatacctagaaatgtcatcacttagatcagaagacaccgctatgtactactgcgcaagaggtttatggggctattacgcactcgactactggggccaaggaacatcagtcacagtatcatccgcatcaacaaaaggcccatcagtattccctctagccccctcatcaaaatcaacctcaggcggaaccgcagcattaggatgcttagtaaaagactattttccagaaccagtcacagtatcctggaactcaggagctcttacatcaggagtccacacttttccagcagtactacaatcatcaggactatactctctatcatcagttgtaacagtaccatcatcatcattaggcacacaaacttacatatgcaatgttaaccacaaaccatcaaatacaaaagtagacaaaaaagtagaaccaaaatcatgtgacaaaacccacacatgcccaccatgcccagccccagaattacttggaggaccatcagtcttcttatttccaccaaaaccaaaagacacactaatgatctcaagaacaccagaagtcacctgcgtagtagtagacgtatcacacgaagatcctgaagtcaaattcaactggtatgtagacggagtcgaagtacataacgcaaaaacaaaaccaagagaagaacaatacaattcaacatacagagtagtaagtgtcttaacagtcctacatcaagattggcttaatggaaaagaatataaatgcaaagtatccaataaagcactcccagcaccaatagaaaaaacaataagtaaagccaaaggtcaaccaagagaaccacaagtttacacattaccaccttcacgagatgaattaactaaaaaccaagtaagcctaacatgtctagtaaaagggttttacccatcagacatagcagtagaatgggaatcaaatggacaaccagaaaacaattataaaaccacaccaccagttttagactcagacggatcattcttcctatactcaaaattaacagtcgacaaatcaagatggcaacaaggcaatgtattctcatgctcagtaatgcacgaagccctacataaccattatacacaaaaatccctgtcactttccccaggaaaa

SEQ ID NO: 46657 - RNA, 639 nt, synthetic construct
  misc_feature 1..639: note = derived and/or modified sequence opt6 from Siltuximab_LightChain1
  source 1..639: mol_type = other RNA
caaatcgtattaatacaatcaccagcaataatgtcagcatcaccaggagaaaaagtaacaatgacatgctcagcctcctcctcagtatcctacatgtactggtaccaacaaaaaccaggatcatcaccaagactactaatatacgacacatcaaatctagcatcaggagtcccagtaagattttcaggatcaggatcaggaacatcctactcactaacaatatcaagaatggaagcagaagacgcagcaacatactactgccaacaatggtcaggatatccatacacattcggaggcggaacaaaactagaaataaaaagaacagtagcagcaccatcagtatttatattcccaccatcagatgaacaactaaaatcaggaacagcatcagtagtatgcctactaaacaacttctacccaagagaagcaaaagtacaatggaaagtagacaacgcactacaatcaggaaactcacaagaatcagtaacagaacaagattcaaaagactcaacatactcactatcatccacactaacactatcaaaagcagactacgaaaaacacaaagtatacgcatgtgaagtcacacatcaaggtctatcatcaccagtaacaaaatcattcaaccgcggagaatgc

SEQ ID NO: 46658 - RNA, 1329 nt, synthetic construct
  misc_feature 1..1329: note = derived and/or modified sequence opt6 from Simtuzumab_HeavyChain1
  source 1..1329: mol_type = other RNA
caagtacaattagtccaaagtggcgccgaagttaagaaaccaggagcaagcgtaaaagtatcatgcaaagccagcggctacgcattcacatactacctaatagaatgggtcagacaagcaccaggacaaggattagaatggataggagtaataaaccctggatcaggaggcacaaactacaacgaaaaattcaaagggagagcaacaataactgcagacaaaagtacaagcacagcttatatggaactatcttcactaagatcagaagacacagcagtatacttctgcgcaagaaattggatgaacttcgactactggggacaaggaacaacagtaacagtctcctcagcctcaacaaaaggaccatcagtattccctttagccccatgctcaagatcaacatcagaaagtacagcagcattaggatgcttagtcaaagactactttccagaaccagtaacagtatcatggaactcaggtgcacttacaagcggcgtacatacttttccagcagtattacaaagctcaggcctctactcactcagcagtgtagtaaccgtaccatcatcatcactaggtacaaaaacatacacatgcaacgtcgatcataaaccatctaacaccaaagtagacaaaagagtagaatcaaaatacggaccaccatgcccaccctgcccagcaccagaattcctaggtggaccctcagtattcttattcccacctaaacctaaagacacattaatgatatcaagaacaccagaagtcacatgcgtagtcgtagacgtatcacaagaagacccagaagtacaattcaactggtacgttgacggagtagaagtgcacaatgcaaaaactaaaccaagagaagaacaattcaatagtacataccgagtagtcagtgttttaacagtactacaccaagactggttaaacggaaaagaatataaatgcaaagtctcaaacaaaggcttaccatcaagcatagaaaaaacaatatcaaaagcaaaaggacaaccaagagaaccacaagtatacacactaccaccatcacaagaagaaatgacaaaaaaccaagtttcattaacatgtctagtaaaaggattttaccctagcgacatagcagtagaatgggaatcaaacggacaaccagaaaataactacaaaacaacaccaccagtactagattctgacggctcatttttcttatattcaagactaacagtagacaaaagcagatggcaagaaggaaatgtattttcatgctcagtcatgcatgaagcactccacaatcactatacacaaaaatcactatcactatcattaggaaaa

SEQ ID NO: 46659 - RNA, 657 nt, synthetic construct
  misc_feature 1..657: note = derived and/or modified sequence opt6 from Simtuzumab_LightChain1
  source 1..657: mol_type = other RNA
gacatagtaatgacacaaaccccattatcactatccgtaacaccaggacaaccagcttcaatatcatgtagatcatctaaatcactactacattcaaacggaaacacatacctatactggttcttacaaaaaccaggacaatcaccacaattcctaatatacagaatgtcaaacttagcatcaggagtcccagacagattctccggctctggatcaggaacagactttacactaaaaatatccagagtagaagcagaagacgtaggagtatactattgtatgcaacacttagaatacccatacacattcggaggagggacaaaagtagaaataaaaagaacagtagcagccccatccgtattcatcttcccaccctcagacgaacaactaaaatcaggaacagcctcagtagtatgcctattaaataacttttacccacgagaagcaaaagtacaatggaaagtagacaacgctctacaatcaggaaactcacaagaatcagtaacagaacaagattcaaaagactcaacatactcactaagctcaaccttaacactatcaaaagcagactacgaaaaacacaaagtatacgcatgcgaagtaacacaccaaggactatcatcaccagtaacaaaatcattcaacagaggagaatgc

SEQ ID NO: 46660 - RNA, 1347 nt, synthetic construct
  misc_feature 1..1347: note = derived and/or modified sequence opt6 from Sirukumab_HeavyChain1
  source 1..1347: mol_type = other RNA
gaagtacaattagtcgaatcaggaggaggacttgtacaaccaggcggcagtttaagattatcatgcgccgcaagcggatttacattttcaccattcgccatgtcatgggttcgacaagcacccggcaaaggattagaatgggtagcaaaaatatctccaggaggatcttggacatactattctgacaccgtaacaggacgttttaccatatcacgagacaacgcaaaaaattcattatacctacaaatgaacagcttaagggcagaagacacagcagtgtattattgcgcaagacaattatggggatattacgccttagatatatggggacaaggaacaacagtaacagtatcatcagcatcaactaaaggtcctagtgtcttcccattagcaccatcatccaaatcaacatctggcggaacagcagctttaggctgcctagtcaaagattacttccctgaaccagtcacagtctcatggaacagcggagcacttacatctggagttcacacattcccagcagttttacaatcttcaggactatactcattatcatcagttgtaacagtaccctcaagttcattaggtactcaaacttacatatgcaatgtaaatcataaaccatctaacacaaaagtagacaaaaaagtagaacccaaatcttgcgataaaacacacacatgcccaccatgtccagcacccgaattattaggaggaccatcagtatttcttttcccaccaaaacccaaagacacacttatgatatcaagaacacctgaagtaacatgtgtagttgtagatgtatcacacgaagaccccgaagtaaaattcaactggtacgtcgacggtgtagaagtacataatgcaaaaacaaaaccaagagaagaacaatacaactctacctacagagtggtatctgttctaactgtacttcaccaagattggctaaatggaaaagaatacaaatgcaaagtctcaaataaagcattacccgcaccaattgaaaaaacaatatccaaagcaaaaggtcaaccaagagaaccacaagtatatacattaccaccctcacgagacgaactcacaaaaaaccaagtatctcttacatgcctagtaaaaggattttacccatcagacatagcagtagaatgggaatccaacggacaaccagaaaacaattacaaaacaactcctccagttttagactcagacggttcattcttcctctattctaaactaacagttgataaatccagatggcaacaaggaaacgtcttttcctgttctgtcatgcatgaagcactacacaaccactacacacaaaaatcattatcattatcaccaggaaaa

SEQ ID NO: 46661 - RNA, 639 nt, synthetic construct
  misc_feature 1..639: note = derived and/or modified sequence opt6 from Sirukumab_LightChain1
  source 1..639: mol_type = other RNA
gaaatagtactaacacaatcaccagcaacattatcactatcaccaggagaaagagcaacactatcatgctcagcatcaatatcagtatcatacatgtactggtaccaacaaaaaccaggacaagccccaagactattaatatacgatatgagcaacctagcatcaggcataccagcaagattctcaggatcaggatcaggaacagacttcacattaacaatatcatcattagaaccagaagatttcgcagtctactactgcatgcaatggagcggctacccatacacattcggaggaggaacaaaagtagaaataaaaagaacagtagcagcaccatcagtattcatattcccaccatcagacgaacaactaaaatcaggaacagcatcagtagtatgcctactaaacaacttttacccaagagaagcaaaagtacaatggaaagtagacaacgcacttcaatcaggcaactcacaagaatcagtaacagaacaagactcaaaagactcaacatacagcttatcatcaacattaaccttatcaaaagcagactatgaaaaacataaagtatacgcatgcgaagtaacacaccaaggactaagctcaccagtaacaaaaagcttcaacagaggagaatgc

SEQ ID NO: 46662 - RNA, 1338 nt, synthetic construct
  misc_feature 1..1338: note = derived and/or modified sequence opt6 from Sofituzumab_vedotin_HeavyChain1
  source 1..1338: mol_type = other RNA
gaagtacaattagtagaatctggtggaggcttagtacaaccaggaggtagcttacgattatcatgcgcagcctcaggatacagtataacaaatgattacgcttggaactgggttagacaagcaccaggtaaaggattagaatgggtaggctacatatcatattcaggctacacaacatataacccatcacttaaatctagattcaccatatcaagagatacttccaaaaacacactatacctacaaatgaactcattacgagcagaagacacagcagtatactactgcgcaagatggacctcaggcttagactattggggtcaaggaaccttggtaacagtatcatcagcatcaactaaaggcccatctgtattccctctagcaccatcatcaaaaagtacatcaggcggaaccgcagcactaggatgccttgtcaaagactactttccagaacccgtaacagtatcctggaactcaggcgcactaacatcaggagtacacacatttccagcagtactacaatcatcaggtctatactcactatcctctgtagtaacagttccatcatcctcactcggaacacaaacatacatatgcaacgtaaaccacaaaccatcaaacacaaaagtcgacaaaaaagtcgaacccaaatcatgcgacaaaacccatacctgtcccccatgccccgcaccagaacttctaggaggcccctcagtattcctattcccaccaaaaccaaaagatacacttatgatatcacgaaccccagaagtaacatgtgtagtagtagacgtctctcacgaagacccagaagtcaaatttaactggtacgtagacggagtagaagtacacaacgcaaaaacaaaaccaagagaagaacaatacaattcaacttacagagtcgtatcagtcctaactgtactacaccaagactggttaaacggaaaagaatataaatgcaaagtatcaaacaaagcattacccgcacccatagaaaaaaccatttccaaagcaaaaggtcaaccaagagaaccacaagtatacacactcccaccttcccgcgaagaaatgactaaaaaccaagtatcactaacctgtctagttaaaggattctacccttccgacattgcagtagaatgggaatctaacggccaacccgaaaacaactacaaaacaacacctcccgtactagattcagatggatcattcttcttatactcaaaattaacagtagataaatccagatggcaacaaggaaacgtcttctcatgctctgttatgcacgaagcactacataaccattacacccaaaaatctttatcattatccccaggaaaa

SEQ ID NO: 46663 - RNA, 642 nt, synthetic construct
  misc_feature 1..642: note = derived and/or modified sequence opt6 from Sofituzumab_vedotin_LightChain1
  source 1..642: mol_type = other RNA
gacatacaaatgacacaatcaccatcatcattatcagcatcagtaggagacagagtaacaataacctgcaaagcatcagacctaatacacaactggctagcatggtaccaacaaaaaccaggaaaagcaccaaaattactaatatacggagcaacatcactagaaacaggagtaccatcaagattctcaggatcaggatcaggaacagacttcacattaaccataagctcactacaaccagaagacttcgcaacatactattgccaacaatactggacaaccccattcacattcggacaaggaacaaaagtagaaataaaaagaacagtagcagcaccatcagtattcatattcccaccatcagacgaacaactaaaatcaggaacagcatcagtagtatgcctactcaacaacttctacccaagagaagcaaaagtacaatggaaagtagacaacgcactacaatcaggaaactcacaagaatcagtaacagaacaagactcaaaagactcaacatactcattatcatcaacactaacactatcaaaagcagactacgaaaaacacaaagtatacgcatgtgaagtaacacaccaaggattaagctcaccagtaacaaaatcatttaacagaggagaatgc

SEQ ID NO: 46664 - RNA, 1323 nt, synthetic construct
  misc_feature 1..1323: note = derived and/or modified sequence opt6 from Solanezumab_HeavyChain1
  source 1..1323: mol_type = other RNA
gaagtacaattagtagaatcaggcggaggactagtacaaccaggcggatccctaagactatcatgcgcagcatccggattcacattcagcagatactcaatgtcttgggttcgacaagctccaggaaaaggcctcgaattagtagcacaaataaattcagtaggaaattccacatactaccctgatactgtcaaaggaagattcacaataagtcgagacaacgccaaaaacactctatacctacaaatgaattcactcagagctgaagacacagcagtctactactgcgcatctggagactactggggacaaggaacactagttacagtctcatcagcatccacaaaaggaccatctgtattcccactagcaccatcatcaaaatcaacatcaggcggcaccgcagcactaggatgtctcgtaaaagattacttccccgaacccgtgacagtcagctggaattcaggagcactaacaagtggtgtccacacattccccgctgtactccaatcctcaggattatattcactatcttcagtcgtaaccgtcccatcatcatcccttggaacacaaacatacatttgcaacgtaaatcataaaccatcaaacaccaaagtagacaaaaaagtagaaccaaaatcatgtgataaaacacatacatgtccaccatgcccagcaccagaattacttggaggcccatccgtatttctattcccccctaaaccaaaagatacactaatgatatccagaacacctgaagtaacatgtgtagtagtagacgtatctcacgaagaccccgaagtcaaattcaattggtatgttgacggagtagaagttcacaacgccaaaacaaaaccaagagaagaacaatacaactcaacatacagagtcgtatcagtattaacagtactccaccaagactggctcaacggaaaagaatacaaatgcaaagtatcaaacaaagcactacctgcacctatagaaaaaactatctcaaaagcaaaaggacaaccaagagaaccacaagtttacacactaccaccatcaagagacgaattaacaaaaaaccaagtatcactaacatgcctagtaaaaggattttacccatcagatattgcagttgaatgggaatccaacggacaaccagaaaataactacaaaactactcctccagtcctagattcagacggatccttctttctctactcgaaactcaccgtagacaaatcccgatggcaacaaggcaatgtattctcatgttcagtcatgcatgaagcactacacaaccattacacacaaaaatcactatccctcagccccgga

SEQ ID NO: 46665 - RNA, 1326 nt, synthetic construct
  misc_feature 1..1326: note = derived and/or modified sequence opt6 from Solanezumab_HeavyChain
  source 1..1326: mol_type = other RNA
gaagtacaattagtcgaatcaggaggaggattagtccaaccaggaggatctctaagattatcctgtgcagcctcgggattcacattttcacgatattctatgagctgggtacgacaagcacccggaaaaggactggaattagtcgcacaaatcaactccgtcggaaatagcacatactatccagatacagtaaaaggtagattcacaatatcaagagacaatgcaaaaaacactctataccttcaaatgaatagcttaagagccgaagacacagcagtatattactgcgcatcaggagactactggggacaaggaacactcgtaacagtatcatcagcctccacaaaaggccccagcgttttccccttagcaccatcaagtaaatcaactagcggaggcaccgctgctttaggatgcctagtcaaagactacttccccgaaccagtaactgtatcatggaattcaggagcactaacatcaggagtacatacattccccgcagtactacaatcttccggattatactcattatcaagcgtagtaactgtaccatcatcctcattaggaacacaaacatacatatgtaatgtaaaccataaaccatctaacaccaaagtcgacaaaaaagtagaaccaaaatcatgtgacaaaacacacacatgccccccatgtccagcaccagaactattaggaggaccatctgtatttctatttccaccaaaaccaaaagatacactaatgatatcaagaactcctgaagtaacatgtgtagtcgtagatgtatcacatgaagaccctgaagtaaaatttaactggtacgtagatggagtagaagtacataacgcaaaaacaaaaccaagagaagaacaatacaactcaacttacagagttgtatccgttctaacagtcttacaccaagactggctaaacggtaaggaatataaatgcaaagtatcaaacaaagctctaccagcaccaatcgaaaaaacaatatcaaaagcaaaaggacaaccaagagaaccccaagtctataccttaccaccaagcagagatgaactcactaaaaatcaagtatccttaacatgtttagtaaaaggattctacccctccgacatagcagttgaatgggaaagtaacggacaacccgaaaataactacaaaaccacaccaccagtcttagattcagacggatcattcttcctatattcaaaactaacagtagacaaaagcagatggcaacaaggaaatgtattctcatgttctgtaatgcatgaagcactacataaccattacactcaaaaatcattaagcctatcaccaggtaaa

SEQ ID NO: 46666 - RNA, 657 nt, synthetic construct
  misc_feature 1..657: note = derived and/or modified sequence opt6 from Solanezumab_LightChain1
  source 1..657: mol_type = other RNA
gacgtagtaatgacacaaagccccctctcactaccagtcacactaggacaaccagcatcaatatcatgcagaagttcacaatcattaatatactcagacggaaacgcatacttacactggttcttacaaaaaccaggacaatcaccaagactactaatatacaaagtatcaaacagattctcaggagtaccagacagattttcaggctcaggatcaggaacagatttcacactaaaaatatcaagagtagaagccgaagatgtaggagtatactactgctcacaatcaacacacgtaccatggacattcggacaaggaaccaaagtagaaataaaaagaacagtagcagcaccatcagtattcatattcccaccatcagatgaacaactaaaatcaggaaccgcatcagtagtatgcctattaaacaacttctacccaagagaagcaaaagtacaatggaaagtagacaatgcactacaatccggcaactcccaagaatcagtaacagaacaagacagcaaagactcaacatattcactatcatcaacattaacactatcaaaagcagactacgaaaaacacaaagtatatgcatgcgaagtaacacatcaaggactatcatcaccagtaacaaaatcattcaacagaggagaatgc

SEQ ID NO: 46667 - RNA, 1506 nt, synthetic construct
  misc_feature 1..1506: note = derived and/or modified sequence opt6 from Solitomab_HeavyChain1
  source 1..1506: mol_type = other RNA
gaattagtaatgacacaaagtccttcatcattaacagtaacagctggtgaaaaagtaactatgtcatgtaaaagctcacaaagtttattaaactcaggaaatcaaaaaaattatttaacatggtatcaacaaaaacctggacaaccacccaaattactaatatattgggcctcaactagagaatcaggggtaccagatcgctttactggatcaggatcaggaacagattttactttaacaatatcatcagtccaagccgaagatttagcagtatattattgtcaaaatgattacagttatccactcacatttggagctggaacaaaactagaaattaaaggaggtggcggatctggaggaggtggatcaggtggaggaggtagtgaagtacaattattagaacaatcaggagctgaattagtacgaccaggtacaagcgtcaaaatttcatgcaaagcaagtggttacgcattcacaaactattggctagggtgggtaaaacaaagaccgggtcacggattagaatggataggtgacatatttccaggatccggaaacattcattacaacgaaaagtttaaaggaaaagcaacattaacagcagacaaaagtagcagcactgcttatatgcaattaagtagtctaacattcgaagacagcgcagtatatttttgtgcaagattacgaaattgggatgaaccaatggattattggggacaaggaacaaccgtaacagtatcctcaggaggaggaggatcagatgttcaattagtacaatcaggagcagaagtaaaaaaaccaggagcaagtgtaaaagtatcatgtaaagcttcaggatacacttttacaagatacacaatgcactgggtaagacaagcacctggacaaggacttgaatggataggttacataaatccctcaagaggttatacaaattatgcagattcagttaaaggaaggtttacaatcacaacggataaaagtacaagtacagcttatatggaacttagttcattaagaagtgaagatacagcaacatattactgtgcacgatactatgatgatcattactgtttggactattggggacaaggtacaacagtaaccgtaagtagtggcgaaggaacatctaccggaagtggaggaagcggcggttcaggtggagctgatgacatagtattaacacaaagtcctgctacactaagtctaagtccaggtgaaagagcaacattatcatgtagagcatcacaaagcgttagctacatgaactggtatcaacaaaaacctggaaaagcaccaaaaagatggatttacgatacaagcaaagtagcatcaggagtacctgcaagattttcaggatctggatcaggaacagattattccctcactataaattcattagaagcggaagatgctgcaacatattattgtcaacaatggtcaagcaatccattaacatttggaggcggaacaaaagtagaaataaaacatcatcatcatcatcac

SEQ ID NO: 46668 - RNA, 1506 nt, synthetic construct
  misc_feature 1..1506: note = derived and/or modified sequence opt6 from Solitomab_SingleChain
  source 1..1506: mol_type = other RNA
gaactagtaatgactcaaagcccatcatcactaacagtcacggcaggagaaaaagttacaatgtcatgtaaatctagtcaatcactactaaacagtggaaatcaaaagaattatctaacatggtatcaacaaaaaccaggccaacctcctaaattattaatatactgggcaagcactagagaatctggtgtaccagatagatttacaggatcaggaagcggaactgatttcacattaacaataagctcagtacaagcagaagacttagcagtatattattgtcaaaatgattattcatatccattaacatttggagccggaacaaaactagaaataaaaggcggaggtggatcaggaggaggaggatcaggaggtggaggatcagaagttcaactattagaacagagcggagcagaattagtaaggcccggaacaagtgtaaaaatatcatgtaaagcttctggttatgcatttacaaattactggttaggatgggtaaaacagagaccaggccacggattagaatggataggagatatattccctggatcaggtaatatacattacaatgaaaaatttaaaggaaaagcaacattaaccgcagataaaagtagcagtacagcatatatgcaattatcatcattaacattcgaagatagcgcagtatatttttgtgcaaggttaagaaattgggacgaaccaatggattactggggacaaggtaccacagtaacagtatcatcaggaggaggtggaagcgatgttcaactagtacaatcaggagcagaagtaaaaaaaccaggtgccagtgtaaaagtatcatgtaaagccagtggatatacatttacaagatatactatgcattgggtaagacaagcaccaggtcaaggacttgaatggataggatatataaatccaagtcgaggatatacaaactatgcggatagcgttaaaggaagatttacgataacaacagacaaaagtacttcaacagcttatatggaattatcaagtttaagaagcgaagatacagcaacttactattgcgccagatattacgacgatcattattgtctagattattggggccaaggtacaacagtaacagtatcatcaggagaaggtacctctactggttcaggaggatcaggaggctcaggaggggcagatgatattgtattaactcaatcaccagctacattatcactttccccaggagaacgagccacactatcatgtagagctagccaatcagtatcatatatgaactggtatcaacaaaaacctggaaaagctccaaaaagatggatatacgatacttccaaagtcgcaagtggcgtgccagcaagattcagtggatcaggaagcggaacagattactcactaacgataaatagtctagaagcagaagatgcggcaacctattactgtcaacaatggagcagtaacccattaacatttggaggaggaacaaaagttgaaataaagcatcatcatcatcatcat

SEQ ID NO: 46669 - RNA, 702 nt, synthetic construct
  misc_feature 1..702: note = derived and/or modified sequence opt6 from Sonepcizumab_LightChain_Precursor
  source 1..702: mol_type = other RNA
atgtcagtaccaacacaagtactaggattactactactatggttaacagacgcaagatgcgaaactacagtaacacaatcaccatccttcttatccgcatctgtaggagacagagtaacaataacatgcataacaacaacagatatagacgacgacatgaactggttccaacaagaacccggaaaagcaccaaaactattaatatctgaaggaaacatactaagaccaggagtcccatcaagattctcatcatcaggatacggaacagacttcacactaacaatatcaaaactacaaccagaagacttcgcaacatattactgcctacaatcagacaacctcccattcacattcggacaaggaacaaaattagaaataaaaagaacagtagcagcaccatcagtattcatattcccaccttcagacgaacaattaaaatcaggaacagcatcagtagtctgcctcctaaacaatttctacccaagagaagcaaaagtacaatggaaagtagacaatgcattacaatcaggaaactcacaagaatcagtaaccgaacaagattcaaaagactcaacatactcattaagctcaactctaacattaagcaaagcagactacgaaaaacacaaagtatacgcatgcgaagtaacacatcaaggactatcatcaccagtaacaaaatccttcaaccgcggagaatgc

SEQ ID NO: 46670 - RNA, 1365 nt, synthetic construct
  misc_feature 1..1365: note = derived and/or modified sequence opt6 from Sonepcizumab_gamma1-Chain_Precursor
  source 1..1365: mol_type = other RNA
atggaatggtcatgggtattcctcttctttctatcagtaaccacaggcgtccactcagaagtacaactagtccaatcaggtgcagaagtcaaaaaaccaggagaatccttaaaaatatcatgccaaagcttcggttacatattcatagaccacacaatccactggatgagacaaatgccaggacaaggcctagaatggatgggagcaataagtccacgacatgacataacaaaatataatgaaatgttcagaggacaagtaacaatatcagcagataaatcttcatcaactgcatatttacaatggtcctctctaaaagcatccgacaccgccatgtacttctgcgcaagaggaggattctatggatcaacaatatggttcgatttttggggacaaggaacaatggtaacagtatcatccgcatccacaaaaggaccaagtgttttccccttagccccatcttcaaaatcaacaagcggaggaacagccgcattaggatgcttagttaaagactacttcccagaaccagtaacagtatcatggaacagtggagcattaacatcaggagtacacaccttcccagctgttctacaatcctcaggattatactcactttcatctgtagtaacagtaccatcaagctccttaggaacacaaacatacatctgtaatgtaaaccataaaccttcaaacacaaaagttgacaaaagagtcgcccccgaattactcggtggaccctctgtattcctttttccaccgaaacctaaagacaccttaatgatatctagaaccccagaagtaacatgcgtagtagtagatgtatcccatgaagacccagaagtaaagttcaactggtacgtagacggagtagaagtacacaacgcaaaaaccaaacccagagaagaacaatacaactccacttatcgcgtagtatcagtcctaacagtattacaccaagattggctaaatggaaaagaatataaatgcaaagtatcaaacaaagccctacccgcaccaatagaaaaaacaatctctaaagcaaaaggacaaccacgagaaccacaagtatacacactcccaccatcaagagaagaaatgactaaaaaccaagtatccctaacatgtttagtaaaaggattttatccctcagatatagccgtcgaatgggaatctaacggtcaaccagaaaacaactacaaaacaacacctccagtactagactccgatggatcatttttcttatactcaaaactaacagtagacaaaagcagatggcaacaaggaaatgtattctcttgttccgtcatgcatgaagccctacacaaccattatacacaaaaatctctatcactttcacccggaaaa

SEQ ID NO: 46671 - RNA, 1338 nt, synthetic construct
  misc_feature 1..1338: note = derived and/or modified sequence opt6 from Stamulumab_HeavyChain1
  source 1..1338: mol_type = other RNA
gtacaattagtacaatctggagctgaagtaaaaaaaccaggagcatcagtaaaagtatcatgcaaagcatcaggttatacattcacatcctactacatgcactgggtaagacaagcaccaggtcaaggactagaatggatgggaataataaatccatcaggaggatctacatcctatgcacaaaaattccaaggacgagttacaatgaccagagatacttccacatcaacagtatacatggaactttcatcactacgctcagaagatacagccgtatactactgtgcaagagatgaaaactggggattcgatccatggggacaaggaacattagtaacagtatcatcagcaagcacaaaaggcccatcagtttttcccttggcaccatcatcaaagagtacctcaggcggtacagcagctctaggctgcctagtaaaagactacttcccagaacccgtaacagtttcatggaattcaggagcactaacatctggtgtacatacattcccagcagtattacaatccagcggattatactcactaagctccgtcgtaactgtaccatcaagctcactaggaacacaaacctatatatgcaacgtaaaccataaaccatctaatacaaaagtagataaaaaagtagagccaaaatcttgtgacaaaacccacacatgccctccatgcccagcaccagaattacttggcggaccttcagtatttctattcccaccaaaaccaaaagacacactcatgatctctagaacaccagaagtaacatgcgtagtagtagacgtatcacacgaagacccagaagtaaaatttaactggtacgtagacggagtagaagtacataacgcaaaaaccaaaccaagagaagaacaatacaactccacatacagagttgtctcagtattaacagtactacatcaagactggctaaacggaaaagaatataaatgcaaagtaagtaacaaagcattaccagcaccaatagaaaaaaccatatcaaaagcaaaaggtcaacccagagaaccccaagtctacacacttccaccatccagagaagaaatgacaaaaaaccaagtttccttaacatgcttagtaaaaggattctatccatcagacatcgccgtagaatgggaatcaaacggacaacctgaaaacaactacaaaacaacccccccagtactagactcagacggatccttcttcctatactcaaaactaactgttgataaatcacgctggcaacaaggaaatgtcttttcttgctcagtaatgcatgaagcacttcacaaccactacacccaaaaatcactatcattatcacccggaaaa

SEQ ID NO: 46672 - RNA, 633 nt, synthetic construct
  misc_feature 1..633: note = derived and/or modified sequence opt6 from Stamulumab_LightChain1
  source 1..633: mol_type = other RNA
tcatacgaattaacacaacctccatcagtatcagtatcaccaggacaaacagcatcaataacatgttcaggacacgcactaggagacaaattcgtatcatggtaccaacaaaaacccggacaatcaccagttctagtaatatacgacgacacacaaagaccatcaggcataccagaaagattctcaggatcaaactcaggaaacacagcaacactcacaatatcaggaacacaagcaatggacgaagcagactactactgccaagcatgggactcatcatttgtattcggtggaggaacaaaagtaacagtactaggacaaccaaaagcagcaccatccgtaacactattcccaccaagctcagaagaactacaagcaaacaaagcaacactagtatgcctaatatcagacttctacccaggagcagtaacagtcgcatggaaagcagactcatcaccagtaaaagcaggagtagaaacaacaacaccatcaaaacaatcaaacaacaaatacgcagcatcatcatacctatcattaacacctgaacaatggaaatcacacagatcctactcatgccaagtaacacacgaaggatcaacagtagaaaaaacagtagcaccaacagaatgctca

SEQ ID NO: 46673 - RNA, 1356 nt, synthetic construct
  misc_feature 1..1356: note = derived and/or modified sequence opt6 from Suptavumab_HeavyChain1
  source 1..1356: mol_type = other RNA
gaagtacaattagtcgaatctggaggagatttagttcaaccaggaagatccttaagattatcatgcgtcgccagcggattcacatttgacgactacgccatgcactgggtaagacaagcacctggaaaaggactcgaatgggtatcaggagtatcctggagtggctccaccgtcggctacgcagattcagtaaaaggaagatttacagtatcaagagacaatgctcaaaaatcattatatctccaaatgaactcactcagagcagaagacactgcactatattattgtgtaaaagacgcatataaattcaattattattactatggcttagacgtatggggacaaggaaccacagtaacagtatcatcagcatctacaaaaggtccctcagtatttccattagctccatcatcaaaatcaacctcaggaggaacagccgcattgggatgtctagtaaaagactatttcccagaaccagtaaccgtatcttggaattctggagccctcacatccggagtacatacctttccagcagtacttcaatcttccggactatattcattatcctccgtagtcacagtaccaagctcatcactaggaacacaaacttatatatgcaacgtcaaccataaaccttcaaacacaaaagtagataaaaaagtagaacccaaatcatgcgataaaacacatacatgcccaccttgcccagcacctgaacttctaggaggaccatccgttttcctattcccaccgaaaccaaaagatacactcatgatatcaagaacaccagaagtaacatgcgtcgtagttgacgtatcacacgaagacccagaagtaaaattcaactggtatgtagacggtgtagaagtacataacgcaaaaacaaaacctagagaagaacaatataactcaacatacagagtcgtatcagttttaaccgtattacatcaagactggctaaacggaaaagaatataaatgcaaggtatctaataaagcactaccagctccaatagaaaaaacaatatcaaaagctaaaggacaaccaagagaaccccaagtatacacactaccaccttcaagggacgaactaacaaaaaaccaagtatctttaacgtgcttagtcaaaggattttatccatcagatatcgctgttgaatgggaatcaaatggacaacccgaaaacaattacaaaacaacaccaccagtactagactcagatggatcattcttcttatattcaaaactaaccgtagacaaatcaagatggcaacaaggaaacgtattttcttgctcagtaatgcatgaagcactacacaaccactacacacaaaaatcattatcattatctccaggt

SEQ ID NO: 46674 - RNA, 642 nt, synthetic construct
  misc_feature 1..642: note = derived and/or modified sequence opt6 from Suptavumab_LightChain1
  source 1..642: mol_type = other RNA
gaaatagtaatgacacaatcaccagcaacactaagcgtaagcccaggcgaaagagcaacactaagctgtagagctagccaaacaatactatcaaacttagcatggtacttacaaaaaccaggacaagcaccaagactattaatatacggagcaagcacacgagcaacaggactaccagccaggttttcaggatcaggatccggaacagaatttactttaacaataagttcgctacaaagcgaagactttgcagtatactattgccaacaatataacaattggccactaacattcggaggaggaacaaaagtagaaataaaacgaacagtagcagcaccaagcgtattcatattcccaccctcagacgaacaattaaaatcaggaacagcatcagtagtatgcttactaaataacttttacccaagagaagcaaaagtacaatggaaagtagataacgcattacaaagcggaaactcacaagaaagcgtaacagaacaagattcaaaagactcaacatatagcttaagctcaacactaaccctaagcaaagcagactacgaaaaacataaagtatacgcatgcgaagtaacacaccaaggattaagctcaccagtaacaaaaagctttaacaggggagaatgc

SEQ ID NO: 46675 - RNA, 1344 nt, synthetic construct
  misc_feature 1..1344: note = derived and/or modified sequence opt6 from Suvizumab_HeavyChain1
  source 1..1344: mol_type = other RNA
caagtacaattagtacaatcaggcgcagaagtaaaaaaaccaggcgcatcagtaaaagtatcctgcaaagcaagtggatacactttcacaaactcttggattggatggttcagacaagcacccggacagggactagaatggattggagacatatatccaggaggaggttacactaactataacgaaatatttaaaggaaaagcaacaatgacagcagacacaagtacaaacacagcatacatggaattatctagcttaagatcagaagatacagcagtatactactgtagtagaggaataccaggatacgcgatggattattggggacagggaactctagtcacagtaagctcagcatcaacaaaaggaccaagcgtattcccactagccccctcaagcaaaagcacatccggaggaacagcagcactcggctgtttagttaaagattattttcctgaaccagttacagttagctggaatagcggagcattaacctctggagtccacacttttccagcagtactacaatcatcaggactatattcattatcatcagtagtgacagtaccaagctcttcattaggtacacaaacatatatatgcaacgtaaatcataaaccatcaaatacgaaagtagacaaaaaagttgaacctaaaagttgtgataaaacccacacttgcccaccatgtccagcaccagaactactaggaggaccatcagtattcctatttccaccaaaacctaaagatacattaatgataagcagaacaccagaagtaacatgtgtcgtagtagatgtctcacacgaagatccagaagttaaattcaattggtacgtagacggagtagaagtacataatgcaaaaacaaaaccacgagaagaacagtacaattcaacatacagagtagtatcagtactaacagtattacaccaagactggctaaatggaaaagagtataaatgtaaagtaagcaataaagcactaccagcaccaatagaaaaaacaatatcaaaagcaaaaggccaacctagagaacctcaagtatataccctaccaccctcaagagatgaattaacaaaaaaccaagtatcacttacatgtctagttaaaggtttctatccctcagacatagcagttgaatgggaatcaaacggccaacccgaaaataattataaaaccactcccccagtattagatagtgacggctcattcttcttatattcaaaattaacagtagataaatcaagatggcaacaaggaaatgtattctcatgcagcgttatgcatgaagccctacacaaccactacactcaaaaatcactttcactcagccccggaaaa

SEQ ID NO: 46676 - RNA, 660 nt, synthetic construct
  misc_feature 1..660: note = derived and/or modified sequence opt6 from Suvizumab_LightChain1
  source 1..660: mol_type = other RNA
gacatacaaatgacacaaagaccagactcactatcagcatcagtaggagaccgagtaacaatgagttgcaaatcaagccaatccctactcaacagcggagaccaaaaaaattacctaacatggtaccaacaaaaaccaggacaaccaccaaaactcttaatctactgggcatcaacaggagaatcaggagtaccagacagattctcaggatccggatctggaacagatttcacattcacaatatcctcactacaaccagaagacatagcaacatactactgtcaaaacgactactcatacccatggacattcggacaaggaacaaaagtagaaataaaaagaaccgtagcagcaccatcagtattcatattcccaccatcagacgaacaactaaaatcaggcacagcatcagtagtatgcctactaaataatttctacccaagagaagcaaaagtacaatggaaagtcgacaacgcattacaaagcggaaactcacaagaatcagtaacagaacaagactcaaaagactcaacatacagcctatcatcaaccctaactctatcaaaagcagactacgaaaaacacaaagtatacgcatgcgaagtcacacaccaaggattatcatcaccagtaacaaaatcattcaacagaggagaatgc

SEQ ID NO: 46677 - RNA, 1350 nt, synthetic construct
  misc_feature 1..1350: note = derived and/or modified sequence opt6 from Tabalumab_HeavyChain1
  source 1..1350: mol_type = other RNA
caagtacaattacaacaatggggagcaggactattaaaaccctctgaaacactctcattaacatgcgcagtatacggtggatccttctccggatattattggtcatggataagacaaccacccggcaaaggactagaatggataggagaaataaaccactcaggatcaacaaactacaacccatcattaaaatcaagagtcactatatcagtagacacatcaaaaaatcaattctcattaaaactatcttcagttacagcagctgacacagcagtctactattgcgcaagaggctactatgacatactaacaggatactactactattttgactactggggacaaggcacactagtaaccgtttcatccgcctctacaaaaggaccatcagtatttcccctagcaccttgttccagatctacatctgaatcaacagccgccctcggatgcctagtaaaagactactttccagaaccagtcacagtctcctggaactctggagcattaacatcaggcgtccacacattcccagccgtactacaatcatcaggactatactcactatcctcagtcgtcaccgtcccatcttcatctctaggaacaaaaacatatacctgcaacgtagatcataaaccatctaacaccaaagtagacaaacgagtagaatcaaaatacggaccaccctgtccaccatgcccagcacccgaatttcttggaggaccctccgtattcctatttccaccaaaaccaaaagataccctaatgatatcaagaacaccagaagttacatgcgtcgtagtagacgtttcacaagaagatccggaagtacaattcaactggtatgtcgatggcgtagaagtacacaatgccaaaacaaaaccaagagaagaacaattcaactcaacataccgagtcgtatctgtactaaccgtattacaccaagattggttaaacggaaaagaatacaaatgcaaagtttcaaacaaaggactaccatcatcaatagaaaaaacaatatccaaagcaaaaggacaacctagagaaccacaagtatatacactacctccatcacaagaagaaatgactaaaaatcaagtatcactaacatgtctagtaaaaggattttatccttccgacatagcagtagaatgggaaagcaatggacaaccagaaaacaactacaaaacaacaccaccagtattagattccgacggatcattcttcttatattcaagactaaccgtagacaaatcaagatggcaagaaggtaatgtattctcatgttccgtcatgcatgaagcattacacaatcactatacacaaaaatctttatcactttcattaggaaaa

SEQ ID NO: 46678 - RNA, 642 nt, synthetic construct
  misc_feature 1..642: note = derived and/or modified sequence opt6 from Tabalumab_LightChain1
  source 1..642: mol_type = other RNA
gaaatagtactaacacaatcacccgcaacactatcactatcaccaggagaaagagcaaccctaagctgccgagcatcacaaagcgtatcaagatacctagcatggtaccaacaaaaaccaggacaagcacccagactactaatatacgacgcatcaaacagagcaacaggaataccagcaagattctcaggatcaggctccggaacagactcaacattaactataagctcactagaaccagaagactttgcagtatattattgccaacaaagatcaaactggccaagaacattcggacaaggaacaaaagtagaaataaaacgaacagtagcagcaccatcagtattcatattcccaccatcagacgaacaactaaaatcaggaacagcatcagtcgtatgcctattaaacaacttctacccaagagaagcaaaagtacaatggaaagtcgacaacgcattacaatcaggaaactcacaagaatcagtaacagaacaagacagcaaagactcaacatactccttatcaaatacattaacactatccaaagcagactacgaaaaacacaaagtttacgcatgcgaagtaacacaccaaggattatcatcaccagtaacaaaatcattcaaccgaggagaatgc

SEQ ID NO: 46679 - RNA, 1332 nt, synthetic construct
  misc_feature 1..1332: note = derived and/or modified sequence opt6 from Tacatuzuab_HeavyChain1
  source 1..1332: mol_type = other RNA
caagttcaattacaacaatcaggagcagaagtaaaaaaaccaggttcctcagtaaaagtatcctgtaaagcctctggatacgcattcacaagctacgtaatccactgggtacgacaagccccaggtcaaggactctactggataggttacatacacccatacaacggaggtacaaaatacaacgaaaaattcaaaggaaaagccacaataacagcagacgaatcaacaaatacagcatatgaactctcatctcttagatcagaagatacagctttctacttctgtgcaagatcaggcggaggagacccattcgcatattggggacaaggatccctcgtaacagtatcatctgcatcaacaaaaggaccctccgtattcccactagccccttcatcaaaatcaacaagtggcggaacagcagcattaggctgcctcgtcaaagactacttcccagaacctgtaactgtaagttggaattcaggcgcactaacatcaggagtacatactttcccagcagtactacaatcctcaggcctctattcactatcaagtgttgtcacagtaccatcatcctctttaggaacacaaacatacatatgtaacgtaaaccacaaaccatcaaatacaaaagtagacaaacgtgtagaaccaaaatcatgcgacaaaacacacacctgtcccccttgcccagccccagaattactaggtggaccatcagttttcctcttcccaccaaaaccaaaagacacattaatatcaagaactccagaagtaacatgcgttgtagtagacgtatcacacgaagacccagaagttaaatttaattggtacgtagacggagtcgaagtacacaacgccaaaacaaaaccaagagaagaacaatataactcaacatatagagtcgtctcagtcttaacagtcctacaccaagactggctaaacggcaaagaatacaaatgcaaagtctcaaacaaagccctaccagccccaatagaaaaaacaatatctaaagcaaaaggacaaccacgagaaccacaagtttatacattaccaccttcaagagaagaaacaaaaaaccaagtatcattaacatgcctagtaaaaggattctacccatccgacatcgccgtagaatgggaatcaaacggacaaccagaaaacaactataaaacaactccaccagtattagacagtgatggatccttcttcttatacagtaaattaacagtcgacaaatcaagatggcaacaaggcaacgtattctcatgctcagtacatgaagcactacacaaccactacacacaaaaatcactaagcttatcaccaggaaaa

SEQ ID NO: 46680 - RNA, 636 nt, synthetic construct
  misc_feature 1..636: note = derived and/or modified sequence opt6 from Tacatuzuab_LightChain1
  source 1..636: mol_type = other RNA
gacatacaactaacacaatcaccatcaagcctatcagcatcagtaggcgacagagtaacaataacatgcaaagcaagccaagatataaataaatacataggatggtaccaacaaaaaccaggaaaagcaccaaaattattacactacacatcagccttactcccaggaataccatcaagattctcaggatcaggaagcggaagagactacacattcacaatatcaagtctacaaccagaagacatagcaacatactactgcctacaatacgacgacctatggacatttggaggaggaacaaaactacaaataaaacgaacagtagcagcaccaagcgtattcattttcccaccatcagacgaacaattaaaatcaggaacagcatcagtagtatgcctactaaataacttctacccaagagaagcaaaagtacaatggaaagtagacaacgcactccaaagcggaaactcacaagaaagcgtcaccgaacaagacagcaaagactcaacatacagcctatcctcaacactaaccctctcaaaagcagactacgaaaaacacaaagtatacgcatgtgaagtaacacaccaaggactaagctcaccagtaacaaaatcattcaacagaggagaatgc

SEQ ID NO: 46681 - RNA, 678 nt, synthetic construct
  misc_feature 1..678: note = derived and/or modified sequence opt6 from Tadocizumab_fab_fragment_HeavyChain
  source 1..678: mol_type = other RNA
caagtacaactagtacaaagcggagcagaagtaaaaaaacccggatcatcagtaaaagtatcatgtaaagcatcaggctacgcattcacaaactatctaatagaatgggtaagacaagcacccggacaaggactagaatggataggagtaatatatccaggatcaggtggaactaactataacgaaaaatttaaaggcagagtaacattaacagtagacgaaagcacaaacacagcatatatggaactatcatcattaagatcagaagacacagcagtatatttctgtgcaagaagagatggaaattacggatggtttgcatattggggacaaggaacactagtaacagtatcatcagcaagcacaaaaggaccatcagtatttccactagcaccatcatcaaaaagtacaagtggaggaacagcagcattaggatgtctagtaaaagattactttccagaaccagtaacagtttcatggaactcaggagcactaacatcaggagtacacacattcccagcagtattacaatcatcaggattatattcattaagctcagtagtaacagtaccatcatcatcattaggaacacaaacatatatatgtaacgtaaaccataaaccatcaaatacaaaagtagataaaaaagtagaaccaaaatcatgtgataaaacacat

SEQ ID NO: 46682 - RNA, 582 nt, synthetic construct
  misc_feature 1..582: note = derived and/or modified sequence opt6 from Tadocizumab_fab_fragment_LightChain
  source 1..582: mol_type = other RNA
gacatacaaatgacacaaacaccatcaacattatcagcatcagtaggagacagagtaactatatcatgccgagcatcacaagacataaacaactacctaaactggtatcaacaaaaaccaggaaaagcaccaaaactactaatatactacacatcaacactacactcaggagtaccatcaagattctcaggatcaggatcaggcacagattacacactaacaatatcatcactacaaccagacgacttcgcaacatacttctgtcaacaaggaaacacactaccatggacattcggacaaggaacaaaagtagaagtaaaacgcacagtagcagcaccatcagtattcatattcccaccatcagacgaacaactaaaatcaggaacagcatcagtagtatgcctactcaacaacttctacgaatcagtaaccgaacaagactcaaaagactcaacatactcactatcatcaacattaacactatcaaaagcagactacgaaaaacacaaagtatacgcatgcgaagtaacacaccaaggattatcatccccagtaacaaaatcattcaacagaggagaatgc

SEQ ID NO: 46683 - RNA, 1359 nt, synthetic construct
  misc_feature 1..1359: note = derived and/or modified sequence opt6 from Talizumab_HeavyChain1
  source 1..1359: mol_type = other RNA
caagtacaattagtccaatcaggagcagaagtaaaaaaaccaggagcgtcagtaaaagtatcctgcaaagcctctggctatacattctccatgtactggctagaatgggtacgccaagccccaggacatggactagaatgggtaggagaaatatcaccaggaacatttacaacaaactacaacgaaaaatttaaagccagagcaacttttacagcagatacatctaccaatacagcatacatggaattatcatcattaagatcagaagacacagccgtatattattgcgccagattctcacacttctcaggatcaaattacgactacttcgattactggggacaaggcacacttgtaacagtatcaagtgcatccacaaaaggaccttccgtgtttcctttagcaccatcctcaaaatcaacaagcggaggcaccgcagcattaggatgtctcgtaaaagactactttccagaaccagtaacagtctcatggaacagtggtgctttaacatcaggagttcatacattccctgcagtattacaatcatcaggattatattccctatcatccgtcgtaacagtaccatcctcttcattaggcacacaaacatacatatgcaacgtaaaccataaaccatcaaatacaaaagtagacaaaaaagtcgaaccaaaatcttgcgacaaaacacacacctgcccaccttgcccagcaccagaactacttggcggaccatcagtattcctattccccccaaaaccaaaagatacactaatgatatccagaactccagaagtcacatgcgtagtagtagacgtctctcacgaagacccagaagtaaaattcaattggtacgtcgacggtgtagaagtacataacgcaaaaaccaaaccaagagaagaacaatacaactccacatatagagtagtctcagtattaacagtccttcaccaagactggttaaacggtaaagaatacaaatgtaaagtatccaacaaagctttaccagcaccaatagaaaaaacaatttcaaaagccaaaggacaaccacgtgaaccacaagtttacacattacctccatcaagagacgaactaacaaaaaaccaagtctctctaacttgcctagttaaaggcttttacccatcagacatagccgtagaatgggaatccaacggacaacccgaaaacaattacaaaacaacaccaccagttttagactcagacggctcattttttctatattcaaaattaacagtagacaaatcacgatggcaacaaggaaacgtattctcatgctctgtaatgcacgaagcactacataatcattacacacaaaaatctttatcactatctccaggtaaa

SEQ ID NO: 46684 - RNA, 642 nt, synthetic construct
  misc_feature 1..642: note = derived and/or modified sequence opt6 from Talizumab_LightChain1
  source 1..642: mol_type = other RNA
gacatattactaacacaatcaccaggaacactaagcttaagcccaggagaacgcgcaacattaagctgcagagcaagtcaaagcataggaacaaacatacactggtaccaacaaaaaccaggacaagcaccaagactcttaataaaatacgcatcagaaagcataagtggaataccatcaagattctcaggatcaggatcaggcacagactttacactaacaataagcagactagaaccagaagacttcgctatgtactactgtcaacaatcagactcatggccaacaacatttggacaaggaacaaaagtagaaataaaaagaacagtagcagcaccatcagtattcatattcccaccatcagacgaacaactaaaatcaggaacagcatcagtagtatgcttactcaacaacttctacccaagagaagcaaaagtacaatggaaagtagacaacgcactacaaagcggtaactcacaagaaagcgtaacagaacaagactcaaaagattcaacatacagcctatcatcaaccttaacactaagcaaagcagactacgaaaaacacaaagtatacgcatgcgaagtaacacaccaaggcctaagctcaccagtaacaaaaagcttcaacagaggcgaatgc

SEQ ID NO: 46685 - RNA, 1368 nt, synthetic construct
  misc_feature 1..1368: note = derived and/or modified sequence opt6 from Tamtuvetmab_HeavyChain1
  source 1..1368: mol_type = other RNA
gaagtaaaactattagaatcaggtggaggtctagtccaaccaggaggttcaatgagattaagctgcgcaggttccggatttacattcacagacttttatatgaattggataagacaaccagcaggaaaagctccagaatggttaggttttatacgagacaaagctaaaggatacaccacagaatataacccatcagtaaaaggccgctttactatttcaagagacaatacgcaaaatatgttatacctacaaatgaataccctaagagcagaagatacagctacctattattgtgcaagagaaggacatacagcagcaccatttgactattggggtcaaggcacactagtaacagtatcatcagcatcaacaacagccccatctgtgtttcctctagcaccttcatgtggttcaacatctggaagcaccgtagcattagcatgtttagtatcaggatactttccagaaccagtaacagtatcatggaactctggaagtctaacatctggagtccatacatttccatcagtattacaatcatcaggcttatactccttatcaagcatggtaacagtcccatcatcaagatggccatcagaaacatttacatgcaatgttgcacacccagcttcaaaaactaaggtagataaacctgtaccaaaaagagaaaatggaagagtaccaagaccacctgattgtcctaaatgtcccgcaccagaaatgttaggaggaccttctgtatttatatttccacccaaacctaaagatacactactaatcgcaagaacaccagaagtaacatgcgtagtagtagatttagatccggaagacccagaggtacaaatctcatggtttgttgacggaaaacaaatgcaaacagctaaaacacaaccacgagaagaacaattcaacggaacatatcgagtagtatcagtactacctatcggacaccaagactggttaaaaggaaaacaatttacatgtaaagttaacaataaagccttaccaagcccaatcgaaagaacaatatcaaaagctagaggtcaagctcatcaaccatccgtttatgtactcccaccaagtagagaagaactatccaaaaacacagtatctttaacatgcctaattaaagattttttccccccagacatagacgttgaatggcaatcaaacggacaacaagaacctgaatccaaatatagaaccacacctccgcaactagatgaagatggatcctattttttatactcaaaattatcagtagataaatcaagatggcaacgaggagatacatttatatgtgcagtaatgcatgaagctttacataaccactatacacaaaaatctctctcacattcacccggaaaa

SEQ ID NO: 46686 - RNA, 639 nt, synthetic construct
  misc_feature 1..639: note = derived and/or modified sequence opt6 from Tamtuvetmab_LightChain1
  source 1..639: mol_type = other RNA
gacataaaaatgacacaatcaccatcattcctatcagcatcagtaggagatagagtaacactaaactgcaaagcctcccaaaacatagataaatacctaaactggtatcaacaaaaactaggagaatccccaaaactcctaatctacaacacaaacaacctacaaacaggaataccatcaagattctcaggatcaggttcaggaacagactttacactaacaatatcatcactacaaccagaagacgtagcaacatatttctgcctacaacacatctcaagaccaagaacattcggcggaggaacccacctaacagtattaggacaaccaaaagcatccccatcagtaacattatttccaccatcatcagaagaattaggagcaaacaaagcaaccctagtatgtctaatatcagacttctacccatcaggagtaacagtagcatggaaagcagacggatcaccaatcacacaaggagtcgaaacaacaaaaccatcaaaacaatcaaacaacaaatacgcagcatcatcatacctatcactaacaccagacaaatggaaatcacactcctcattctcatgcttagtaacacatgaaggatccacagtagaaaaaaaagtcgcaccagcagaatgctca

SEQ ID NO: 46687 - RNA, 360 nt, synthetic construct
  misc_feature 1..360: note = derived and/or modified sequence opt6 from Tanezumab_HeavyChain
  source 1..360: mol_type = other RNA
caagtacaattacaagaaagcggaccaggactagtaaaaccaagcgaaacattaagcttaacatgtacagtaagcggattctcactaataggatatgacttaaactggataagacaaccaccaggaaaaggactagaatggataggaataatatggggagatggaacaacagattacaatagtgcagtaaaaagcagagtaacaatatcaaaagatacatcaaaaaatcaatttagtttaaaattaagctcagtaacagcagcagacacagcagtatactattgcgcaagaggaggatattggtatgcaacaagctattactttgactattggggacaaggaacattagtaacagtatca

SEQ ID NO: 46688 - RNA, 327 nt, synthetic construct
  misc_feature 1..327: note = derived and/or modified sequence opt6 from Tanezumab_LightChain
  source 1..327: mol_type = other RNA
gacatacaaatgacacaatcaccatcatcattatcagcatcagtaggagacagagtaacaataacatgcagagcatcacaatcaatatcaaacaacctaaactggtaccaacaaaaaccaggaaaagcaccaaaactactaatatactacacatcaagattccactcaggagtaccatcaagattctcaggatcaggatcaggaacagacttcacattcacaatatcatcactacaaccagaagacatagcaacatactactgccaacaagaacacacactaccatacacattcggacaaggaacaaaactagaaataaaaagaaca

SEQ ID NO: 46689 - RNA, 1323 nt, synthetic construct
  misc_feature 1..1323: note = derived and/or modified sequence opt6 from Tarextumab_HeavyChain1
  source 1..1323: mol_type = other RNA
gaagttcaactagtagaaagcggcggaggtctagtacaaccaggaggatcactaagactaagctgtgccgcatctggcttcacattctcatcctcaggaatgtcatgggtccgacaagcaccaggaaaaggattagaatgggtatcagtaatagcaagttctggatcaaatacctactatgcagatagcgtaaaaggaagatttacaataagcagagacaatagcaaaaacacactatatctacaaatgaattctctaagagcagaagatacagcagtttattactgcgctcgatcaatattttatacaacatggggacaaggaactctagtcacagtatctagcgcatctactaaaggaccatcagtctttccattagccccatgctctagatcaacatcagaatccactgcagcattaggttgtctagtaaaagattattttcccgaaccagttacagtaagttggaactcaggagcactaacttcaggagtacatacctttccagcagtactacaatcaagcggattatattcattatcatcagtagttacagtaccctcttcaaacttcggaacacaaacatatacatgcaatgttgaccataaaccatccaacacaaaagtagataaaacagtcgaaagaaaatgctgtgttgaatgcccaccctgtccagcacccccagttgctggaccatctgtattcttattcccaccaaaaccaaaagacacactaatgatatcaagaacaccagaagttacatgcgtagttgtagatgtaagccacgaagatcccgaagtacaattcaactggtatgtagacggagttgaagtacataatgccaaaactaaacccagagaagaacaatttaacagtacatttcgcgtagtatcagtattaaccgtagttcatcaagattggctaaacggaaaagaatacaaatgtaaagtatctaacaaaggacttcctgctccaatagaaaaaacaatatcaaaaaccaaaggacaacccagagaaccacaagtatacacacttcctccatcaagagaagaaatgaccaaaaaccaagtctcactaacatgcctagtaaaaggcttctacccatcagacatagctgtagaatgggaatcaaatggacaacctgaaaacaattataaaacaacaccaccaatgttagattcagacggatcttttttcctatactcaaaattaaccgtagataaatctagatggcaacaaggaaatgtattctcatgtagtgtaatgcacgaagcactacataaccactatacacaaaaatcactatcattatcaccaggtaaa

SEQ ID NO: 46690 - RNA, 645 nt, synthetic construct
  misc_feature 1..645: note = derived and/or modified sequence opt6 from Tarextumab_LightChain1
  source 1..645: mol_type = other RNA
gacatagtattaacacaatcaccagcaaccctatcactatcaccaggagaacgagcaaccttatcctgccgagcatctcaatcagtaagatccaactacctagcctggtaccaacaaaaacctggacaagcaccaagacttttaatatacggcgcatcatcaagagcaaccggagtaccagcaagattctcaggatcaggttcaggcacagacttcacactaacaatatcatcattagaaccagaagacttcgcagtatactactgccaacaatactcaaacttcccaataacattcggacaaggaacaaaagtagaaataaaaagaacagtagcagccccatcagtattcatattcccaccaagcgacgaacaactaaaatcaggaacagcatcagtcgtatgcttactaaacaacttctacccaagagaagcaaaagtacaatggaaagtagacaacgcattacaatcaggaaattcacaagaatcagtaacagaacaagactcaaaagattccacatactcactatcctcaacactaacactatctaaagcagactacgaaaaacacaaagtatacgcatgcgaagtcacacatcaaggattatcatcaccagtaacaaaatcattcaacagaggagaatgc

SEQ ID NO: 46691 - RNA, 363 nt, synthetic construct
  misc_feature 1..363: note = derived and/or modified sequence opt6 from Tefibazumab_HeavyChain1
  source 1..363: mol_type = other RNA
caagtacaattaaaagaaagcggaccaggactagtaaaaccaagccaaacattaagcataacatgtacaataagcggattctcactatcaagatatagcgtacactgggtaagacaaccaccaggaaaaggactagaatggctaggaatgatatggggaggaggaaatacagattacaatagcgcactaaaaagcagactatcaatatcaaaagataactcaaaaaatcaagtattcttaaaaatgaactcactaacagcagcagacacagcagtatactattgcgcaagaaaaggagaattctattacggatacgatggatttgtatattggggacaaggaacattagtaacagtatcaagc

SEQ ID NO: 46692 - RNA, 336 nt, synthetic construct
  misc_feature 1..336: note = derived and/or modified sequence opt6 from Tefibazumab_LightChain1
  source 1..336: mol_type = other RNA
gacatagtaatgacacaatcaccagactcactagcagtatcactaggagaacgagtaacaatgaactgcaaatcatcacaatcagtactatactcatcaaaccaaaaaaactacctagcatggtaccaacaaaaaccaggacaatcaccaaaactactaatatactgggcatcaacaagagaatcaggagtaccagacagattctcaggatcaggatcaggaacagacttcacactaacaatatcatcagtacaagcagaagacctagcagtatactactgccaccaatacctatcatcatacacattcggaggaggaacaaaactagaaataaaa

SEQ ID NO: 46693 - RNA, 1368 nt, synthetic construct
  misc_feature 1..1368: note = derived and/or modified sequence opt6 from Tenatumomab_HeavyChain1
  source 1..1368: mol_type = other RNA
gaaattcaactacaacaatcaggaccagaactagtcaaaccaggagcttccgtaaaagtatcatgtaaagcatcaggatacgcatttacatcatataacatgtactgggtcaaacaatctcacggcaaatcactagaatggataggatacatcgacccatacaatggtgtaacctcatataaccaaaaattcaaaggaaaagccacactaacagtagacaaatcttcctctacagcatatatgcacttaaatagcctaacatctgaagactcagcagtatactactgcgcaagaggaggaggatcaatctactatgcaatggactactggggacaaggaacctctgtcacagtatcctccgccaaaacaacacccccttcagtatacccactagcacccggatgcggagacactacaggctcatctgtcacattaggttgcctcgtaaaaggttacttcccagaaagtgttacagtaacatggaactcaggatccttatcatcttccgtacacacattcccagccctattacaatcaggactatacactatgtcatcatcagtaacagtaccatcctcaacatggccatcacaaacagtcacatgctcagtcgcacacccagcttcaagcacaacagtagacaaaaaattagaaccatcaggaccaatttcaacaataaatccctgtccaccatgcaaagaatgccacaaatgcccagccccaaacctagaaggaggaccatcagtattcatattcccaccaaatataaaagacgtcttaatgatatcactaacaccaaaagtaacatgcgtagtagttgacgtatcagaagacgacccagatgtacaaatatcatggttcgtaaataacgtagaagtacatacagcacaaacacaaacacacagagaagactacaactcaactataagagtcgtaagcacactacctatccaacatcaagactggatgtcaggaaaagaatttaaatgtaaagtaaacaacaaagatctcccatcaccaatagaacgaactatatccaaaataaaaggactagtacgagctccacaagtatatatattaccacccccagctgaacaattatctagaaaagacgtatcactaacatgcctcgtagtcggatttaacccaggcgacatatcagtcgaatggacatcaaacggacacacagaagaaaactataaagacacagcccccgtattagactctgatggatcatactttatatatagtaaattaaatatgaaaaccagcaaatgggaaaaaacagactccttctcatgcaacgtcagacacgaaggtctaaaaaactattacttaaaaaaaacaatatcaagatcaccaggaaaa

SEQ ID NO: 46694 - RNA, 657 nt, synthetic construct
  misc_feature 1..657: note = derived and/or modified sequence opt6 from Tenatumomab_LightChain1
  source 1..657: mol_type = other RNA
gacatagtaatgacacaagcagcaccatcagtaccagtaacaccaggagaatcagtatcaatatcatgcagatcatctaaatcactactacactccaacggaaacacatacctatactggttcctacaaagaccaggacaatctccacaactattaatatacagaatgtcaaacctagcatcaggagtaccagacagattctcaggatcaggatcaggaacagcattcacactaagaatatcaagagtagaagcagaagacgtaggagtatactattgcatgcaacacctagaatatccattaactttcggagcaggaacaaaattagaactaaaaagagcagacgcagcaccaacagtatcaatattcccaccatcaagcgaacaactaacctcaggaggagcatcagtcgtatgctttttaaacaacttctacccaaaagacataaacgtaaaatggaaaatagacggatcagaaagacaaaacggagtattaaactcatggacagaccaagactcaaaagactcaacctactcaatgtcatctacactaacattaacaaaagacgaatacgaaagacacaactcatacacatgcgaagcaacacacaaaacatcaacatccccaatagtaaaatcattcaacagaaacgaatgc

SEQ ID NO: 46695 - RNA, 1356 nt, synthetic construct
  misc_feature 1..1356: note = derived and/or modified sequence opt6 from Teneliximab_HeavyChain1
  source 1..1356: mol_type = other RNA
caaatacaattagtacaatcaggacccgaattaaaaaaaccaggagaaacagtcagaatatcatgtaaagcatccggctacgcatttaccacaaccggaatgcaatgggtacaagaaatgccaggaaaaggactaaaatggataggatggataaacacacattcaggcgttcccaaatacgtagaagacttcaaaggaagatttgcattctccctagaaacatccgcaaacactgcatacctccaaatatcaaatttaaaaaatgaagacacagcaacatatttctgcgtaagatcaggaaatggaaattacgacctagcatattttgcctactggggacaaggaacactagtaacagtatcagcagcctcaacaaaaggtccatcagtatttcccctcgccccatcatccaaatcaacatcaggaggtactgcagcactcggctgcctagtcaaagactacttccccgaacccgtaaccgtatcttggaacagtggagcactaacatcaggagtacacacattcccagcagtcctacaatcttctggattatactcattatcatcagtagtaacagtacccagcagttcactaggaacccaaacctacatatgcaatgttaaccacaaaccatccaataccaaagtagacaaaaaagtagaaccaaaatcatgcgacaaaacacatacatgcccaccatgtcccgcacccgaattactcggaggaccatccgttttcctattcccaccaaaaccaaaagataccttaatgatatcaagaacaccagaagtaacatgcgttgtagtagacgtctcacacgaggaccctgaagtaaaatttaactggtacgtcgacggagtagaagtccataacgcaaaaactaaaccaagagaagaacaatataactccacatatagagttgtttccgttttaacggtactacatcaagactggttaaacggcaaagaatacaaatgcaaagtttcaaataaagcattacccgcacccatcgaaaaaacaatctctaaagctaaaggccaaccaagagaaccacaagtctacacactaccaccatcacgcgacgaactcacaaaaaaccaagtttctttaacatgcctagtaaaaggcttctacccctcagacatagctgtcgaatgggaatcaaacggacaacccgaaaacaactacaaaaccacaccaccagtcctagactcagacggatcttttttcctatactctaaattaacagtagataaatcaagatggcaacaaggtaacgtcttctcttgttctgtaatgcatgaagctttacacaaccactacacacaaaaatcattatcattatctcccggcaaa

SEQ ID NO: 46696 - RNA, 642 nt, synthetic construct
  misc_feature 1..642: note = derived and/or modified sequence opt6 from Teneliximab_LightChain1
  source 1..642: mol_type = other RNA
gacatagtactaacacaatcaccagccacattatcagtaacacctggcgacagagtatcactatcatgcagagcatcacaatcaatatcagactacttacactggtaccaacaaaaatcccacgaatcaccaagactactaataaaatatgcatcccactccatatcaggaataccaagcagattctcaggatcaggatcaggatcagacttcacactaagcataaactcagtagaaccagaagacgtaggaatatactactgccaacacggacactcatttccatggacattcggaggaggaacaaaactcgaaataaaacgaacagtagcagcaccaagcgtattcatattcccaccatcagacgaacaattaaaatctggaacagcctcagtagtatgcctactaaacaacttctacccaagagaagcaaaagtacaatggaaagtagacaacgcactacaatccggaaactcacaagaatcagtaacagaacaagactcaaaagactcaacatattcattatcatcaacactaacattaagcaaagcagactacgaaaaacacaaagtatacgcatgcgaagtaacacaccaaggactatcatcaccagtaaccaaatcattcaacagaggcgaatgc

SEQ ID NO: 46697 - RNA, 1347 nt, synthetic construct
  misc_feature 1..1347: note = derived and/or modified sequence opt6 from Teplizumab_HeavyChain1
  source 1..1347: mol_type = other RNA
caagttcaactagtacaatcaggaggaggagtagttcaaccaggcagatctttaagactctcatgcaaagcctcaggatacaccttcaccagatacacaatgcattgggttcgacaagctccaggcaaaggacttgaatggattggttacatcaacccatctcgaggatacactaactacaatcaaaaagtaaaagacagattcactataagcagagacaactccaaaaacacagcttttctacaaatggacagtctaagaccagaagacaccggcgtatacttctgtgcaagatactacgacgatcactattgcctagactactggggacaaggaacccccgtaacagtctccagcgcctccacaaaaggaccatcagtattcccactagcaccatcttctaaatcaacctcaggaggaacagcagctttaggatgcctagtaaaagattactttccagaaccagtaacagtatcctggaattccggagctctcacatcaggagttcacacattccccgcagttctacaatcttccggactctacagcctctcatcagtagtaacagtaccttcttcttctttaggaacacaaacatacatctgcaatgtaaatcacaaaccatccaacacaaaagtagacaaaaaagtagaacccaaatcctgtgacaaaacacatacatgcccaccttgcccagcaccagaagccgcaggaggaccatcagtatttctattcccccctaaaccaaaagataccttaatgatatcaagaaccccagaagtaacctgcgttgttgtagatgtatcacacgaagatccagaagtaaaattcaactggtatgtagacggagttgaagtacataacgcaaaaacaaaaccaagagaagaacaatacaattccacatatcgagtagtatcagttcttacagtgctccatcaagactggctcaatggcaaagaatacaaatgcaaagtatccaacaaagcattacccgcaccaatagaaaaaacaatatcgaaagcaaaaggccaaccacgagaaccacaagtttacacacttccaccatcaagagatgaattaaccaaaaaccaagtatcactaacatgcttagtaaaaggattttacccatcagacatagcagtagaatgggaatcaaatggccaaccagaaaacaactacaaaacaacaccaccagtattagactcagacggatcattctttttatattcaaaactaacagtcgacaaaagtagatggcaacaaggaaacgtattttcatgctcagtaatgcatgaagcattacataaccactatacacaaaaatcactatccttatcaccaggaaaa

SEQ ID NO: 46698 - RNA, 639 nt, synthetic construct
  misc_feature 1..639: note = derived and/or modified sequence opt6 from Teplizumab_LightChain1
  source 1..639: mol_type = other RNA
gacatacaaatgacccaatcaccatcctcactatcagcctcagtaggagacagagtaacaataacatgctcagcatcctcatcagtatcatacatgaactggtaccaacaaacaccaggaaaagcaccaaaaagatggatatacgatacatccaaactcgcatctggagtaccatcaagattctcaggatccggatcaggaacagactacacattcactatatcatcattacaacccgaagacatagccacatattactgccaacaatggtcatcaaacccattcacatttggacaaggaacaaaactccaaataacaagaacagtagccgcaccatcagtattcatattcccaccatcagacgaacaactaaaatcaggaacagcatcagtagtatgcctattaaacaacttctacccaagagaagcaaaagttcaatggaaagtagacaacgcactacaatcaggaaactcacaagaatccgtaacagaacaagactcaaaagattcaacatactccttatcatcaacactaacactatcaaaagcagattacgaaaaacacaaagtatacgcatgcgaagtaacacatcaaggactatcatcaccagtaacaaaatccttcaatagaggagaatgc

SEQ ID NO: 46699 - RNA, 1344 nt, synthetic construct
  misc_feature 1..1344: note = derived and/or modified sequence opt6 from Teprotumumab_HeavyChain1
  source 1..1344: mol_type = other RNA
caagtagaactagtagaatcaggaggaggagtcgtacaacctggccgctcacaaagactaagttgtgcagcatcaggatttaccttttcatcttacggaatgcactgggtacgacaagcaccaggaaaaggattagaatgggtagcaataatatggtttgacggatcctcaacctactatgcagactctgtaagaggcagatttacaatcagtagagacaactctaaaaatactctttacctccaaatgaactcattaagagccgaagacacagcagtctatttttgcgcacgtgaactaggtagacgatacttcgacctatggggacgaggaacactagtatccgtcagttcagcctctacaaaaggaccatcagtattccccctagcaccatcatcaaaaagtacatcaggaggaaccgccgccttaggatgtctagtaaaagactatttccccgaaccagtaaccgtctcatggaactcaggcgcactaacttcaggcgtacacacatttccagcagtcctacaatcttcaggactatattcattaagctcagtagtaacagtaccatcatcttctctaggaactcaaacatatatatgcaatgtcaaccacaaaccatccaacacaaaagtagacaaaaaagtagaaccaaaatcatgcgataaaacccacacatgccctccatgcccagcaccggaattattaggaggaccctcagtattcttattcccacccaaacccaaagacactttaatgatatcaagaacacccgaagtaacatgcgtagtagtagatgtcagccatgaggaccctgaagtaaaattcaactggtatgtagacggcgtcgaagtacacaatgcaaaaacaaaacccagagaagaacaatacaattcaacttatagagttgtatccgttcttactgtactacaccaagactggctaaatggtaaagaatataaatgcaaagtatcaaataaagcattacccgctccaattgaaaaaacaatttcaaaagccaaaggtcaaccaagagaaccacaagtatacacactcccaccctcaagagacgaactaacaaaaaaccaagtatcattaacatgcttagtaaaaggattttatccatcagatatcgcagtagaatgggaatccaatggccaaccagaaaacaattacaaaacaacaccaccagtattagattccgacggaagtttttttttatactcaaaattaactgtagataaatcaagatggcaacaaggaaatgttttctcttgttcagtaatgcacgaagcactacataatcactatacacaaaaatctttatccttatcacccggaaaa

SEQ ID NO: 46700 - RNA, 645 nt, synthetic construct
  misc_feature 1..645: note = derived and/or modified sequence opt6 from Teprotumumab_LightChain1
  source 1..645: mol_type = other RNA
gaaatagtactaacacaatcaccagcaacattatcactctccccaggagaaagagcaacactatcatgcagagcatcacaatctgtatcatcatacctagcatggtaccaacaaaaaccaggacaagcaccaagactactaatatacgacgcatcaaaaagagcaacaggaataccagcacgattctcaggatcaggatcaggcacagacttcacattaacaatatcatcactagaaccagaagacttcgcagtatactactgccaacaaagatcaaaatggccaccatggacattcggacaaggaacaaaagtagaatcaaaaagaacagtagcagcaccatccgtattcatattcccaccatcagacgaacaactcaaatcaggaacagcatcagtagtctgcctactaaacaacttctacccaagagaagcaaaagtacaatggaaagtagacaacgccctacaatcaggaaactcacaagaatcagtcacagaacaagactccaaagactcaacatactcactatcatcaacattaacactatcaaaagcagactacgaaaaacacaaagtatacgcatgtgaagtaacacaccaaggactatcatcaccagtaacaaaatcattcaacagaggagaatgc

SEQ ID NO: 46701 - RNA, 1338 nt, synthetic construct
  misc_feature 1..1338: note = derived and/or modified sequence opt6 from Tesidolumab_HeavyChain1
  source 1..1338: mol_type = other RNA
gaagtccaactagttcaatcaggcgcagaagtaaaaaaaccaggatcatcagtaaaagtctcatgcaaagcctccggaggaacattcagttcatacgctatatcatgggtaagacaagcaccaggacaaggcctagaatggatgggtggaataggaccattcttcggaacagcaaactatgctcaaaaattccaaggaagggtcacaataacagccgacgaatcaacaagtacagcctacatggaattatcatcactaagatcagaagacacagcagtatattactgcgcaagagatacaccatacttcgactactggggacaaggcacattagtaactgtctcatcagcaagtacaaaaggaccatctgtatttccactagctccatcctcaaaatcaacgtcaggaggaacagcagccctaggatgcctagtaaaagattacttcccagagccagtaacagtaagttggaattcaggagcattaacctccggagttcatacctttccagcagtattacaaagctcaggactatacagcttatcaagcgtagtaaccgtcccttcctcatctctaggaacacaaacatatatttgcaacgtaaaccacaaacctagtaatacgaaagtagacaaaagagtagaaccaaaatcatgtgataaaacccacacatgtccaccatgcccagccccagaagcagcaggaggaccaagtgtcttcttattccctcctaaaccaaaagacacactaatgatatcacgaacaccagaagttacatgtgtagtagtagatgtaagtcatgaagatccagaagtaaaatttaactggtacgtcgatggagtagaagttcacaacgcaaaaaccaaaccaagagaagaacaatataattcaacatatagagtagtatccgtcttaacagtactacaccaagactggctaaatggaaaagaatacaaatgcaaagtatcaaacaaagcattaccagcaccaatagaaaaaacaataagtaaagcaaaaggccaaccaagagaaccacaagtatacacattaccaccaagtagagaagaaatgacaaaaaaccaagtatcattaacatgtttagtaaaaggattttacccaagtgacatagccgtagaatgggaatcaaacggtcaaccagaaaacaattacaaaacaacaccaccagtactagactcagatggttccttcttcctatatagtaaacttacagtagacaaatcaagatggcaacaaggaaacgtcttctcttgctctgtaatgcatgaagccctacataaccactatacacaaaaatcactttcattatcaccaggtaaa

SEQ ID NO: 46702 - RNA, 642 nt, synthetic construct
  misc_feature 1..642: note = derived and/or modified sequence opt6 from Tesidolumab_LightChain1
  source 1..642: mol_type = other RNA
tcatacgaattaacacaaccactatcagtatccgtagcactaggacaaacagcaagaataacatgctctggagactccataccaaactactacgtatattggtaccaacaaaaaccaggacaagcaccagtcctagtaatatacgacgactcaaacagaccatcaggaataccagaaagattctcaggaagcaactcaggaaacacagccacactaacaatatcaagagcacaagcaggagacgaagcagactactactgtcaatcattcgacagctcactaaacgccgaagttttcggaggaggaacaaaattaacagtactaggacaaccaaaagcagcaccatcagtaactttattcccaccatcatcagaagaactacaagcaaacaaagcaacactagtatgcctaatatccgacttctacccaggcgcagtaacagtagcatggaaagcagactcatcaccagtcaaagcaggcgtcgaaacaacaacaccatcaaaacaatcaaacaacaaatacgcagcctcatcatacctatcactaacaccagaacaatggaaatcacacagatcatattcatgccaagtcacacacgaaggatcaacagtagaaaaaaccgtagcaccaacagaatgctca

SEQ ID NO: 46703 - RNA, 1344 nt, synthetic construct
  misc_feature 1..1344: note = derived and/or modified sequence opt6 from Tezepelumab_HeavyChain1
  source 1..1344: mol_type = other RNA
caaatgcaattagtagaatcgggtggcggagtagtacaacccggccgatcacttagactaagctgcgcagcatcaggctttaccttcagaacatacggaatgcattgggtaagacaagccccaggaaaaggattagaatgggtagccgtaatatggtatgacggatcaaacaaacactatgcagactctgtaaaaggaagatttactataacaagagacaactcaaaaaatacacttaacttacaaatgaactcattaagagcagaagatactgcagtatactactgcgcaagagctccacaatgggaacttgtacacgaagcattcgacatatggggacaaggaacaatggtaacagtatcatctgcatccacaaaaggaccttcagtctttcccttagctccatgctcacgatcaacatcagaatcaacagcagctttaggatgtctagtaaaagattactttcccgaacccgtaacagtcagctggaacagtggagcactaacttcaggcgtacatacatttccagccgtcttacaatcatctggactatactcactgtcatctgtcgtaaccgttccatcttcaaatttcggaacccaaacctacacatgcaatgttgatcacaaaccatcaaatacaaaagtagataaaacagtagaaagaaaatgctgtgttgaatgcccaccttgtcctgcacctccagtagcaggaccatccgtcttcctatttccaccaaaacccaaagatacattaatgatatcaagaacaccagaagtaacatgtgttgttgtagacgtatcacacgaagatcctgaagtacaattcaactggtacgtagacggagtagaagtacataatgcaaaaacaaaaccaagagaagaacaattcaactcaacatttagagtagtttcagtattaacagtagtccaccaagactggctaaacggaaaagaatataaatgcaaagtctcaaacaaaggattaccagcaccaatagaaaaaacaatatcgaaaacaaaaggacaaccaagagaaccccaagtatacacactaccaccttcacgcgaagaaatgacaaaaaatcaagtttccctaacatgtttagtaaaaggattctatccatcagacatcgcagtagaatgggaatcaaatggacaaccagaaaacaattataaaaccacaccaccaatgttagattcggacggaagctttttcttatactcaaaacttacagtcgataaatcaagatggcaacaaggaaacgtattctcatgctcagtaatgcacgaagcattacacaatcactacactcaaaaatctttatctttaagcccaggaaaa

SEQ ID NO: 46704 - RNA, 642 nt, synthetic construct
  misc_feature 1..642: note = derived and/or modified sequence opt6 from Tezepelumab_LightChain1
  source 1..642: mol_type = other RNA
tcatatgtactaacacaaccaccatcagtatcagttgcacctggacaaaccgcaagaatcacatgcggaggaaacaacttaggatcaaaatcagtacattggtaccaacaaaaaccaggacaagcaccagtactagtagtctacgatgactcagacaggccatcatggataccagaaagattctcaggatcaaactcaggaaacacagcaacactaacaatatcaagaggagaagcaggagacgaagcagactactactgccaagtatgggactcatcaagtgaccacgtagtattcggaggcggaacaaaactaacagtattaggacaaccaaaagcagcaccaagcgtaacactattcccaccatcaagcgaagaattacaagcaaacaaagcaacactagtatgcctaataagcgacttctacccaggagcagtaacagtagcatggaaagcagactcatcaccagtaaaagcaggagtagaaacaacaacaccatcaaaacaaagtaataacaaatacgcagcatcttcatacttatcattaacaccagaacaatggaaatcacacagatcatactcatgccaagtaacacacgaaggatcaacagtagaaaaaacagtagcaccaacagaatgctca

SEQ ID NO: 46705 - RNA, 1338 nt, synthetic construct
  misc_feature 1..1338: note = derived and/or modified sequence opt6 from ThioMAb-chMA79b-HC(A118C)_HeavyChain
  source 1..1338: mol_type = other RNA
gaagtacaactacaacaatccggagcagaactaatgaaaccaggagcatccgtaaaaatatcttgcaaagcaacaggatacactttctcatcatactggatagaatgggtaaaacaaagacccggtcacggactagaatggataggagaaatcttaccaggaggtggcgacacaaactacaacgaaatattcaaaggaaaagcaacattcacagcagacacatcctctaacaccgcatatatgcagctatcatctctaacatcagaagattccgccgtttactactgtaccagaagagtaccagtctacttcgactactggggacaaggaacatcagtaacagtatcatcgtgttcaacaaaaggcccatcagtcttcccactcgccccttcctcaaaatccacatcaggaggaacagcagcactaggatgcctagtaaaagactatttcccagaaccagtaacagtaagctggaactcaggagctctaacatcaggtgtacatacattcccagcagtattacaatcaagtggattatactcactatcatccgtagtaacagtaccctcatcaagtttgggcacacaaacatacatatgcaacgtaaaccataaaccaagtaacacaaaagtagataaaaaagtcgaacctaaatcatgcgataaaacccatacctgtcccccatgcccagcaccagaattactaggaggaccatcagtatttttattcccaccaaaacccaaagacaccttaatgatctcacgtacaccagaagtaacatgcgtcgtagtagacgtatcccacgaagacccagaagtcaaattcaattggtatgtagatggagtcgaagtacacaatgccaaaacaaaaccccgagaagaacaatataactcaacatatagagtagtatccgttttaacagtactacaccaagactggctaaacggtaaagaatataaatgcaaagtatccaacaaagccttacccgcaccaatagaaaaaacaatatcaaaagcaaaaggtcaaccaagagaaccacaagtatacactctaccaccctcaagagaagaaatgacaaaaaaccaagtatcattaacctgtttagtaaaaggattctatccttccgacatcgccgtagaatgggaatctaacggtcaaccagaaaacaactacaaaaccacaccaccagtcctagactcagatggatccttcttcctttactccaaattaacagtagacaaatctaggtggcaacaaggaaatgtattttcatgctcagtaatgcacgaagcattacacaaccactacacacaaaaatcattaagcctctcacccgga

SEQ ID NO: 46706 - RNA, 1347 nt, synthetic construct
  misc_feature 1..1347: note = derived and/or modified sequence opt6 from ThioMab-hu10A8.v1-HC(A118C)_HeavyChain
  source 1..1347: mol_type = other RNA
gaagtacaactcgtagaatccggaggaggattagtacaaccaggtggatcattaagattatcttgcgcagcatcaggcttcacattctcatcctacgcagtcagttgggtaagacaagcaccaggcaaaggattagaatgggtagcaacaatatcatccggcggctcactaacattttaccttgactcagttagaggtcgattcacaatatccagagacaactcaaaaaatacattataccttcaaatgaactccttaagagcagaagatactgcagtatattactgcgcacgacccatcccagactattatgctctagattactggggacaaggaacactagttaccgtttcatcctgctccaccaaaggcccaagtgtattccctctagcaccatcatccaaatccacatctggcggcactgccgctttaggctgcttagtaaaagattatttccccgaaccagtaactgtctcatggaattccggtgcattaacatcaggagttcacacattccccgcagtactccaaagctcaggactatattcattatcatccgtcgtaacagttccttcctcttccctaggaacacaaacttatatatgcaatgtcaaccacaaaccatcaaacacaaaagtcgataaaaaagtagaaccaaaatcctgtgacaaaacacacacatgtccaccatgtccagcaccagaattactaggaggtccatccgtctttttatttccaccaaaaccaaaagataccctcatgatatctagaacaccagaagtcacatgcgtagtagtagacgtatctcacgaagatcctgaagttaaatttaactggtatgttgacggagtagaagtacataatgcaaaaacaaaaccaagagaagaacaatataatagcacatatcgagtagtttcagtcttaacagttttacaccaagactggctaaacggaaaagaatacaaatgtaaagtatcaaacaaagcattacctgcacctatagagaaaacaatatcaaaagccaaaggtcaacctagagaacctcaagtatatacacttccaccatccagagaagagatgacaaaaaaccaagtatcacttacatgtttagtaaaaggcttctacccctcagatattgcagtcgaatgggaatcaaacggccaaccagaaaacaactataaaacaacaccaccagtattagattccgatggatcattctttctatactctaaattaacagtagacaaatcaagatggcaacagggcaatgtcttctcatgttcagtgatgcacgaagcactacataaccattacacacaaaaatcattatcattatcaccaggaaaa

SEQ ID NO: 46707 - RNA, 1347 nt, synthetic construct
  misc_feature 1..1347: note = derived and/or modified sequence opt6 from ThioMab-hu10A8.v1-HC(V205C)_HeavyChain
  source 1..1347: mol_type = other RNA
gaagtacaattagttgaatcaggaggaggcctcgtccaaccaggcggatcactaagattatcatgcgcagctagtggattcacattttcatcatacgccgtaagttgggtacgtcaagcaccaggaaaaggacttgaatgggttgcaacaatatcatccggtggctcattaactttctacttagatagtgtaagaggacgctttactatttcaagagataattcaaaaaatacattatacctacaaatgaattcactaagagcagaagacacagctgtttattattgcgcaagaccaataccagactactatgccttagactactggggacaaggcacacttgttacagtatctagtgcatcaacaaaaggaccatcagttttcccactcgctccatcatcaaaaagtacatccggaggaacagcagcattaggctgtttagtaaaagactactttccagaacccgtcactgtttcatggaattcaggagcattaacatccggagtacacacatttccagcagtactacaaagctcaggtctatactcattatcatcagtagtgacagtaccatcaagcagtttaggaacccaaacctacatctgtaacgtaaatcacaaaccatccaacacaaaagttgacaaaaaagttgaaccaaaatcctgcgacaaaacacacacatgccccccatgtcctgcaccagaactattaggaggcccaagcgttttcttattcccaccaaaaccaaaagacacactaatgatatcacgcacaccagaagtaacatgtgtagtcgtcgatgtttcacacgaagacccagaagtaaaatttaattggtatgttgacggagtcgaagtacacaacgcaaaaacaaagcccagagaagaacaatataacagtacatatcgcgttgtctcagtactaacagtattacaccaagattggctaaatggcaaagaatataaatgcaaagtatctaacaaagcactaccagcaccaatagaaaaaaccatatctaaagctaaaggacaacctagagaaccacaagtctatacactacctccttcacgcgaagaaatgacaaaaaaccaagtatcattaacatgcttagtaaaaggattctaccccagcgatatagcagtagaatgggaatcaaacggtcaaccagaaaacaactacaaaaccacaccaccagtcttagacagtgacggatcatttttcttatatagcaaactaacagttgacaaatctagatggcaacaaggaaatgtattctcatgctcagtaatgcacgaagcattacataatcactatacacaaaaatcattatcactatcacccggaaaa

SEQ ID NO: 46708 - RNA, 642 nt, synthetic construct
  misc_feature 1..642: note = derived and/or modified sequence opt6 from ThioMab-hu10A8.v1-LC(A118C)_LightChain
  source 1..642: mol_type = other RNA
gacatacaaatgacacaatcaccttcctcattatcagcatcagtaggcgacagagtaacaataacatgtaaagcatcacaagacgtatccacagcagtagcatggtaccaacaaaaaccaggaaaagcaccaaaactattaatatactcagcatcatacagatacacaggagtaccatcaagattctcaggatcaggctcaggaacagacttcaccctaaccatatcctcactacaaccagaagacttcgcaacatactactgccaacaacacttctcaagcccaagaacattcggacaaggaacaaaagtcgaaataaaaagaacagtagcagcaccatcagtattcatattcccaccatcagacgaacaactaaaatcaggaacagcatcagtcgtatgcctattaaacaacttctacccaagagaagcaaaagtacaatggaaagtagataacgcactacaatcaggaaactcacaagaatcagtaacagaacaagactcaaaagactcaacatactccctatcatcaaccctaaccctatcaaaagcagactacgaaaaacacaaagtatacgcatgcgaagtaacacaccaaggcttatcatcaccagtaacaaaatctttcaacagaggagaatgc

SEQ ID NO: 46709 - RNA, 642 nt, synthetic construct
  misc_feature 1..642: note = derived and/or modified sequence opt6 from ThioMab-hu10A8.v1-LC(V205C)_LightChain
  source 1..642: mol_type = other RNA
gacatacaaatgacacaatcaccatcatcactatccgcctcagtaggagacagagtaacaataacttgcaaagcatcacaagacgtatcaacagcagtagcatggtaccaacaaaaaccaggaaaagcaccaaaactactaatctactcagcatcatacagatacaccggagtaccatcaagattctccggatcaggatcaggtacagacttcacattaacaatatcatcactacaaccagaagacttcgccacatattactgccaacaacacttttcctccccacgaacattcggacaaggaacaaaagtagaaataaaaagaacagtagcagcaccatcagtatttatattcccaccatcagacgaacaactaaaatcaggcacagcctcagtagtatgcttattaaacaacttttacccacgagaagccaaagtacaatggaaagtagacaacgcactacaatcaggaaactcacaagaatcagtaacagaacaagattccaaagattcaacatactcattatcctcaacactaacactatcaaaagcagactacgaaaaacacaaagtatacgcatgcgaagtcacacaccaaggattatcatcaccatgcacaaaatctttcaacagaggagaatgc

SEQ ID NO: 46710 - RNA, 1338 nt, synthetic construct
  misc_feature 1..1338: note = derived and/or modified sequence opt6 from ThioMAb-huMA79b.v17-HC(A118C)_HeavyChain
  source 1..1338: mol_type = other RNA
gaagtccaactagtagaatcaggaggaggcctagtacaacccggtggatcactcagactatcgtgcgcagcatctggatacactttcagttcatactggatagaatgggtacgacaagcaccaggaaaaggattagaatggatcggagaaatactaccaggaggaggtgatactaattacaacgaaattttcaaaggacgagcaactttctcagctgacacaagcaaaaatacagcatacttacaaatgaactcattaagagcagaggacacagcagtttactactgcacaagaagagtaccagtatacttcgattactggggacaaggaacattagttacagtttcatcatgttcaacaaaaggaccaagcgtattcccactagctcccagttcaaaatcaacatccggaggaacagcagcactaggatgtcttgtaaaagattatttcccagaaccagttactgtctcatggaactcaggtgcactcacatcaggagttcacacattcccagcagtattacaatcatcaggactatactcactatcatcagtagtaacagtaccatcatcctcgttaggaacacaaacctatatctgcaatgtaaatcacaaaccatcaaacacaaaagtagacaaaaaagtagaacccaaatcatgcgataaaacacacacatgcccaccatgtccagcaccagagttattaggaggtccatcagttttcctattcccaccaaaaccaaaagataccttaatgatatcaagaacaccagaagtaacatgcgtagtcgtagatgtatcacacgaagatccagaagtaaaattcaattggtacgtagacggcgtagaagtccataatgcaaaaacaaaaccaagagaagaacaatacaattcaacatacagggtagtatcagtcctaacagtacttcatcaagattggctcaacggaaaagaatacaaatgcaaagtatcaaataaagcattacctgccccaattgaaaaaactatatctaaagcaaaaggacaaccaagagaaccacaagtatacaccttaccaccttcacgagaagaaatgacaaaaaatcaagtatcattaacatgcctagtaaaaggattctacccatcagacatagccgtcgaatgggaatctaacggacaacccgaaaacaattataaaacaactccaccagtcctagacagcgatggttcattcttcctttacagcaaattaacagtagataaatcgagatggcaacaaggaaacgtattttcatgttcagtcatgcatgaagccttacacaaccactatacacaaaaatcattaagcttaagcccagga

SEQ ID NO: 46711 - RNA, 654 nt, synthetic construct
  misc_feature 1..654: note = derived and/or modified sequence opt6 from ThioMAb-huMA79b.v17-HC(A118C)_LightChain
  source 1..654: mol_type = other RNA
gacatacaactaacacaatcaccatcatcactaagtgcatcagtaggagaccgagtaaccataacatgcaaagcatcccaatcagtagactatgatggcgactcattcttaaactggtaccaacaaaaaccaggaaaagcaccaaaactattaatatacgcagcatcaaacctagaatcaggagtaccatcaagattctcaggatcaggatccggaacagacttcacactaaccatatcatcactacaaccagaagacttcgcaacatactactgccaacaatcaaacgaagacccactaacatttggacaaggaacaaaagtagaaataaaaagaacagtcgcagcaccatccgtattcatattcccaccatctgacgaacaactaaaatcaggaacagcatcagtagtatgcctattaaacaacttctacccacgagaagcaaaagtacaatggaaagtagacaacgcactacaatccggaaactcacaagaatccgtaacagaacaagactcaaaagactccacctattcattatcctccaccctaacactatcaaaagccgactacgaaaaacacaaagtatacgcatgcgaagtaacacaccaaggactatcctcaccagtcacaaaatcattcaaccgaggagaatgc

SEQ ID NO: 46712 - RNA, 1338 nt, synthetic construct
  misc_feature 1..1338: note = derived and/or modified sequence opt6 from ThioMAb-huMA79b.v18-HC(A118C)_HeavyChain
  source 1..1338: mol_type = other RNA
gaagtacaattagtagaatccggcggtggattagttcaaccaggaggttcactaagactatcttgcgcagcatccggttacactttcagctcttattggatagaatgggtacgacaagcaccaggtaaaggactagaatggataggcgaaatactaccaggaggtggagacactaactataacgaaatatttaaaggaagagcaacattttccgctgacactagtaaaaatacagcatacctacaaatgaacagtctccgagccgaagatacagcagtatactactgtacaagaagagtaccaatcagattagattattggggacaaggaacactagtaacagtatcgtcatgtagtacaaaaggacctagtgtatttccactagcaccttcatcaaaatctacatcaggaggaacagcagcactaggatgcttagtaaaagactactttccagaacccgtaacagtttcatggaactcaggagcactcacatcaggagtacatacattcccagctgtattacaatcttcaggcctttattcactaagttctgtagtaacagttccttcatctagtctcggaactcaaacttatatatgcaatgtaaaccataaaccatcaaacacaaaagtagataaaaaagtagaaccaaaaagttgtgacaaaacacatacatgtccaccatgcccagcacctgaactcttaggaggaccaagtgtatttttattcccaccaaaaccaaaagacactttaatgatatcaagaacacctgaagtaacatgcgtagtagtagatgtctcacatgaagaccctgaagtcaaattcaattggtatgtagatggagttgaagtacacaacgcaaaaacaaaaccccgagaggaacaatataactcaacatatcgcgtcgtttcagtattaacagttctccatcaagattggttaaatggaaaagaatataaatgcaaagtatcaaataaagcactacccgcaccaatagaaaaaacaatttccaaagctaaaggtcaacctcgcgaaccacaagtatacacacttccaccaagcagagaagaaatgacaaaaaaccaagtttctctaacatgtttagtaaaaggtttttacccatcagatatagcagtagaatgggaatcaaacggacaacccgaaaacaactataagacaaccccaccagtactagattcagacggatcatttttcttatactctaaacttacagtagacaaaagcaggtggcaacaaggtaacgttttctcatgttcagtaatgcatgaagcattacacaatcattacacccaaaaaagcttatcactatcacctgga

SEQ ID NO: 46713 - RNA, 654 nt, synthetic construct
  misc_feature 1..654: note = derived and/or modified sequence opt6 from ThioMAb-huMA79b.v28-HC(A118C)_LightChain
  source 1..654: mol_type = other RNA
gacatacaactaacacaatcaccctcatcactatcagcatcagtcggagaccgagtaacaataacatgcaaagcatcccaatcagtagactacgaaggagactcattcttaaactggtatcaacaaaaaccaggaaaagcaccaaaactactaatatacgcagcatcaaacttagaatcaggagtaccttcaagattctcaggatcaggatcaggaacagacttcacactaaccatatcatcacttcaaccagaagacttcgccacatattactgccaacaatcaaacgaagacccactaacattcggacaaggaacaaaagtagaaataaaaagaacagtagcagcaccatcagtattcatatttccaccatcagacgaacaactaaaatcaggaacagcatccgtcgtatgcctactaaacaacttctacccacgagaagcaaaagtacaatggaaagtagacaacgcactacaatcaggaaactcacaagaatcagtaacagaacaagactcaaaagactcaacatatagcttatcatccacactaacactatccaaagccgactacgaaaaacataaagtatacgcatgcgaagtaacacaccaaggactatcatcaccagtaactaaatccttcaatagaggagaatgc

SEQ ID NO: 46714 - RNA, 654 nt, synthetic construct
  misc_feature 1..654: note = derived and/or modified sequence opt6 from ThioMAb-huMA79b.v28-LC(V205C)_LightChain
  source 1..654: mol_type = other RNA
gacatagtactcacacaatcaccagcatcactagcagtatcactaggccaaagagcaacaatatcatgcaaagcatcccaatcagtagactacgacggagactcattcctaaactggtaccaacaaaaaccaggccaaccaccaaaactctttatatacgcagcatcaaacttagaatcaggaataccagcaagattctcaggatcaggatcaggaacagacttcacactaaacatacacccagtagaagaagaagacgccgccacatactactgccaacaatcaaacgaagaccccctaacatttggcgcaggaacagaattagaactaaaacgaacagtagcagcaccaagcgtattcatattcccaccatcagacgaacaactaaaatcaggaacagcatcagtagtatgcttactaaacaacttctatccaagagaagcaaaagtacaatggaaagtagacaacgcactacaatcaggaaactcacaagaatcagtaaccgaacaagacagcaaagactcaacatactctctatcatcaacattaacactatccaaagcagactacgaaaaacacaaagtctacgcatgtgaagtaacacaccaaggattatcatcaccatgcacaaaatcattcaacagaggagaatgc

SEQ ID NO: 46715 - RNA, 1332 nt, synthetic construct
  misc_feature 1..1332: note = derived and/or modified sequence opt6 from Ticiliuab_HeavyChain1
  source 1..1332: mol_type = other RNA
caagtacaactcgtagaatcaggaggaggagttgtacaaccaggaagatctctaagattatcatgcgcagcatcaggatttacatttagctcatatggacactgggtaagacaagctccaggaaaaggattagaatgggtagcagtaatctggtacgatggatctaacaaatattatgcagacagcgtaaaaggaagatttaccatatcaagagacaattccaaaaacacactatatctacaaaactccttaagagccgaagacacagcagtttactattgcgctcgcgatccaagaggggcaactctatactattactattacggtgatgtatggggtcaaggaacaacagtaacagtatcatctgcttcaacaaaaggaccaagtgtatttccactagccccatgctcaagatcaacatctgaatctacagccgcattaggatgtctagtaaaagattactttccagaaccagtaacagttagctggaactccggagcactaacctcaggagtccatacattccctgcagtactacaatcatcaggtctatacagcttatcctcagtcgtaacagttccttcatcaaactttggaacacaaacatatacatgcaatgtagatcataaaccttccaatactaaggtagataaaacagtcgagagaaaatgctgtgtagaatgtccaccatgtccagcacctcctgtagcaggaccttcagtattcttattcccaccaaaaccaaaagacacacttatttcaagaaccccggaagtaacatgcgtagtagtagacgtaagccatgaagaccctgaagtacaattcaactggtacgtagacggagtagaagtacacaacgcaaaaactaaaccacgagaagaacaatttaatagcacattcagagtagtaagcgttctaacagtagtacaccaagactggctaaacggaaaagaatataaatgcaaagtatccaataaaggattaccagcaccaattgagaaaactatatcaaaaacaaaaggacaaccacgagaaccacaagtatacacattaccaccatcaagagaagaaactaaaaaccaagtatcattaacatgcctagtaaaaggattttacccatcagatatcgctgtagaatgggaatcaaatggacaacctgaaaacaattacaaaacaacaccaccactcgactcagatggatcattcttcctatattcaaaattaacagtagataaatccagatggcaacaaggcaatgtattttcctgtagcgtccacgaagcattacataatcattatactcaaaaatctctctcattatctcctggtaaa

SEQ ID NO: 46716 - RNA, 639 nt, synthetic construct
  misc_feature 1..639: note = derived and/or modified sequence opt6 from Ticiliuab_LightChain1
  source 1..639: mol_type = other RNA
gacatacaaacccaatcaccatcatcactctcagcatcagtaggagacagagtaacaataacatgcagagcatcacaatcaataaattcatacttagactggtaccaacaaaaaccaggaaaagcaccaaaactattaatctacgctgcatcctcactacaatcaggagtaccaagcagattctcaggctccggatcaggaacagactttactctaaccatatcatcacttcaaccagaagatttcgcaacatactactgccaacaatactactcaacaccattcacattcggaccaggaacaaaagtcgaaatcaaaagaacagtcgcagcaccatcagtatttatattcccaccttcagacgaacaactaaaatcaggaacagcatcagtagtatgcctactaaacaacttctacccacgagaagcaaaagtacaatggaaagtagacaacgcactacaatcaggaaactcacaagaatcagtaacagaacaagactccaaagactcaacatactcactatcatcaacactaacactatccaaagcagactacgaaaaacataaagtatacgcatgcgaagtaacacaccaaggactatcatcaccagtaacaaaatcattcaacagaggcgaatgc

SEQ ID NO: 46717 - RNA, 1347 nt, synthetic construct
  misc_feature 1..1347: note = derived and/or modified sequence opt6 from Tigatuzumab_HeavyChain1
  source 1..1347: mol_type = other RNA
gaagtacagctagtagaatcaggaggtggtttagtacaaccaggcggaagcctaagactatcatgcgcagcatcaggattcacattcagctcatacgtaatgtcatgggtacgtcaagcacccggaaaaggactagaatgggtagccacaatctcctcaggcggatcatatacatattatccagactcagtaaaaggtagattcacaatatccagagacaatgcaaaaaatacactatacctacaaatgaattcactaagagcagaagatacagcagtatattactgtgcaagaagaggcgactcaatgataacaacagactattggggacaaggaaccctagtcacagtcagttcagcatcaactaaaggaccatccgtattccccttagcaccttcatcaaaatcaacatcaggaggaacagctgcattaggatgtctagtcaaagattatttcccagaacccgtaaccgtctcttggaattccggcgccctaacaagcggtgtccatacctttccagctgttttacaatcatcaggactatacagcctatcctcagtagttacagtaccatcatcatccttaggtacacaaacatacatatgcaatgtaaatcacaaaccatccaatacaaaagtagacaaaagagtagaaccaaaatcttgcgacaaaacacatacctgccccccatgcccagctccagaactattaggaggcccctccgtttttttatttccaccaaaaccaaaagatactttaatgatatcacgaacccccgaagtaacatgcgtagtcgtagacgtatcacatgaagatccagaagtaaaattcaactggtacgtagatggagtcgaagtccacaatgcaaaaacaaaaccacgagaagaacaatacaattccacttacagagtagtttcagtactaacagtcctacaccaagactggcttaacggaaaagaatacaaatgcaaagtatcaaataaagcattacccgcacccatagaaaaaacaataagtaaagccaaaggccaaccacgtgaaccacaagtatacacattacctccatctagagaagaaatgaccaaaaatcaagtatccttaacatgcctcgtaaaaggattctacccttcagacatagcagtagaatgggaaagtaacggacaacccgaaaataactacaaaacaacacctcccgtattagattccgacggtagtttcttcctttattctaaattaacagtagacaaatcaagatggcaacaaggaaacgtattctcatgctcagtaatgcacgaagcattacacaaccattacacacaaaaatcactatccctatctccaggaaaa

SEQ ID NO: 46718 - RNA, 1347 nt, synthetic construct
  misc_feature 1..1347: note = derived and/or modified sequence opt6 from Tigatuzumab_HeavyChain
  source 1..1347: mol_type = other RNA
gaagtacaactagtagaatcgggcggaggactagtacaaccaggaggatcactaagactttcatgcgcagcatcaggattcacatttagttcatatgtaatgtcatgggttagacaagcacccggaaaaggattagaatgggtagcaaccatttcatcagggggatcatacacctattatccagatagtgtgaaaggaagatttacaatttccagggataacgcaaaaaacacattatatctacaaatgaactcactaagagcagaagacacagccgtatattactgtgcaagaagaggtgacagcatgataacaactgactactggggacaaggaaccctagtaacagtatcaagtgcaagcacaaaaggcccatcagtattcccattagccccttcctcaaaatcaacatccggtggaacagccgccttaggatgcctagtcaaagattacttcccggaaccagtaacagtatcatggaatagtggcgctttaactagtggagtacatacatttccagcagtattacaatcctcaggattatactcattatcatcagtagtaacagtaccatcaagctccctaggtacacaaacatacatatgcaacgtaaaccataaaccttcaaatacaaaagtagataaaagagtagaaccaaaaagctgtgacaaaacacacacctgtccaccatgtccagcaccagaactcctaggaggcccctcagtattccttttccctccaaaacccaaagatacactaatgatatcaagaacacccgaagtaacatgcgtagtagtcgacgtatcacacgaagaccccgaagtaaaattcaactggtatgtagacggagtagaagtacacaacgcaaaaacaaaaccaagagaagaacagtacaactcaacatatagagtcgtatctgtattaacagttttacatcaagattggcttaacggcaaagaatacaagtgtaaagtatcaaacaaagcattacctgcaccaatagaaaaaacaatctccaaagcaaaaggacaaccaagagaacctcaagtatacacactaccaccatctagagaagaaatgacaaaaaatcaagtatcattaacatgccttgtaaaaggattttacccatcagacatcgcagtagaatgggaatcaaatggacaaccagaaaacaattataaaacaactcctcctgtattagactcagacggatcttttttcttatactctaaactcaccgtagataaatcacgttggcaacaaggaaacgtattcagctgttcagttatgcatgaagctctacataaccactacacacaaaagtcactatcactatccccaggtaaa

SEQ ID NO: 46719 - RNA, 639 nt, synthetic construct
  misc_feature 1..639: note = derived and/or modified sequence opt6 from Tigatuzumab_LightChain1
  source 1..639: mol_type = other RNA
gatatacaaatgacacaatcaccctcatcactatcagcatcagtaggagacagagtaacaataacatgtaaagcatcacaagatgtaggaaccgcagtagcatggtaccaacaaaaacccggaaaagcaccaaaactactaatctactgggcatcaacaagacacacaggagtaccatcaagattcagcggatcaggatcaggaacagacttcacactaacaatatcatcactacaaccagaagacttcgcaacatattactgccaacaatactcaagctaccgaacattcggacaaggaacaaaagtagaaatcaaaagaacagtagcggcaccatcagtattcatattcccaccatcagacgaacaattaaaatcaggaacagcatcagtagtatgcctcttaaacaacttctaccccagagaagccaaagtacaatggaaagtagacaacgcactacaatcaggaaactcacaagaatcagtaaccgaacaagacagcaaagactcaacatactcactatcatcaacattaacattaagtaaagcagactacgaaaaacacaaagtatacgcatgcgaagtcacacaccaaggactaagctcaccagtaacaaaatcattcaacagaggcgaatgc

SEQ ID NO: 46720 - RNA, 639 nt, synthetic construct
  misc_feature 1..639: note = derived and/or modified sequence opt6 from Tigatuzumab_LightChain
  source 1..639: mol_type = other RNA
gacatacaaatgacacaatcaccatcatccctatcagcatctgtaggagacagagtaacaataacatgcaaagcatcacaagacgtaggaacagcagtcgcatggtaccaacaaaaaccaggcaaagcaccaaaattactaatatactgggcatcaacaagacacacaggagtaccatcaagattctcaggatcaggatcaggaaccgacttcacactaacaatatcatcattacaacccgaagatttcgcaacatactactgccaacaatactcatcatacagaacattcggacaaggaacaaaagtagaaataaaacgaacagtagcagcaccatccgtatttatattcccaccatcagacgaacaattaaaatcaggcacagcatcagtagtatgcctactaaacaacttctacccaagagaagcaaaagtacaatggaaagtagacaacgcattacaatcaggaaactcacaagaatcagtaactgaacaagactcaaaagactcaacatactcactatcatcaacattaaccctatcaaaagccgactacgaaaaacataaagtatacgcatgcgaagtaacacaccaaggactatcatcaccagtaacaaaaagcttcaacagaggagaatgc

SEQ ID NO: 46721 - RNA, 1338 nt, synthetic construct
  misc_feature 1..1338: note = derived and/or modified sequence opt6 from Tildrakizumab_HeavyChain1
  source 1..1338: mol_type = other RNA
caagtccaactggtacaatcaggagcagaagtaaaaaaacccggcgcatcagtcaaagtaagctgcaaagcatcaggatacatctttataacatattggatgacttgggtaagacaagccccaggacaagggctagaatggatgggccaaatattcccagcctcaggatcagccgattacaacgaaaaatttgaaggtagagtaacaatgacaacagacacatcaacttccacagcatatatggaactaagatcactaagatctgatgacacagcagtttactactgtgcaagagggggaggcggattcgcatactggggccaaggtactctagttacagtctcctcagcctcaacaaaaggcccatcagtattcccattagcaccatcatccaaatcaacaagtggaggaaccgcagcattaggctgccttgtaaaagactattttccagaaccagtaacagtctcatggaactcaggagcattaacttccggcgtacacacattccctgctgtactacaatcatccggactttactctttatcctctgttgtaacagtccctagctcatcattaggaacacaaacctatatttgtaatgtcaaccataaaccatcaaacaccaaagtagacaaaaaagtcgaaccaaaatcatgcgataaaacacacacatgcccaccctgtccagcacccgaactattaggcggaccatcagtatttctattccccccaaaaccaaaagacacattaatgatatcaagaactccagaagtaacatgtgtagtagtcgacgtatcacatgaagatccagaagtaaaattcaactggtacgtcgatggagttgaagtacataacgcaaaaacaaaaccaagagaagaacaatataactcaacctacagagtcgtatccgtcctaaccgtattacatcaagactggttaaatggtaaggaatataaatgcaaagtatcaaacaaagcactaccagccccaatagaaaaaaccatatcaaaagcaaaaggacaaccaagagaaccacaagtatacacattaccaccaagtcgcgatgaattaactaaaaatcaagtctcactaacatgtcttgtcaaaggcttctatccctcagacattgcagtagaatgggaatccaatggacaacccgaaaataactataaaacaacaccacccgtacttgattcagacggttcattcttcctatactctaaactcacagtagacaaatcacgctggcaacaaggaaacgtattttcttgttcagtaatgcatgaagcactccacaaccattacacacaaaaatcattatcattaagcccaggaaaa

SEQ ID NO: 46722 - RNA, 642 nt, synthetic construct
  misc_feature 1..642: note = derived and/or modified sequence opt6 from Tildrakizumab_LightChain1
  source 1..642: mol_type = other RNA
gacatacaaatgacacaatcaccatcatcactatcagcatcagtaggagacagagtaacaataacatgcagaacatcagaaaacatatactcatacctagcatggtaccaacaaaaacccggaaaagcaccaaaactactaatatacaacgcaaaaacactagcagaaggagtaccaagcagattctcaggatcaggctcaggaacagacttcacattaaccatatcatcactacaaccagaagacttcgcaacatactactgccaacaccactacggaataccattcacattcggacaaggaacaaaagtcgaaataaaacgaacagtagcagcaccaagcgtattcatattcccaccatcagacgaacaactaaaatcaggaacagcatcagtagtatgcctactaaacaatttctacccaagagaagcaaaagtacaatggaaagtagacaacgcactacaatctggaaactcacaagaatcagtaacagaacaagacagcaaagactccacatactcactatcatcaacactaacactatcaaaagcagactacgaaaaacataaagtatacgcatgcgaagtaacccaccaaggactatcatcaccagtaacaaaaagcttcaacagaggagaatgc

SEQ ID NO: 46723 - RNA, 1344 nt, synthetic construct
  misc_feature 1..1344: note = derived and/or modified sequence opt6 from Tisotumab_vedotin_HeavyChain1
  source 1..1344: mol_type = other RNA
gaagtacaactattagaatccggaggaggactagttcaaccaggaggctcactacgtttaagctgtgcagcatcaggatttacattcagcaattacgctatgtcatgggtaagacaagcaccaggaaaaggactagaatgggtttcaagtatctctggttccggcgattacacatactataccgacagtgtaaaaggaagattcactatctcacgagataattcaaaaaacaccttatatctccaaatgaactcattaagagcagaagacacagcagtatactactgtgcacgatcaccttggggatattacttagactcttggggacaaggaacactagtaaccgttagcagcgcttctaccaagggaccatcagtatttccactcgctccttcatctaaatcaacttcaggaggaacagcagcactaggatgtctagtaaaagattactttccagaaccagtaacagtatcatggaactcaggagcactaacctcaggcgtccatacattcccagcagtattacaatcatcaggcttatattccttatcaagtgtcgtaaccgtaccatcatcatcactaggaacacaaacctatatatgcaacgtaaatcataaaccatctaatacaaaagtagacaaacgcgtcgaaccaaaatcatgcgacaaaacccacacatgcccaccatgcccagcaccagaactactaggaggaccatcagtattcctttttccaccaaaacccaaagacacattaatgatatcccgtacaccagaggtaacctgcgttgtagtagacgtaagccacgaagacccagaagtaaaatttaactggtatgtagacggagtcgaagtacacaacgcaaaaacaaaaccacgagaagaacaatacaactctacatacagagtagtttccgtcctaacagttttacaccaagactggctaaacggaaaagaatataaatgcaaagtaagtaacaaagcactaccagccccaatagaaaaaacaataagcaaagctaaaggacaaccacgagaaccacaagtttatacacttccaccttcaagagaagaaatgactaaaaatcaagtatcattaacctgcttagtaaaaggattttatccatcagacatagctgtagaatgggaatctaacggacaaccagaaaacaactataaaacaactccccctgtactcgactcagatggaagtttctttttatattccaaacttaccgtagataaatcaagatggcaacaaggaaacgttttctcatgcagtgtaatgcatgaagcattacacaaccactacacacaaaaatccctatctttatcaccaggaaaa

SEQ ID NO: 46724 - RNA, 642 nt, synthetic construct
  misc_feature 1..642: note = derived and/or modified sequence opt6 from Tisotumab_vedotin_LightChain1
  source 1..642: mol_type = other RNA
gacatacaaatgacacaatcaccaccatcactatccgcctcagctggagaccgagtaacaataacatgccgagcatcacaaggaatatcatcaagactagcatggtaccaacaaaaaccagaaaaagcaccaaaatcactaatctacgccgcctcatcactacaatccggagtaccatcaagattctctggttcaggatcaggaacagacttcacattaacaatatcatcactccaaccagaagacttcgcaacatattactgccaacaatacaactcatacccatacacattcggacaaggaacaaaactcgaaatcaaacgaacagtagcagcaccatcagtattcatcttcccaccatcagatgaacaactaaaatcaggaacagcctccgtagtctgcctactaaacaacttctaccccagagaagccaaagtacaatggaaagtagataacgcactccaatcaggaaactcacaagaatcagtaacagaacaagactcaaaagactcaacatactcactatcctcaacactaacattatcaaaagcagactacgaaaaacacaaagtatatgcatgcgaagtaacacaccaaggattatcatcacccgtaacaaaatcattcaacagaggagaatgc

SEQ ID NO: 46725 - RNA, 1341 nt, synthetic construct
  misc_feature 1..1341: note = derived and/or modified sequence opt6 from Tocilizumab_HeavyChain1
  source 1..1341: mol_type = other RNA
gtccaattacaagaatcaggtccaggactcgtaagaccatcacaaacattatcattaacctgtacagtatcaggatactcaataacttctgaccacgcctggtcatgggtaagacagccacccggacgtggcctagaatggataggttatatatcatactcaggaataaccacatacaacccatcattaaaatctagagttacaatgctacgagatacatccaaaaatcaattctcattaagactatcttcagtaaccgccgcagacaccgccgtctattactgcgcacgatcgctagcacgaacaactgcaatggactactggggtcaaggatcactagttacagtctcctcagcatcaacaaaaggaccatcagtattcccattagccccctcctcaaaatcaacctcaggcggaaccgccgcattaggatgtttagtaaaagactatttccccgaaccagtaacagtatcatggaactctggagcattaacatctggcgttcatacatttcctgcagtacttcaatcatcaggactatactccttatcatctgtagtaacagttccctcctcatcactaggaacacaaacatacatctgtaacgtaaaccataaaccatctaatacaaaagttgacaaaaaagtagaaccaaaatcttgcgacaaaacacacacctgtccaccctgtccagcaccagaattactaggaggaccctcagtatttttattcccaccaaaaccaaaagatacactaatgataagtagaaccccagaagtaacatgcgtcgtagtcgacgtttcacatgaagaccctgaagtaaaattcaactggtatgtcgacggagttgaagtccacaacgcaaaaaccaaaccaagagaagaacaatacaattcaacctaccgagtagtctctgtactcactgtactacatcaagattggctaaacggaaaagaatacaaatgcaaagtaagcaataaagcactacctgcaccaatcgaaaaaactatatccaaagcaaaaggacaaccacgagaaccacaagtttacacactcccacctagcagagacgaactaacaaaaaatcaagtatcacttacttgcctagtaaaaggattctacccttcagatatagcagtagaatgggaatcaaacggtcaaccagaaaataactacaaaacaacaccaccagtcctagactcagacggatcttttttcctatattctaaacttactgtcgataaatcaagatggcaacaaggtaacgtcttttcatgctcagttatgcacgaagcactacacaaccactacacacaaaaaagcttatcactatcaccagga

SEQ ID NO: 46726 - RNA, 642 nt, synthetic construct
  misc_feature 1..642: note = derived and/or modified sequence opt6 from Tocilizumab_LightChain1
  source 1..642: mol_type = other RNA
gacatacaaatgacacaatcaccttcatcactatcagcatccgtaggagaccgagtaacaataacctgccgagcatcccaagacatatcatcatacttaaactggtaccaacaaaaaccaggaaaagcaccaaaactactaatatattacacatccagactccactcaggagttccatcaagattctcaggatcaggatcaggaacagacttcacattcacaatatcatcactacaaccagaagacatagcaacatactactgccaacaaggaaatacactaccatacacattcggacaaggaacaaaagtcgaaataaaaagaacagtagcagccccatcagtattcatattcccaccatcagacgaacaactaaaatcaggaacagcctcagtcgtatgcctactaaacaacttctaccctagagaagcaaaagtacaatggaaagtagacaacgcactacaatcaggaaactcccaagaatcagtaacagaacaagactccaaagactcaacatactccctatcatcaacactaaccctatcaaaagcagactacgaaaaacacaaagtatacgcatgcgaagtaacacaccaaggactatcatcaccagtaacaaaatcattcaaccgaggagaatgc

SEQ ID NO: 46727 - RNA, 1353 nt, synthetic construct
  misc_feature 1..1353: note = derived and/or modified sequence opt6 from Tosatoxumab_HeavyChain1
  source 1..1353: mol_type = other RNA
gaagtacaaatggtacaatcaggagcagaagtcaaaaaaccaggagaaccattaaaaataagctgcaaaggatcaggatacaaatttggaacacactggataggttgggtaagacaaagaccaggcaaaggactagaatggatgggaataatccacccagccgatagtgaaaccaaatactctccatcattccaaggacaagtatcattttcagcagataaatcatcaaacactgcctatcttcattggagtacacttagagcatcagatactgcaatgtattactgcgcaagaagatcaggatcatcaagctggtatgctctagacttctggggacagggtacaatggtaacagtaagttcagcttcaaccaaaggaccatcagtatttcccctagctccatcatctaagtctacatcaggaggaacagcagcattaggatgcttagtaaaagactatttcccagaaccagtcacagtaagctggaatagtggagctttaacttcaggagtacatacatttccagctgtattacaatcatctggactatattccctatcatcagtagtcacagtaccttcatcctcactgggcacacaaacatacatatgcaatgtaaaccacaaaccctctaatacaaaagtcgacaaacgtgtagaacccaaatcatgcgataaaacacacacatgtcccccatgcccagcacctgaactcctaggaggaccatcagtttttctattcccacctaaaccaaaagatacactaatgatatctcgaaccccagaagtaacatgcgttgtagtagacgtatcacacgaagacccagaagtcaaattcaactggtatgtagacggtgtagaagtccataacgcaaaaactaaaccaagagaagaacaatataacagtacatacagagtagtttcagttttaactgtactacatcaagactggctaaacggaaaagaatacaaatgtaaagtttcaaataaagccttacctgctcccatagaaaaaacaataagtaaagcaaaaggacaaccaagagaaccacaagtatataccttgccaccttcacgagaagaaatgacaaaaaatcaagtcagcttaacctgcttagtaaaaggattctatccatcagacatagcagtagaatgggaaagcaacggtcaaccagaaaataactataaaacaactccacctgtattagactcagatggatccttcttcttatactcaaaactaaccgtggataaatcacgatggcaacaaggaaacgtattctcatgttcagttatgcacgaagcactacataaccattacacccaaaaaagcttatcactatcaccaggaaaa

SEQ ID NO: 46728 - RNA, 651 nt, synthetic construct
  misc_feature 1..651: note = derived and/or modified sequence opt6 from Tosatoxumab_LightChain1
  source 1..651: mol_type = other RNA
caatcagtactaacacaatcaccatccgcatcaggaacaccaggacaaagagtaacaatatcctgctcaggaggaagctcaaacataggatcaaacacagtaaactggtaccaacaatttccaggagcagccccaaaactactaatatacacaaacaaccaaagaccatccggagtaccagacagattctcaggatctaaatcaggaacatcagcatcactagcaatatcaggactacaatcagaagacgaagcagactactactgcgcaacatgggatgactcactaaacggactatacgtcttcggaacaggaacaaaagtaacagtactaggacaaccaaaagcaaacccaacagtaaccctattcccaccatcatcagaagaactacaagcaaacaaagccacactagtatgcttaatatcagacttctacccaggagcagtaacagtagcatggaaagccgacggatcaccagtaaaagcaggagtagaaacaacaaaaccatccaaacaatcaaacaataaatacgcagcttcatcatacttatcattaaccccagaacaatggaaatcacaccgatcatactcatgccaagtcacacacgaaggatccacagtcgaaaaaacagtagcaccaacagaatgctca

SEQ ID NO: 46729 - RNA, 1341 nt, synthetic construct
  misc_feature 1..1341: note = derived and/or modified sequence opt6 from Tositumomab_HeavyChain
  source 1..1341: mol_type = other RNA
caagcatacctacaacaatcaggtgctgaattagtaagaccaggcgcatcagtcaaaatgtcatgtaaagcttcaggatatacatttacttcttacaacatgcattgggtaaaacaaaccccccgacaaggactcgaatggatcggagcaatatacccaggaaacggagacacatcatataaccaaaaattcaaaggaaaagcaaccttaacagttgacaaatcatcctccacagcctatatgcaattatcatcactaacatcagaagattcagccgtctatttttgtgccagagtagtatattactccaattcatattggtacttcgatgtatggggcacaggaacaacagtaacagtctcaggaccctcagtatttccactagcaccttcctctaaatctacatccggaggcacagccgccttaggatgcttagttaaagactattttcccgaacccgttacagtctcctggaactcaggagcactcactagtggagtacatacattccctgcagtactacaatcttccggactttattcattatcatcagtagtcacagtaccatctagctccctaggaacccaaacctacatatgcaacgtaaaccacaaaccatcaaacacaaaagtagataaaaaagctgaaccaaaatcatgcgataaaacacacacttgtccaccatgccccgcacccgaattactaggaggaccatcagtatttttatttccaccaaaaccaaaagacacactaatgatatccagaaccccagaagtaacctgcgtagtcgtcgatgtatcccacgaagatccagaagtcaaattcaactggtatgtcgatggtgttgaagtccacaatgcaaaaaccaaaccaagagaagaacaatacaactcaacctatcgagtagtctctgtattaaccgttctacaccaagactggcttaacggcaaagaatacaaatgcaaagtaagtaacaaagctttaccagcaccaatcgaaaaaacaatttcaaaagcaaaaggacaaccaagagaaccacaagtatacacattacctccatcaagagacgaactaacaaaaaaccaagtctcattaacatgtctcgtaaaaggcttctacccatcagatatagcagtcgaatgggaatccaacggacaaccagaaaataactacaaaaccacaccacccgtattagactcagacggttcattcttcttatactcaaaattaaccgtagacaaaagcagatggcaacaaggaaacgtcttctcatgctcagttatgcacgaagcccttcacaaccactacacacaaaaatcattatcactatcacctggcaaa

SEQ ID NO: 46730 - RNA, 630 nt, synthetic construct
  misc_feature 1..630: note = derived and/or modified sequence opt6 from Tositumomab_LightChain
  source 1..630: mol_type = other RNA
caaatagtactatcacaatcaccagcaatactatcagcatcacctggcgaaaaagtaacaatgacatgcagagcatcttcatcagtatcatacatgcactggtaccaacaaaaacctggatcttcaccaaaaccatggatatacgcaccatccaacttagcatcaggagtaccagcaagattctcaggatccggatcaggaacatcatactcactaacaatatcacgagtcgaagcagaagacgcagcaacatactactgccaacaatggtccttcaacccaccaacattcggagcaggaacaaaactagaactaaaacgaacagtagcagcaccatcagtattcatattcccaccatcagatgaacaactaaaatcaggaaccgcatcagtagtatgcctactcaacaacttctacccccgcgaagcaaaagtacaatggaaagtagacaacgcattacaatcaggaaactcacaagaatctgtaacagaacaagactcaaaagactcaacatactcactatcatcaacattaacattatccaaagcagactatgaaaaacacaaagtatacgcatgcgaagtaacacaccaaggactatcctcacccgtaacaaaatcattcaacaga

SEQ ID NO: 46731 - RNA, 1338 nt, synthetic construct
  misc_feature 1..1338: note = derived and/or modified sequence opt6 from Tovetumab_HeavyChain1
  source 1..1338: mol_type = other RNA
caagtacaattagttgaatcaggaggaggattagtcaaacccggaggatctttaagactatcttgtgcagcttctgggtttacattctcagattattacatgaattggataagacaagcaccaggcaaaggtttagaatgggtatcatacatttcaagttcaggatctattatctattacgcagactctgtcaaaggcagattcacaatatcaagagataatgcaaaaaattccttatacttacaaatgaactcactaagagctgaagatacagcagtttattattgcgcaagagaaggaagaattgcagcacgaggaatggacgtatggggacaaggaacaactgtaactgtatcctcagccagcacaaaaggaccctcagtatttccattagcaccctgctcaagatctacaagtgaatcaactgcagcattaggctgcctagtaaaagactacttcccagaaccagtaaccgtcagttggaactcaggagcattaacatcaggtgtacatactttccctgcagtactacaaagctcaggtttatattcattatcatcagtagtcacagtaccatcctcaaatttcgggacccaaacctatacatgtaatgttgaccataaaccatccaatactaaagtcgataaaacagttgaaagaaaatgttgtgtagaatgccctccatgtcccgcacccccagttgcaggcccatcagtatttttgttcccaccaaaaccaaaagacactttaatgatatcaagaacaccagaagtaacatgtgtagtagtagacgtgtctcacgaagacccagaagttcaatttaattggtacgtagatggagtagaagttcataacgccaaaacaaaaccaagagaagaacaatttaattcaacattcagagtagtatctgtccttactgtggtacatcaagactggttaaatggaaaagaatacaaatgcaaagtatcaaataaaggattaccagccccaattgaaaaaaccatatcaaaaactaaaggtcaaccacgagaacctcaagtatacacactaccaccatctcgcgaagaaatgacaaaaaatcaagtctcactcacttgcttagttaaaggcttttatccatcagacattgcagtagaatgggaaagcaacggacaacccgaaaataattataaaaccactccaccaatgctagattcagacggaagttttttcttatacagcaaactaactgtagacaaatcaagatggcaacaaggaaacgttttttcttgctcagtcatgcacgaagcattacacaatcattatacacaaaaaagtttatcattatcaccaggaaaa

SEQ ID NO: 46732 - RNA, 645 nt, synthetic construct
  misc_feature 1..645: note = derived and/or modified sequence opt6 from Tovetumab_LightChain1
  source 1..645: mol_type = other RNA
gacatccaaatgacacaatcaccatcatcactttcagcatcagtaggagacagagtatccatcacatgcagaccctcacaatcattctcaagatacataaactggtaccaacaaaaacccggaaaagcaccaaaactactaatacatgcagcatcatcactagtaggcggagtaccatcaagattctcaggatcaggatcaggaacagacttcacactaacaatatcatccctccaaccagaagacttcgcaacatactactgccaacaaacatactcaaaccccccaataacattcggacaaggaacaagactagaaatgaaaagaacagtagccgcaccatcagtcttcatattcccaccatcagacgaacaactaaaatcaggtacagcatcagtagtatgcctattaaataacttctacccaagagaagcaaaagtccaatggaaagtagacaacgcattacaatcaggcaactcacaagaatcagtaacagaacaagactcaaaagactccacatactcactatcatcaacactaacactatcaaaagcagactatgaaaaacacaaagtatacgcatgcgaagtaacacatcaaggactatcctcaccagtaacaaaatccttcaaccgaggagaatgc

SEQ ID NO: 46733 - RNA, 1347 nt, synthetic construct
  misc_feature 1..1347: note = derived and/or modified sequence opt6 from Tralokinumab_HeavyChain1
  source 1..1347: mol_type = other RNA
caagtacaattagttcaatctggcgctgaagtaaaaaaaccaggtgcatcagttaaagtctcctgtaaagcctcaggatatacattcacaaattacggcctatcatgggtaagacaagcaccaggacaaggactagaatggatgggttggatatcagcaaacaatggcgacacaaattatggacaagaatttcaaggaagagtcaccatgactacagacacatcaacatcaacagcatacatggaattaagatcattaaggtcagatgacactgcagtttactactgcgcaagagattcctcttcatcctgggcaagatggttcttcgacttatggggaagaggaacattagtaacagtatcatcagcatccactaaaggaccatcagtttttccacttgctccttgctcaagatcaacaagcgaatctacagctgctttaggttgtttagtaaaagattattttcccgaaccagtcaccgtatcctggaactctggagcactcacaagcggagttcatacctttccagctgttctacaaagctccggtctatattcactctcatctgtagtaacagttccctcatcatctctaggcacaaaaacctatacatgtaacgtagaccataaaccatctaatacaaaagtagataaacgtgtagaatcaaaatacggaccaccctgcccatcctgtccagcaccagaatttctaggaggacccagcgtatttttatttccaccaaaaccaaaagacactttgatgatctcaagaacacctgaagtaacttgtgtcgtagtcgatgtatcacaggaagacccagaagtacaattcaactggtacgttgatggagtagaagtacataatgcaaaaacgaaaccaagagaagaacaatttaattctacatacagagtagtatcagtactaacagtattacatcaagactggttaaatggaaaagaatataaatgtaaagtatccaataaaggacttccctcatctatagaaaaaaccatttcaaaagccaaaggccaaccaagagaaccccaagtatatactttaccaccatcacaagaagaaatgacaaaaaatcaagtatcattaacatgcttagtaaaaggattttatccatcagacatagcagtagaatgggaatcaaacggccaaccagaaaataattacaaaactacaccaccagtactagattcagatggatccttctttttatattcaagactaacagtagataaatcaagatggcaagaaggaaacgtattttcctgtagcgtaatgcatgaagccttacataaccattacacacaaaaatcactatcattatccttaggcaaa

SEQ ID NO: 46734 - RNA, 642 nt, synthetic construct
  misc_feature 1..642: note = derived and/or modified sequence opt6 from Tralokinumab_LightChain1
  source 1..642: mol_type = other RNA
tcatacgtattaactcaaccaccaagcgtatccgtagcaccaggaaaaacagcaagaataacatgcggtggaaatataataggatcaaaactcgtacactggtaccaacaaaaaccaggacaagcaccagtattagtaatatacgacgacggcgacagaccaagcggaataccagaaagattctcaggatcaaacagcggaaacaccgcaaccttaacaatatcaagagtcgaagcaggagacgaagcagactactattgccaagtatgggacacaggttcagacccagtagtattcggaggaggaacaaaattaacagtactaggacaaccaaaagcagcaccatcagtaacactattcccaccatcatcagaagaactacaagcaaacaaagcaacactagtctgcctaatatcagacttctacccaggagccgtaaccgtagcatggaaagcagactcaagcccagtaaaagcaggagtagaaacaacaacaccaagtaaacaatcaaataacaaatacgcagcatcatcatacctatcattaacaccagaacaatggaaatcccacagatcatactcatgccaagtaacacacgaaggctcaacagtcgaaaaaacagtagcaccaacagaatgctca

SEQ ID NO: 46735 - RNA, 1332 nt, synthetic construct
  misc_feature 1..1332: note = derived and/or modified sequence opt6 from Trastuzuab_HeavyChain1
  source 1..1332: mol_type = other RNA
gaagttcaattagtcgaatcaggaggaggcttagtacaacccggaggatctctaagactatcatgcgccgcatcaggattcaatataaaagatacatacattcactgggtaagacaagcaccaggaaaaggactagaatgggtagccagaatttatcccaccaacggatacactagatacgccgactccgtaaaaggaagattcactatatcagcagatacatcaaaaaacacagcatacttacaaaactcactaagagcagaagatacagcagtatactattgtagccgctggggtggagacggcttctacgccgactactggggccaaggaactctcgtaactgtatcaagcgcatctacaaaaggtccatcagtttttccactagcaccaagttccaaatccacatctggaggtacagcagcactaggctgcttagtaaaagactattttccagaacctgtaacagtatcttggaattccggcgcactaacttctggagtacacacatttccagcagtactacaatcatccggtctatattcattatcctctgtagtaacagtaccctcttcatcactaggaacacaaacctatatctgcaacgtaaatcataaaccatcaaacacaaaagtagacaagaaagtagaacccaaatcatgtgataaaacccatacatgcccaccatgtccagctcccgaattactaggaggcccaagtgtattcctattcccaccaaaacccaaagacactctaatatcacgcacaccagaagtaacatgcgtagtagtcgacgtatctcacgaagacccagaagtaaaattcaattggtatgtagacggcgtcgaagttcataatgcaaaaacaaaaccaagagaagaacaatacaattctacttacagagtagtctcagtattaacagtacttcatcaagactggttaaatggaaaagaatacaaatgcaaagtatcaaataaagcattaccagcaccaatcgaaaaaacaatatcaaaagcaaaaggacaacctagagaaccgcaagtatatacactaccaccatcaagagaagaaacaaaaaatcaagtctctctaacttgcttagtaaaaggtttctatccttcagacatagcagtagaatgggaaagtaatggacaaccagaaaacaattataaaacaacaccaccagtattagattcagacggatccttcttcctatactctaaattaactgtcgacaaatcaagatggcaacaaggaaacgtattctcctgttctgttcacgaagcactacacaaccattatactcaaaaatccctatccctatcaccagga

SEQ ID NO: 46736 - RNA, 639 nt, synthetic construct
  misc_feature 1..639: note = derived and/or modified sequence opt6 from Trastuzuab_LightChain1
  source 1..639: mol_type = other RNA
gacatacaaacacaatccccctcatcattatcagcatccgtaggagatagagtaacaataacctgcagagcatcacaagacgtaaacacagcagtagcatggtaccaacaaaaaccaggaaaagcaccaaaactactaatctactcagcatccttcctatactcaggagtaccatccagattctcaggatcacgatcaggaacagacttcacattaaccatatcatcattacaaccagaagacttcgccacatactactgccaacaacactacacaaccccacccacattcggacaaggaactaaagtagaaataaaaagaacagtagcagcaccatcagtattcatcttccccccatcagacgaacaattaaaatcaggcacagcatcagtagtatgcctactaaacaacttctacccaagagaagccaaagtccaatggaaagtagacaacgcactacaatcaggaaactcacaagaatcagtaacagaacaagactccaaagactcaacatattccttatcatcaacactaacactatcaaaagcagactacgaaaaacacaaagtatatgcatgcgaagtcacacaccaaggactatcttcacccgtaacaaaatctttcaacagaggagaatgc

SEQ ID NO: 46737 - RNA, 1347 nt, synthetic construct
  misc_feature 1..1347: note = derived and/or modified sequence opt6 from Trastuzumab_emtansine_HeavyChain1
  source 1..1347: mol_type = other RNA
gaagttcaactagtagaatcaggaggaggactagtacaaccaggcggatcattacgcctatcatgtgcagcctccggattcaacataaaagacacatacatccactgggtaagacaagcaccaggaaaaggcctagaatgggtagcaagaatatatcccacaaatggatacacacgctatgccgactcagtaaaaggtagattcactataagcgccgatacatccaaaaatacagcatatctccaaatgaactctttaagagccgaagatactgcagtttactactgctcacgatggggaggcgatggcttttacgcaatggactactggggacaaggaacccttgtaaccgttagttctgcatccacaaaaggcccatcagtattcccattagcaccatcctcaaaatcaacctcaggcggtacagcagccctaggatgtctcgtcaaagattactttccagaaccagtcacagtctcctggaattctggtgccctaacatccggagttcacacattcccagcagtattacaatcatcaggactatattcactatcatctgtagtaacagtaccatcttcatcattaggaacacaaacatatatatgcaatgtcaaccataaaccctctaataccaaagtagataaaaaagtcgaacccaaatcatgcgacaaaacccacacatgcccaccatgtccagccccagaactacttggtggaccatcagtcttcctatttccaccaaaaccaaaagacacactaatgatttcaagaacaccagaagtaacatgtgtagtagtagacgtatcacatgaagaccctgaagtaaaattcaactggtacgtagatggagtcgaagttcacaacgcaaaaactaaaccaagagaagaacaatacaacagtacataccgagtagtatcagtattaacagtcttacaccaagattggctaaacggtaaagaatacaaatgcaaagtttccaacaaagcactaccagcaccaatagaaaaaacgatatctaaagcaaaaggacaaccaagagaaccacaagtatacacactaccaccttcaagagaagaaatgacaaaaaatcaagtatccttaacttgcttagtaaaaggattctatccttcagacatagcagtagaatgggaatctaacggacaaccagaaaacaactataaaacaacaccaccagtactagactcagacggatcatttttcttatactcaaaattaacagtcgataaatcaagatggcaacaaggcaatgtattctcatgctcagtaatgcacgaagcattacacaaccactacacacaaaaatcattaagcctaagccccgga

SEQ ID NO: 46738 - RNA, 642 nt, synthetic construct
  misc_feature 1..642: note = derived and/or modified sequence opt6 from Trastuzumab_emtansine_LightChain1
  source 1..642: mol_type = other RNA
gacatacaaatgacacaatcaccatcaagcttatcagcatcagtaggagacagagtaaccataacatgtagagcaagccaagacgtaaacacagcagtagcctggtaccaacaaaaaccaggaaaagcaccaaaactactaatatactccgcctccttcctatactctggagtaccatcaagattctcaggatcaagatccggcacagacttcacactaacaatatcatcactacaaccagaagattttgcaacatactattgccaacaacactacacaacaccaccaacattcggacaaggaacaaaagtcgaaataaaaagaacagtagcagcaccatcagtattcatattcccaccatcagacgaacaactaaaatctggaacagcatcagtagtatgcctactaaataacttctacccaagagaagccaaagtccaatggaaagtagacaatgcactacaatcaggaaactcacaagaatcagtaacagaacaagactcaaaagactcaacatattcactatcatcaacactaaccctatcaaaagcagattacgaaaaacacaaagtatacgcatgcgaagtaacccaccaaggcctatcatcaccagtaacaaaatcattcaaccgaggcgaatgc

SEQ ID NO: 46739 - RNA, 1347 nt, synthetic construct
  misc_feature 1..1347: note = derived and/or modified sequence opt6 from Trastuzumab_HeavyChain1
  source 1..1347: mol_type = other RNA
gaagtacaactagtagaaagtggcggaggactagtacaaccaggaggtagtttaagactgtcatgcgcagcatccggttttaatatcaaagacacctacatacactgggtaagacaagctccaggtaaaggattagaatgggttgcccgaatatacccaacaaacggatatacaagatatgcagatagtgtaaaaggtagattcacaatatcagcagacactagcaaaaatacagcatacctacaaatgaattcattacgagcagaagatacagcagtatactattgtagtcgatggggaggtgacggattctatgcaatggattactggggacaaggaacactagtaaccgtatcatcagcatcaacaaaaggcccaagtgtattcccactagcaccatccagcaaaagcactagcggaggcacagcagcacttggatgcttagtaaaagactacttcccagaaccagtaacagtttcctggaatagtggagcattaacctctggagttcatacattcccagcagtacttcaatcatccggactatactcattatctagtgtagttacagtaccttctagctcattgggcacacaaacttacatatgcaatgtcaatcacaaaccctcaaatacaaaagtagacaaaaaagttgaaccaaaatcatgcgataaaacacacacatgtccaccatgccctgcaccagaacttttaggaggaccatcagtatttctatttccacctaaaccaaaagatactttaatgatatccaggactcccgaagtaacatgcgtagtagtagacgtttcacatgaagatccagaagtaaaatttaactggtacgtagacggagtagaagtacacaacgcaaaaacaaaaccaagagaagaacaatataattcaacataccgtgttgtaagcgtgctaacagtattacaccaagactggttaaacggtaaagaatacaaatgtaaagtatcaaataaagcactaccagcaccaattgaaaaaacaatatccaaagcaaaaggacaaccaagagaaccacaagtatatacactaccaccatcacgagaagaaatgactaaaaatcaagtttcattaacatgtctagtaaaaggattttatccatctgacatagccgttgaatgggaatcgaacggccaaccagaaaataactataaaactacacctccagtattagattcagacggctcattttttttatattcaaaattaacagtagataaatccagatggcaacaaggaaatgtctttagctgtagtgtaatgcatgaagcactacataatcattacacacaaaaatcgctaagcttaagtccagga

SEQ ID NO: 46740 - RNA, 1353 nt, synthetic construct
  misc_feature 1..1353: note = derived and/or modified sequence opt6 from Trastuzumab_HeavyChain
  source 1..1353: mol_type = other RNA
gaagtacaactagtagaatcaggaggtggactagtacaacctggaggatcactaagactatcatgcgcagcctcaggctttaacataaaagatacatacatacactgggtccgacaagcacctggaaaaggattagaatgggtagccagaatatatccaaccaatggatatactagatatgctgacagcgtaaaaggtagatttacaatatctgcagacactagtaaaaacaccgcataccttcaaatgaatagcctaagagcagaagatacagccgtatactactgctcaagatggggaggagacggattctatgcaatggactactggggacaaggaacacttgtaacagtatcttccgcatcaactaaaggtccaagtgtatttccacttgcaccttcatccaaatcaacatcaggaggcacagcagcactcggatgtctagtaaaagattattttccagaaccagtaacagtatcctggaattcaggagcactaacctcaggtgtccatacatttcccgccgtcctacaatcatccggtctatactcactatcatcagttgtaacagttccatcctcatcactaggtacacaaacatatatttgcaacgttaaccataaaccatctaataccaaagtagataaaaaagtagaaccacctaaatcatgtgataaaacacacacatgtcctccctgtccagctccagaattattaggaggaccatctgtcttcttatttccaccaaaaccaaaagatacattaatgatctcacgaacacccgaagtaacttgtgtagtagtagatgtatcacatgaagacccagaagtaaaatttaactggtacgttgatggtgtagaagtacacaatgccaaaactaaaccacgagaagaacaatataactccacctacagagtagtatcagtactaacagtattacaccaagattggttaaacggaaaagaatataaatgtaaagtttctaataaagccctaccagcaccaatagaaaaaacaatatcaaaggcaaagggacaacctagagaaccccaagtatatacactaccaccatcaagagatgaactaacaaaaaatcaagtatcattaacatgtctagtaaaagggttttatccatccgacatagccgttgaatgggaatctaacggtcaacccgaaaataactataaaacaacccccccagtcttagattctgatggatctttttttctctattcaaaactaacagtagataaaagtagatggcaacaaggaaatgtattttcatgctcagtaatgcatgaagctttacataaccactacacacaaaaatcactatcattgtcacctggaaaa

SEQ ID NO: 46741 - RNA, 660 nt, synthetic construct
  misc_feature 1..660: note = derived and/or modified sequence opt6 from Trastuzumab_HeavyChain_variant_1n8z_B
  source 1..660: mol_type = other RNA
gaagtacaactagtagaatcaggaggaggactagtacaaccaggaggatcattaagactatcctgcgcagcatcaggatttaacataaaagatacatatatacattgggttagacaagcccctggaaaaggattagaatgggtagcaagaatatacccaacaaatggctatacaagatacgctgacagtgtaaaaggaagattcacaatatcagcagacacatcaaaaaatacagcctacttacaaatgaacagtctaagagcagaagacacagcagtatactattgctcacgatggggaggagatggattctatgcaatggactattggggacaaggaacattagtaacagtaagtagtgcaagtactaaaggaccatcagtattcccattagcaccttcatcaaaatcaacatcaggaggaacagcagctttaggatgtctagtaaaagattattttccagaaccagtaacagtatcatggaactcaggagcattaacatctggagtacatacttttccagcagtattacaatcaagtggattatattcattatcatcagtagtaacagtaccatcatcatcactaggtacacaaacatatatatgtaacgttaaccataaaccatcaaatacaaaagtagataaaaaagtagaacca

SEQ ID NO: 46742 - RNA, 45 nt, synthetic construct
  misc_feature 1..45: note = derived and/or modified sequence opt6 from Trastuzumab_HeavyChain_variant_7637_H
  source 1..45: mol_type = other RNA
gaaccaaaatcatgcgacaaaacacacacatgcccaccatgccca

SEQ ID NO: 46743 - RNA, 642 nt, synthetic construct
  misc_feature 1..642: note = derived and/or modified sequence opt6 from Trastuzumab_LightChain1
  source 1..642: mol_type = other RNA
gacatacaaatgacacaatcaccatcatcactatcagcatcagtaggagacagagtaaccataacatgcagagcaagccaagacgtaaacacagcagtagcatggtaccaacaaaaacccggaaaagcacccaaactactaatatactcagcatcattcctatactcaggagtaccatccagattttcaggatcaagatcaggcaccgacttcactctaaccatatcatcactacaaccagaagacttcgcaacatactactgccaacaacactacacaacaccaccaacattcggacaaggaacaaaagtagaaataaaaagaacagtagcagcaccatcagtattcatattccccccatcagacgaacaactaaaatcaggaacagcctcagtagtatgcctactaaacaacttctacccacgagaagcaaaagtacaatggaaagtcgacaacgcactccaatcaggaaactcacaagaatccgtaacagaacaagactcaaaagactccacatactcattatcatcaaccctaacactatcaaaagcagactacgaaaaacacaaagtatacgcatgcgaagtaacacatcaaggactatcatcaccagtaaccaaatcattcaacagaggagaatgc

SEQ ID NO: 46744 - RNA, 642 nt, synthetic construct
  misc_feature 1..642: note = derived and/or modified sequence opt6 from Trastuzumab_LightChain_variant_1n8z_A
  source 1..642: mol_type = other RNA
gacatacaaatgacacaatcaccatcatcattatcagcatcagtaggagacagagtaacaataacatgcagagcatcacaagacgtaaataccgcagtagcctggtaccaacaaaaaccaggaaaagcacccaaactactaatatactcagcatccttcctatactcaggagtcccatccagattctcaggatcaagatcaggaaccgacttcacattaacaatatcatcactccaaccagaagacttcgcaacatactactgccaacaacactacacaacaccaccaacattcggacaaggaacaaaagtagaaataaaaagaacagtagcagcaccaagcgtattcatattcccaccatcagacgaacaattaaaatcaggaacagcctcagtcgtatgcctactaaacaacttctacccaagagaagcaaaagtccaatggaaagtagacaacgcactacaatcaggaaactcacaagaatcagtaaccgaacaagacagcaaagactcaacatactcattatcatcaacattaaccttatcaaaagcagactacgaaaaacacaaagtatacgcatgcgaagtaacacaccaaggactatcttcacccgtaacaaaatcctttaacagaggagaatgc

SEQ ID NO: 46745 - RNA, 642 nt, synthetic construct
  misc_feature 1..642: note = derived and/or modified sequence opt6 from Trastuzumab_LightChain_variant_7637_L
  source 1..642: mol_type = other RNA
gacatacaaatgacacaatcaccatcatccctatcagcatccgtaggagatagagtaaccataacatgccgagcatcacaagacgtaaacacagcagtagcctggtaccaacaaaaaccaggaaaagcacccaaactactaatatatagtgcatcattcctctactcaggagtaccatcccgattctcaggatcaagatcaggcacagacttcacattaacaatatcatctttacaaccagaagacttcgcaacatactactgccaacaacactacactactccaccaacattcggacaaggaaccaaagtagaaataaaaagaacagtcgcagccccatcagtattcatattcccaccctcagacgaacaactaaaatcaggtacagcctcagtcgtatgcctactcaacaacttctaccccagagaagcaaaagtacaatggaaagtagacaacgcactacaatccggaaactcacaagaatcagtaacagaacaagattcaaaagactcaacatactcactatcatcaacattaaccttatccaaagccgactacgaaaaacacaaagtatacgcatgcgaagtaacccaccaaggattatcatcaccagtaacaaaaagcttcaacagaggagaatgc

SEQ ID NO: 46746 - RNA, 1344 nt, synthetic construct
  misc_feature 1..1344: note = derived and/or modified sequence opt6 from TRC-105_HeavyChain1
  source 1..1344: mol_type = other RNA
gaagtaaaacttgaagaatcaggaggcggattagtccaacccggaggttcaatgaaattaagttgcgcagcatccggcttcacattctccgacgcctggatggattgggtaagacaatcacctgaaaaaggattagaatgggtcgcagaaataagatcaaaagcctcaaaccatgcaacatattacgcagaatcagtaaaaggcagatttacaatatctagagacgactcaaaatcctcagtctatttacaaatgaattccttaagagccgaagatacaggaatatattactgcacacgctggcgacgatttttcgactcctggggacaaggaacaacactaacagtatcatcagcatcaacaaaaggaccatcagtattcccactagctccatcatccaaatctacatcaggaggaactgcagcacttggatgcttggtcaaagactattttccagaaccagtaactgtatcatggaactcaggcgcactaacttcaggagtccacacattccccgccgtactacaatcaagtggtctatattccctatcatcagtagtcacagtaccctcctcatcattaggaacacaaacctacatatgtaatgtaaaccacaaaccaagtaacaccaaagtagataaaaaagtagaaccgaaatcttgcgacaaaacacatacatgtccaccctgtccagcaccagaattactcggaggaccatcagtattcctattcccaccaaaaccaaaagatacattgatgatttcaagaacaccagaagtaacatgcgttgtcgtagacgtatcacacgaagacccagaagttaaatttaattggtacgtagacggcgttgaagtacacaacgctaaaacaaaaccaagagaagaacaatacaattcaacttatagagttgtatccgttttaacagttctccaccaagattggctaaacggaaaagaatacaaatgcaaagtctcaaacaaagccctacccgcccctatagaaaagactatatcaaaagcaaaaggacaacccagagaacctcaagtatacacattaccaccatcaagagacgaacttaccaaaaatcaagtatcactaacatgcttagtaaaaggcttctacccatctgacatagcagtagaatgggaatctaacggacaaccagaaaataactacaaaacaacaccacctgttttagactcagacggatcattctttctatattctaaactaacagtagacaaaagcagatggcaacaaggaaacgtattctcatgctcagtaatgcatgaagcactacataaccactacacacaaaaatcactctcactttcacctggaaaa

SEQ ID NO: 46747 - RNA, 639 nt, synthetic construct
  misc_feature 1..639: note = derived and/or modified sequence opt6 from TRC-105_LightChain1
  source 1..639: mol_type = other RNA
caaatagtactatcacaatccccagcaatattatcagcatcaccaggagaaaaagtaacaatgacatgcagagcatcatcatcagtatcatacatgcactggtaccaacaaaaaccaggatcatcaccaaaaccatggatatacgcaacatccaacctagcatctggagtaccagtaagatttagcggatcaggatcaggaacatcatactcactaacaatatcaagagtagaagcagaagacgcagcaacatactactgccaacaatggagtagcaacccattaacattcggagcaggaacaaaactagaattaaaaagaacagtagcagcaccatcagtattcatattcccaccaagcgacgaacaactaaaatcaggaacagcatcagtagtatgcctattaaacaacttttacccaagagaagcaaaagtacaatggaaagtagacaacgcactacaatcaggaaactcacaagaatcagtaacagaacaagactcaaaagactcaacctactcactatcctcaacactaacactatcaaaagcagactatgaaaaacacaaagtatacgcatgcgaagttacacaccaaggattaagttcaccagtaacaaaatcattcaacagaggagaatgc

SEQ ID NO: 46748 - RNA, 1362 nt, synthetic construct
  misc_feature 1..1362: note = derived and/or modified sequence opt6 from Tregalizumab_HeavyChain1
  source 1..1362: mol_type = other RNA
gaagaacaattagtagaaagcggaggaggattagtaaaaccaggaggatcacttagactaagctgtgccgcatctggattttccttctcagactgtagaatgtactggctaagacaggcaccaggaaaaggcctagaatggataggcgtaatatccgtcaaatcagaaaactacggtgctaactatgcagaaagcgtaagaggaagatttaccatatcaagagatgatagcaaaaacacagtatacctacaaatgaacagcttaaaaacagaagatacagcagtttactactgttcagcatcatattacagatacgatgttggagcctggttcgcatattggggccaaggcacattagtaacagtctcatcagcatcaacaaaaggaccaagcgttttcccacttgcccctagcagtaaatcaacatcaggaggtaccgcagcactaggatgcttagtcaaggactactttccagaaccagtaactgtatcttggaattcaggtgcactaacatcaggagtacacactttcccagccgtactacaaagttcaggattatacagtttatcatctgtagtaacagttccttcatcatctctaggtactcaaacatatatatgtaatgtaaatcacaaaccatcaaacacaaaagttgacaaaaaagtagaacctaaatcctgcgataaaacacatacatgtcctccatgccctgcaccagaattacttggcggcccatcagtctttttattcccaccaaaaccaaaagatacattaatgatcagcagaaccccagaagtcacatgtgtagttgtagacgtatcacatgaagaccctgaagttaaattcaactggtatgttgacggagtagaagtacataacgcaaaaacaaaacccagagaagaacaatataactcaacttatcgcgtagtatcagtcctaacagtattacatcaagactggctaaatggaaaagaatacaaatgcaaagtatcaaataaagcattaccagcccccatagaaaaaacaatatcaaaagcaaaaggtcaaccaagagaaccacaagtatataccctacccccatcacgagatgaattaacaaaaaatcaagtatcattaacctgcctagttaaaggattctacccctccgacatagccgtagaatgggaatcaaacggacaaccagaaaacaattataaaacaacaccaccagtattagactcagatggatcattttttttatactcaaaactaacagtagataaaagtagatggcaacagggcaatgtcttctcatgttcagttatgcacgaagcacttcataatcactatacccaaaaatcattaagtttatcaccaggcaaa

SEQ ID NO: 46749 - RNA, 654 nt, synthetic construct
  misc_feature 1..654: note = derived and/or modified sequence opt6 from Tregalizumab_LightChain1
  source 1..654: mol_type = other RNA
gacatagtaatgacacaatcaccagactcattagccgtaagtttaggagaaagagcaacaataaactgtagagcaagcaaaagcgtaagtacaagcggatactcatacatatactggtaccaacaaaaaccaggacaaccaccaaaactactaatatatctcgcatcaatactagaaagtggagtaccagatagattctcaggatcaggttcaggaacagactttaccttaacaataagttcactacaagcagaagacgtagcagtatactactgccaacactcaagagaactaccatggacattcggacaaggaacaaaagtagaaatcaaaagaacagtagcagcaccaagcgtattcatattcccaccttcagacgaacaattaaaatcaggaacagcatcagtagtatgcttactaaataacttttacccgagagaagcaaaagtacaatggaaagtagataacgcactacaaagcggaaattcacaagaaagtgtaacagaacaagacagcaaagactcaacatattcattaagttcaactttaaccttaagcaaagcagattacgaaaaacataaagtatacgcatgcgaagtaacacaccaaggcttaagctcacccgtaacaaaatcatttaacagaggagaatgc

SEQ ID NO: 46750 - RNA, 1353 nt, synthetic construct
  misc_feature 1..1353: note = derived and/or modified sequence opt6 from Tremelimumab_HeavyChain1
  source 1..1353: mol_type = other RNA
caagtgcaattagtagaaagcggaggtggagtagtccaaccaggtagaagcttaagattatcatgtgcagcatcaggatttactttttcatcatatggcatgcattgggtacgacaagcaccaggaaaaggtttagaatgggtagcagtaatatggtacgacggctcaaataaatattatgccgattcagtaaaaggaagatttacaataagtcgtgataactcaaaaaacacactatatctacaaatgaattcactaagagctgaagacacagcagtttattactgtgcacgagacccacgtggagcaacattatattactactattacggaatggacgtatggggacaaggaacaacagtaacagtatcaagtgcatcaaccaaaggcccatcagtattccccctagccccatgctctcgatcaacttctgaatcaacagcagcattaggatgcctagtaaaagattactttccagaacccgtaactgtttcatggaacagtggagcacttacatcaggagtacatacttttccagcagtcttacaatctagcggtttatatagtctatcttctgtcgtaacagtacctagttcaaactttggaacacaaacatacacttgtaacgtagaccataaaccatcaaacaccaaagtagataaaacagtagaaagaaaatgttgcgtcgaatgcccaccatgccctgcaccacctgtagcaggcccatcagtattcttattccctccaaagccaaaagacacattaatgatatcaagaactccagaagtaacatgtgtagtagtagatgtctcacacgaagatcccgaagttcaattcaattggtatgttgatggagtagaagtacataatgccaaaaccaaaccaagagaagaacaatttaactcaacctttcgagtagtctccgtactaacagtagtacatcaagattggttaaatggaaaagaatacaaatgtaaagtatcaaacaaaggactaccagcacccatcgaaaaaactatatccaaaacaaaaggtcaacctagagaaccacaagtatatacccttccaccatcaagagaagaaatgacaaaaaatcaagtctcactaacatgcttagtaaaaggattttacccatcagacatagcagttgaatgggaatcaaatggacaacccgagaacaattataaaacaacaccaccaatgttagacagtgatggtagcttttttttatactcaaaattaaccgtagacaaaagtagatggcaacaaggaaacgtattcagttgctcagtaatgcatgaggcattacacaatcactatacacaaaaatcactctctttatctccaggaaaa

SEQ ID NO: 46751 - RNA, 642 nt, synthetic construct
  misc_feature 1..642: note = derived and/or modified sequence opt6 from Tremelimumab_LightChain1
  source 1..642: mol_type = other RNA
gacatacaaatgacacaatcaccatcatctttatcagcatcagtaggagacagagtaaccataacatgcagagcatctcaatcaataaattcctacctagactggtaccaacaaaaacccggaaaagcaccaaaactcttaatatacgcagcatcatcactccaatcaggagtaccatcaagattctcaggatcaggatccggaacagacttcacattaaccatatcctcactccaaccagaagacttcgcaacatactactgccaacaatactactcaactccattcacattcggaccaggaacaaaagtagaaataaaaagaacagtagcagcaccatccgtattcatatttccaccctcagacgaacaactaaaatcaggaacagcctcagtagtatgcttactcaacaacttctacccacgagaagcaaaagtacaatggaaagtagacaacgcactccaatccggaaactcacaagaatcagtaacagaacaagattccaaagactcaacatactcactatcatcaacactaacactatcaaaagcagactacgaaaaacacaaagtatacgcatgcgaagtaacacaccaaggactatcatcaccagtaaccaaatcattcaacagaggagaatgc

SEQ ID NO: 46752 - RNA, 1341 nt, synthetic construct
  misc_feature 1..1341: note = derived and/or modified sequence opt6 from Trevogrumab_HeavyChain1
  source 1..1341: mol_type = other RNA
gaagtacaagtattagaatcaggaggtgatttagtacaacctggaggttcactacgactatcatgtgctgcatccggtttcacatttagtgcatacgccatgacctgggtaagacaagctcctggaaaaggactagaatgggtctccgctatatcaggatcaggaggaagcgcatattacgcagattcagtaaaaggaagattcactatatctagagataacagtaaaaatacagtatacctacaaatgaactcactacgtgcagaagatacggcagtatattattgtgctaaagatggagcatggaaaatgtcaggattagacgtatggggtcaaggcactacagttatagtttcatcagcatccacaaaaggaccttccgtatttccattagcaccatgttccagatcaacaagcgaatcaacagcagcactaggatgtctcgtaaaagactactttccagaacccgtaaccgtatcatggaactcaggagctctaacatcaggagtacatacatttcctgcagtacttcaaagctcaggactatattcattatcatcagtagttacagtaccctcatcctccttaggcacaaaaacatatacatgtaacgtagaccataaaccatcaaacacaaaagtagataaacgagtagaatcaaaatacggtccaccatgtccaccatgtccagctccggaattcttaggaggaccctctgtatttttatttccaccaaaacccaaagatactttaatgattagtagaacaccagaagtaacttgtgtagttgtagatgtatctcaagaagacccagaagtacaatttaactggtatgtagacggagtagaagtccacaacgcaaaaactaaaccaagagaagaacaattcaatagcacatatcgagtagtatcagttttaacggtattacatcaagattggttaaacggaaaagaatacaaatgtaaagttagtaataaaggacttccatcatcaatagaaaaaacaatttccaaagcaaaaggacaacctagagaaccacaagtatatacccttcccccatctcaagaagaaatgacaaaaaatcaagtttcattaacctgtttagtaaaaggattttatccatcagacatagcagttgaatgggaatcaaacggccaaccagaaaataattataaaacaacaccaccagtactagattccgatggatctttctttttatatagtcgattaacagtagataaatctcgatggcaagaaggaaacgtatttagctgttcagtaatgcatgaagccctacacaaccactacacccaaaaatcattatcactttcactcggaaaa

SEQ ID NO: 46753 - RNA, 642 nt, synthetic construct
  misc_feature 1..642: note = derived and/or modified sequence opt6 from Trevogrumab_LightChain1
  source 1..642: mol_type = other RNA
gacatacaaatgacccaatcaccagcatcactatcagcatcagtaggcgacagagtaaccataacctgcagagcatcacaagatatatcagactacttagcttggtaccaacaaaaaccaggaaaaataccccgattattaatatacacaacatccacactacaatccggagtcccatcaagattcagaggatctggctccggaacagacttcacactaacaataagttcactccaaccagaagacgtagcaacatactactgccaaaaatacgactcagcaccactaacattcggaggaggaacaaaagtagaaataaaacgaacagtagcagcaccatcagtattcatattcccaccatcagacgaacaattaaaatcaggaacagcatcagtagtatgcctattaaacaacttctatccaagagaagcaaaagtacaatggaaagtagataacgcattacaatccggaaactcacaagaatcagtaacagaacaagactcaaaagactcaacatactcactatcatcaacactaacactatcaaaagcagactacgaaaaacacaaagtatacgcatgcgaagtaacacaccaaggactatcatcacccgtaacaaaatcattcaacagaggagaatgc

SEQ ID NO: 46754 - RNA, 1737 nt, synthetic construct
  misc_feature 1..1737: note = derived and/or modified sequence opt6 from Tucotuzumab_celmoleukin_HeavyChain1
  source 1..1737: mol_type = other RNA
caaatccaactagttcaatcaggtgccgaagtaaaaaaacctggagaaaccgtcaaaatttcatgcaaagcatcaggatacactttcacaaactacggaatgaattgggtcaaacaaacaccaggaaaaggactaaaatggatgggatggatcaacacctacaccggagaaccaacatacgcagacgacttcaaaggacgcttcgcattctcactcgaaacatcaacaagcacagccttcctacaaataaacaacctacgctccgaagacactgctacctacttttgtgtaagatttatctcaaaaggagactactggggacaaggcacgtctgtcacagtatccagcgcctcaacaaaaggaccctccgtattcccactagctccctcatcaaaatccacctccggtggaactgccgccctcggatgcttagttaaagattactttcctgaacctgtaaccgtctcatggaactctggtgcactaacttccggagtacatacattcccagctgtattacaatcctcaggactatactcactatcatccgtcgtaacagtaccatcctcctcattaggaacacaaacctatatatgcaatgtaaatcacaagccctccaacaccaaagtagataaaagagtagaacctaaatcctgcgacaaaacacatacctgccccccatgccccgcccccgaattactaggaggcccatcagtattcctattcccaccaaaaccaaaagataccctaatgatctcacgaactccagaagtaacttgtgtcgtagtagacgtatcccacgaagaccccgaagtcaaatttaactggtatgtagatggtgtagaggtacacaacgccaaaaccaaaccaagagaagaacaatacaactctacatatagagtagtatccgtactaacagtcttacatcaagattggttaaacggaaaagaatacaaatgcaaagtatcaaacaaagcattgcccgcacccatagaaaaaacaatatctaaagcaaaaggtcaaccaagagaaccacaagtttacacattaccaccatcaagagaagaaatgaccaaaaaccaagtatccctaacatgtctcgttaaaggattctacccctccgatatagcagtagaatgggaatcaaatggacaacccgaaaacaactataaaacaaccccacccgtattagactcggacggatcattcttcttatactcaaaactaacagtcgataaatccagatggcaacaaggcaatgtcttttcatgttcagtaatgcacgaagctctacacaaccactacacacaaaaatcattatcactatcaccaggaaaagcaccaacatcatcctcaacaaaaaaaacacaactacaattagaacatttattactagacctacaaatgatactcaacggaataaacaattataaaaaccccaaattaacacgcatgctaacttttaaattttacatgcccaaaaaagccacagaattaaaacacctacaatgtctagaagaagaactaaaacctctagaagaagtactcaatctcgctcaatcaaaaaatttccacctcagaccacgcgacctaatttcaaacataaacgtcatagtcttagaactcaaaggatcagaaaccacattcatgtgtgaatatgcagacgaaactgcaacaatagtagaattcctaaatagatggataaccttctgccaatcaatcatatcaacattaacc

SEQ ID NO: 46755 - RNA, 639 nt, synthetic construct
  misc_feature 1..639: note = derived and/or modified sequence opt6 from Tucotuzumab_celmoleukin_LightChain1
  source 1..639: mol_type = other RNA
gaaatagtcctaacacaatccccagcaacattatcactatccccaggcgaaagagtcacattaacatgctcagcatcatcatcagtatcatacatgctatggtaccaacaaaaaccaggatcatcaccaaaaccatggatatttgacacatcaaacctagcatcaggatttccagcaagattctcgggatcaggatctggtacaagctactctcttataatatcatcaatggaagcagaagacgcagcaacatactactgtcatcaaagatcaggatacccatacacattcggaggaggaacaaaactagaaataaaaagaacagtagcagccccatcagtatttatattcccaccctcagacgaacaattaaaatcaggaacagcatcagtagtttgcctactcaacaacttctacccaagagaagccaaagtacaatggaaagtagacaacgcacttcaatcaggaaactcacaagaatccgtaacagaacaagactcaaaagactcaacatactcactatcatcaacactaacattatcaaaagcagattacgaaaaacacaaagtatacgcatgcgaagtcacacaccaaggcttatcatcaccagtaacaaaatcattcaacagaggagaatgc

SEQ ID NO: 46756 - RNA, 1344 nt, synthetic construct
  misc_feature 1..1344: note = derived and/or modified sequence opt6 from Ublituximab_HeavyChain1
  source 1..1344: mol_type = other RNA
caagcatatctacaacaaagcggagcagaactagtacgaccaggagcctctgtcaaaatgtcatgcaaagcttcaggctacacattcacatcatacaacatgcactgggtcaaacaaacaccccgacaaggattagaatggatcggaggaatataccctggtaacggagacacatcctacaatcaaaaatttaaaggcaaagcaacactaactgtaggaaaatcgtcatcaacagcatacatgcaattatcttccttaacatcagaagactcagcagtctatttctgcgcacgatatgactataactatgctatggattactggggccaaggaacatcagtaacagtatcatcagcctccacaaaaggcccatcagtatttccactagcaccatcatcaaagtccaccagcggaggaacagcagcattaggatgcctagttaaagactacttccctgaacccgtaacagtaagctggaattcaggagcactaacttcaggtgtacacacattcccagctgtcctacaatcaagtggattatactctttatcatcagtagtaaccgtaccatcttcctcactaggaacacaaacatacatatgcaacgtaaatcacaaaccaagcaacactaaagtcgataaaaaagtagaacccaaatcctgcgataaaacacatacttgcccaccatgcccagcacccgaactactaggcggaccctcagtattcttattccccccaaaaccaaaagacacattaatgatatccagaacccctgaagtaacatgcgtagttgtagacgtatcacacgaagatccagaagttaaattcaattggtacgtagatggagtagaagtacacaacgccaaaacaaaaccaagagaagaacaatacaactcaacatacagagtagtctccgttctcacagtactacatcaagattggttaaatggaaaagaatataaatgcaaagtatccaataaagcactaccagcaccaatagaaaaaaccatatcaaaagcaaagggacaacctagagaaccacaagtatacacattaccaccatcaagagatgaattaacaaaaaaccaagtctcattaacatgtctagtaaaaggattctatccatccgacatagccgttgaatgggaatccaacggacaaccagaaaataattacaaaacaacaccaccagtcctagactcagacggttctttctttttatattcaaaattaaccgtcgacaaaagcagatggcaacaaggcaacgtattctcatgctcagtaatgcacgaagcactccataaccattacactcaaaaatctctcagcctttcacccggaaaa

SEQ ID NO: 46757 - RNA, 639 nt, synthetic construct
  misc_feature 1..639: note = derived and/or modified sequence opt6 from Ublituximab_LightChain1
  source 1..639: mol_type = other RNA
caaatagtattaagccaatcaccagcaatactatcagcatcaccaggcgaaaaagtcacaatgacatgcagagcatcatcatcagtatcatacatgcactggtaccaacaaaaaccaggatcttcacctaaaccatggatatacgccacctcaaatttagcatcaggagtaccagcaagattctccggatcaggatcaggtacatcatacagcttcacaatatccagagtagaagcagaagacgcagccacatactactgccaacaatggacattcaacccaccaacattcggaggaggaaccagattagaaataaaaagaacagtagcagcaccatccgtattcatattcccaccatccgacgaacaattaaaatcaggaacagcatcagtagtatgcctcctaaacaacttctacccacgagaagcaaaagttcaatggaaagtagacaacgcattacaatcaggaaactcacaagaatcagtaaccgaacaagactcaaaagactcaacatactcactatcatctacactaacattatcaaaagcagactacgaaaaacacaaagtatacgcatgcgaagtaacacaccaaggattaagctcaccagtcacaaaatcattcaacagaggagaatgc

SEQ ID NO: 46758 - RNA, 1353 nt, synthetic construct
  misc_feature 1..1353: note = derived and/or modified sequence opt6 from Ulocuplumab_HeavyChain1
  source 1..1353: mol_type = other RNA
gaagttcaattagtagaatctggaggcggactggtccaacctggaggaagccttagattatcatgcgcagctgcaggttttacattcagttcatactccatgaattgggtaagacaagcaccaggtaaaggattagaatgggtatcatatataagctcacgttcaagaaccatatattatgctgactcagtaaaaggaagatttaccatctcacgcgacaatgccaaaaattcgctatatttacaaatgaattcactcagagatgaagatacagcagtctactactgtgcccgagactatggaggacaacctccttattattattactatggaatggatgtatggggacaaggaacaacagtaacagtctcatcagcatcaacaaaaggaccatcagtatttccattagcaccatgctctagatccacctcagaatcaaccgctgcactaggatgtttagttaaagactattttccagaacccgtaacagtatcatggaattcaggcgcactaacttcaggagtacataccttcccagcagtactccaatcatcaggattatactcactatcatctgtcgtaacagtaccatcatcatcactaggtacaaaaacatatacatgcaacgttgaccataaaccctcaaatacaaaagtcgataaaagagtcgaatcaaaatacggtccaccatgcccaccatgtccagcacctgaattcctaggaggaccaagcgtttttctatttccaccaaaacctaaagatacactcatgatatcaagaactcctgaagttacatgtgtagtagtagacgtatcacaagaagaccctgaagttcaattcaactggtacgtagatggcgtagaagtacataatgcaaaaacaaaaccaagagaagaacaattcaattcaacatacagagtagtatcagtattaacagtactacaccaagactggttaaacggaaaagaatacaaatgcaaagtatcaaacaaaggactaccatcatctatagaaaaaacaataagtaaagcaaaaggacaacctcgagaaccacaagtctatacattaccaccaagccaagaagaaatgactaaaaatcaagtttccctaacatgtctagtaaaaggattttatccatctgacatagcagtagaatgggaatctaacggtcaaccagaaaataactataaaactacaccacccgtattagactcagatggctccttctttctatatagcagactaaccgtagataaatcaagatggcaagaaggtaacgttttctcctgttcagtaatgcatgaagcactacataaccattacacccagaaaagtttatcattatcattggga

SEQ ID NO: 46759 - RNA, 642 nt, synthetic construct
  misc_feature 1..642: note = derived and/or modified sequence opt6 from Ulocuplumab_LightChain1
  source 1..642: mol_type = other RNA
gacatacaaatgacacaatcaccctcatcattatcagcatcagtaggagaccgagtaacaataacatgcagagcatcacaaggaatatcatcatggctagcatggtaccaacaaaaacccgaaaaagcaccaaaatcactaatatacgccgcatcatcactccaatcaggagtaccatcaagattctcaggatcaggctcaggcacagacttcacactaacaatatcatcactacaaccagaagacttcgtaacatactactgccaacaatacaactcatacccaagaacattcggacaaggaaccaaagtagaaataaaaagaacagtagcagccccatcagtattcatattcccaccatcagacgaacaactaaaatccggaacagcctcagtcgtatgcctattaaacaacttctacccaagagaagcaaaagtacaatggaaagtagacaacgcactacaatcaggaaactcacaagaatcagtaacagaacaagacagcaaagactcaacatactccttatcctcaacattaacattatcaaaagcagactacgaaaaacacaaagtatacgcatgcgaagtaacacaccaaggactaagctccccagtaaccaaatcattcaacagaggagaatgc

SEQ ID NO: 46760 - RNA, 1344 nt, synthetic construct
  misc_feature 1..1344: note = derived and/or modified sequence opt6 from Urelumab_HeavyChain1
  source 1..1344: mol_type = other RNA
caagtacaattacaacaatggggagccggtttattaaaaccaagcgaaacactctcactaacatgcgcagtatatggcggatcattttcaggatattattggagttggataagacaatcacccgaaaaaggattagaatggataggcgaaattaatcatggcggatatgtaacatacaatccatctctagaatcacgagtcaccatatcagtcgatacatcaaaaaatcaattttcacttaaattatcttccgtaacagcagcagataccgcagtatactattgcgctcgcgactatggacccggtaactatgattggtactttgacttatggggcagaggcacattagtaacagtatcatcagcatctacaaaaggaccatctgtttttccattagctccatgttcaagatctacatcagaaagtacagcagcattaggatgcttagtaaaagattactttccagaaccagtaacagtctcatggaactcaggagcattaacctctggtgtacacacatttcccgcagtattacaaagttcaggtctatactcattatcaagcgtagtaacagtaccatcatcatccttaggcactaaaacatatacatgtaatgtagatcataaaccatcaaatacaaaagttgataaacgagtagaatccaaatatggaccaccatgcccaccatgcccagcccccgaattcctcggaggcccctcagtttttttatttccaccaaaacctaaagacacacttatgatctccagaacaccagaagtaacatgtgtagtagtagatgtatcacaagaagatccagaagttcaatttaactggtatgttgatggagtcgaagtacacaatgcaaaaactaaaccaagagaagaacaattcaactcaacttacagagtcgtaagcgtactaacagtactacatcaagactggttaaacggaaaagaatataaatgtaaagtatcaaacaaaggcttaccatcctcaatagaaaaaacaatatcaaaagcaaaaggacaaccaagagaaccacaagtatatacattacctccatcacaagaagaaatgaccaaaaatcaagtatcacttacctgtttagttaaaggattttatcctagcgacattgcagtagaatgggaatcaaacggacaacctgaaaacaattacaaaacaacccctccagtcttagattcagatggatctttttttctatactcaagactaaccgtcgataaatccagatggcaagaaggaaacgtcttctcatgcagtgtaatgcatgaagcactacataaccactacacacaaaaatcattatcgctatccctagggaaa

SEQ ID NO: 46761 - RNA, 648 nt, synthetic construct
  misc_feature 1..648: note = derived and/or modified sequence opt6 from Urelumab_LightChain1
  source 1..648: mol_type = other RNA
gaaatagtactcacacaatcaccagcaacactatcactaagcccaggcgaaagagcaacactatcatgtagagcaagccaatcagtatcatcatacctagcatggtaccaacaaaaacccggacaagccccaagactactaatatacgacgcatcaaatagagcaacaggaataccagcaagattctctggatcaggttcaggcacagacttcaccctaacaatcagctcattagaaccagaagacttcgctgtatactactgccaacaaagatcaaactggccaccagcactaacattctgcggcggaacaaaagtagaaataaaaagaacagtagcagcaccatcagtatttatattcccaccatcagacgaacaattaaaatcaggaacagcatcagtagtatgcctactcaacaacttctacccacgcgaagcaaaagtccaatggaaagtagacaacgcactacaatcaggaaactcacaagaatccgtaacagaacaagactcaaaagactcaacatattcattatcatcaacactaacactatcaaaagcagattacgaaaaacataaagtctatgcatgcgaagtaacacaccaaggcctctcatcaccagtaacaaaatcattcaacagaggagaatgc

SEQ ID NO: 46762 - RNA, 1347 nt, synthetic construct
  misc_feature 1..1347: note = derived and/or modified sequence opt6 from Urtoxazumab_HeavyChain1
  source 1..1347: mol_type = other RNA
gaagtacaattagtagaatcaggcggaggactagtccaaccaggaggatccctaagactatcctgtgcagcatcaggatttacattctcatcatacggaatgtcctgggtaagacaagcaccaggaaaaggcttagaatgggttgcaacaatatcaaccggaggatcttacacctactatcccgactctgtaaaaggaagattcacaatttccagagataacgcaaaaaatacactatatttacaaatgaactcattaagagcagaagatacagctgtttattattgtgcacgacgaggcgacgcatggggcaacttagactactggggacaaggaacactagtaacagtatcatcagcctcaacaaaaggaccatccgtatttccactagctccctcatctaaatcaacctcaggaggaaccgcagcactaggatgcttagtcaaagactactttccagaacctgtaacagtatcatggaactcaggagcactaacttccggagtacacacattcccagcagtactacaaagttcaggtctatactcattatcatccgtagtaacagtaccatcgtcttcacttggaacacaaacatatatatgtaacgtaaaccataaaccgtcaaacacaaaagtagacaaaaaagtagaaccaaaaagctgtgacaaaacccacacatgcccaccatgcccagcaccagaacttctaggcggaccttcagttttcttatttcctccaaaaccaaaagacaccctaatgatttcacgaacacctgaagtaacatgcgtagttgtagacgtcagccatgaagacccagaagttaaattcaattggtacgtcgacggagtagaagtccacaatgccaaaaccaaacccagagaagaacaatacaactctacataccgcgtagtatcagtacttacagtcctacatcaagactggctaaatggaaaagaatacaaatgtaaagtatcaaacaaagccctcccagccccaatagaaaaaacaattagcaaagcaaaaggccaaccaagagaaccacaagtatacactttacctccctcaagagatgaacttacaaaaaaccaagtatcattaacatgcctagtaaaaggattctacccaagcgatatagcagtagaatgggaatcaaacggacaaccagaaaacaattacaaaacaacaccaccagtacttgactcagacggatcattcttcctatactcaaaactcacagtagataaatcaagatggcaacaaggtaacgtattcagttgctcagtcatgcatgaagcactacataatcactatacacaaaaatcactctcactgtctccaggaaaa

SEQ ID NO: 46763 - RNA, 642 nt, synthetic construct
  misc_feature 1..642: note = derived and/or modified sequence opt6 from Urtoxazumab_LightChain1
  source 1..642: mol_type = other RNA
gaaatagtactaacacaatcaccagcaacattatctgtatcaccaggagaaagagcaactctatcatgcagagcatcacaaacaatatcaaacaacttacactggtatcaacaaaaacccggacaagcaccaagactattaataaaatcagcatcacaatcaatatcaggaataccagcacgattctcaggatctggatcaggaacagacttcacactaacaatatcatctctagaatcagaagactttgcagtatactactgccaacaatcatactcatggccactaacattcggacaaggaacaaaagtagaaataaaaagaacagtcgcagcaccatccgtattcatattcccaccatcagacgaacaactaaaatcaggaacagcaagcgttgtatgcctactcaacaacttttacccaagagaagcaaaagtacaatggaaagtagacaacgcactacaatcaggaaactcacaagaatcagtaacagaacaagactcaaaagactcaacatactcactatcctcaacattaacactatcaaaagcagactacgaaaaacacaaagtatacgcatgcgaagtaacacaccaaggcctatcatcaccagtaacaaaatccttcaacagaggagaatgc

SEQ ID NO: 46764 - RNA, 1347 nt, synthetic construct
  misc_feature 1..1347: note = derived and/or modified sequence opt6 from Ustekinumab_HeavyChain1
  source 1..1347: mol_type = other RNA
gaagtacaacttgtacaatcaggtgccgaagtaaaaaaaccaggagaatcactaaaaatatcctgcaaaggatcaggatactcattcaccacatactggttaggatgggtccgacaaatgccaggtaaaggactcgactggatcggaataatgtctccagtagactcagacataagatactcaccatcatttcaaggccaagtaacaatgagcgtagacaaatcaatcacaaccgcatacctacaatggaattcattaaaagcatcagataccgcaatgtattattgtgccagacgaagaccaggacaaggatactttgacttctggggacaaggaacactcgtaacagtatcatcttcttcaactaaaggcccaagtgtattccctttagccccatcatcaaaatctacaagcggaggaacagcagccctaggatgtctagtaaaagattattttccagaaccagtaacagtctcatggaactcaggcgctctaacctcaggagtacacacatttccagcagtactccaatcctctggactatattcactatcatcagtagtaacagttccatcatcatcactaggaacacaaacatacatctgcaacgtaaaccacaaaccatccaacacaaaagtagacaaaagagtagaacccaaatcatgtgacaaaacacatacctgccctccatgccccgctcccgaactactaggtggaccctcagtattcctattcccaccaaaaccaaaagacaccctaatgatatcaagaacacccgaagtcacatgcgtcgtagtcgatgtatcacacgaagatcctgaagttaagttcaactggtatgtagatggtgtagaagtccataatgcaaaaaccaaaccacgagaagaacaatataactcaacctaccgagtagtatctgtactaacagtattacatcaagattggctaaacggaaaagaatataaatgtaaagtatctaacaaagcactaccagcacctatagaaaaaacaatatcaaaagctaaaggacaaccaagagaaccccaagtttacactctacctccatccagagacgaattaacaaaaaaccaagtttcactaacatgtttagtaaaaggattctacccttcagacatagcagtagaatgggaatctaacggtcagccagaaaataactataaaactacgcctcccgtattagattcagacggatccttcttcctatattcaaaattaactgtagacaaatcaagatggcaacaaggaaacgtcttcagctgctcagtaatgcacgaagcccttcacaaccactacacacaaaaaagcttatctctatcacctggaaaa

SEQ ID NO: 46765 - RNA, 642 nt, synthetic construct
  misc_feature 1..642: note = derived and/or modified sequence opt6 from Ustekinumab_LightChain1
  source 1..642: mol_type = other RNA
gacatacaaatgacacaatcaccatcatcattatcagcatccgtaggagacagagtaacaataacatgcagagcatcacaaggaatatcatcatggttagcatggtaccaacaaaaaccagaaaaagcacccaaatcactaatttacgcagcatcatcattacaatcaggagtaccatccaggttctcaggatcaggatcaggaacagactttacactaacaatctcctcactacaaccagaagacttcgcaacatactactgccaacaatacaacatatacccatacacattcggacaaggaacaaaactcgaaataaaacgaaccgtcgcagctccatcagtattcatattcccaccctcagacgaacaactaaaatcaggaacagcatcagtcgtatgcttactcaacaacttctacccaagagaagcaaaagtccaatggaaagtagacaacgcactacaatcaggaaattcacaagaatccgttaccgaacaagactcaaaagactcaacatattcattatcctcaacactaacattaagcaaagctgactacgaaaaacacaaagtatacgcatgcgaagtaacacaccaaggcctatcatcaccagtaacaaaatcattcaacagaggagaatgc

SEQ ID NO: 46766 - RNA, 1341 nt, synthetic construct
  misc_feature 1..1341: note = derived and/or modified sequence opt6 from Vadastuximab_talirine_HeavyChain1
  source 1..1341: mol_type = other RNA
caagttcaacttgtccaatcaggagcagaagttaaaaaacctggtgcctcagtaaaagtatcatgtaaagcatcaggatacacatttacaaactatgatatcaactgggtaagacaagcaccaggacaaggtttagaatggatcggatggatatacccaggagacggatcaaccaaatataatgaaaaattcaaagcaaaagcaacattaaccgcagacacatcaactagcacagcatacatggaattaagatccctccgatcagacgatacagccgtatactactgcgcctcaggatatgaagacgcaatggattactggggacaaggaacaacagtaacagtatcatcagcttcaacaaaaggaccatctgtatttccactagcaccatcatcaaaatctacatcaggaggaaccgcagcactaggatgcttagtaaaagactattttccagaaccagtcaccgtttcatggaatagcggagcattaacatcaggcgtacatacatttccagcagttctacaaagctctggactatactccctatcatcagtagtcaccgtaccatcatcaagcctaggaacacaaacatacatctgtaacgtcaatcacaaaccttcaaacacaaaagtagacaaaaaagtagaacccaaatcatgcgataaaacacatacatgcccaccatgcccagctcccgaactactaggaggaccatgtgtatttttattccctccaaaaccaaaagacacactaatgatatcacgaacaccagaagtcacctgcgtagtagtagacgtatcccatgaagacccagaagtaaaattcaactggtatgtcgacggcgtagaagtacataacgcaaaaaccaaaccaagagaagaacagtataactctacttatagagtagtatcagtcttaacagtactacatcaagattggctaaacggtaaagaatacaaatgtaaagtaagcaataaagcattacccgcaccaattgaaaaaacaatatcaaaagcaaaaggacaaccaagagaaccccaagtatacaccttacccccatctagagacgaactaacaaaaaatcaagtctcattaacatgtttagtaaaaggattctacccctcagatatagcagtagaatgggaatccaatggccaaccagaaaacaattacaaaacaacaccgcccgttctagattcagacggaagtttctttttatactccaaactcacagtagacaaatcacgatggcaacaaggcaacgtattctcatgctcagtaatgcatgaagccttacacaaccattatacacaaaaatcattatccctatcaccaggaaaa

SEQ ID NO: 46767 - RNA, 642 nt, synthetic construct
  misc_feature 1..642: note = derived and/or modified sequence opt6 from Vadastuximab_talirine_LightChain1
  source 1..642: mol_type = other RNA
gacatacaaatgacacaatcaccatcatcattatccgcatcagtaggagatagagtaacaataaattgcaaagcatcacaagacataaactcatacctatcctggttccaacaaaaaccaggaaaagcacccaaaacattaatatacagagccaacagactcgtagacggagtcccatccaggttttccggatcaggatcaggacaagactacacactaacaataagctcactacaacccgaagactttgcaacatactactgcctacaatacgacgaattcccactaacattcggaggcggaacaaaagtagaaataaaaagaacagtagcagcaccatcagtattcatattcccaccatcagacgaacaactaaaatcaggaacagcatcagtcgtatgcctattaaacaacttttatccaagagaagcaaaagtacaatggaaagtagacaatgcactacaatcaggaaactcacaagaatcagtaacagaacaagactcaaaagactcaacatactcattatcatcaacattaacattatcaaaagcagactacgaaaaacacaaagtatacgcatgcgaagtaacacaccaaggactatcatcaccagtaacaaaatccttcaacaggggagaatgc

SEQ ID NO: 46768 - RNA, 1362 nt, synthetic construct
  misc_feature 1..1362: note = derived and/or modified sequence opt6 from Vandortuzumab_vedotin_HeavyChain1
  source 1..1362: mol_type = other RNA
gaagtccaactagtagaatctggtggaggactcgtacaaccaggcggttctttaagactatcgtgtgcagtttctggatacagtataacctcagactacgcatggaactgggtaagacaagcaccaggaaaaggactcgaatgggttggatacatatccaattcaggatccacttcctacaatccatcactaaaatcaagattcacaatatccagagatacaagtaaaaatacattatacctacaaatgaactctctcagagccgaagatacagcagtctactattgcgcacgagaaagaaactacgattacgacgattactattacgcaatggactactggggtcaaggcacattagtaaccgtatcatcagcctctaccaaaggcccatcagtatttccattagcaccaagttcaaaatccacctcaggtggaacagcagccctaggctgcttagtaaaagactactttccagaaccagtgactgtatcttggaattcaggagccctaacatcaggagttcacacattcccagcagtactccaatcatcaggattatattcattaagttcagtagtaacagtaccttcctcaagcctaggtacacaaacatatatctgcaacgtaaaccacaaaccatccaatactaaagtagacaaaaaagtagaaccaaaatcttgcgataaaacccatacatgcccaccctgcccagcaccagaattattaggcggtccatccgtattcttatttccaccaaaaccaaaagatactttaatgatatccagaacaccagaagtaacatgtgttgtcgttgatgtatctcatgaagacccagaagtaaaattcaattggtatgtcgacggagttgaagtacataacgcaaaaacaaaaccccgagaagaacaatacaattcaacatacagagtagtatccgttttaacagtactacaccaagactggcttaacggaaaagaatataaatgcaaagtatccaataaagcactacctgcaccaatagaaaaaactatctccaaagccaaaggacaacccagagaaccacaagtttacactttaccaccatctcgcgaagaaatgacaaaaaaccaagtttcattaacatgtttagtcaaaggattctacccatccgacatagcagtcgaatgggaatcaaacggccaaccagaaaacaattataaaacaaccccacctgtactagactcagacggatccttttttttatactctaaactaacagtagacaaatcaagatggcaacaaggcaacgtattctcatgctcagtaatgcacgaagcactacacaatcattacacacaaaaatcattatcactatcaccaggtaaa

SEQ ID NO: 46769 - RNA, 660 nt, synthetic construct
  misc_feature 1..660: note = derived and/or modified sequence opt6 from Vandortuzumab_vedotin_LightChain1
  source 1..660: mol_type = other RNA
gacatccaaatgacacaatcaccatcatcactatcagcaagcgtaggagacagagtaacaataacatgcaaatcatcccaaagcttactatacagatcaaaccaaaaaaactacctagcatggtaccaacaaaaacccggaaaagcaccaaaactcctaatatactgggcatcaacaagagaatccggtgtaccatcaagattctcaggatcaggatcaggaacagacttcacactaacaatatcctcactacaacccgaagacttcgcaacatactactgccaacaatactacaattacccccgcacattcggacaaggaacaaaagtagaaataaaaagaacagtagcagcaccatcagtattcatattcccaccatcagacgaacaactaaaatcaggaacagcatcagtcgtatgcctactaaacaacttctacccaagagaagcaaaagtccaatggaaagtcgacaacgcactacaatccggaaactcacaagaatccgtaacagaacaagactcaaaagactcaacatactccctatcatcaacattaacattatccaaagcagactacgaaaaacacaaagtatacgcatgcgaagtaacacaccaaggcttatcatccccagtaacaaaatccttcaacagaggagaatgc

SEQ ID NO: 46770 - RNA, 1329 nt, synthetic construct
  misc_feature 1..1329: note = derived and/or modified sequence opt6 from Vantictumab_HeavyChain1
  source 1..1329: mol_type = other RNA
gaagtacaattagttgaatcaggcggaggattagtacaacccggcggatcattacgcctatcatgtgcagcatcaggatttacattctcacattatacactatcatgggtccgtcaagcaccaggcaaaggattagaatgggtttctgtcatctcaggagatggatcttacacatactacgcagattccgtaaaaggaagattcacaatatcatctgacaactcaaaaaacacattatacttacaaatgaactcattaagagcagaagacacagccgtatactactgcgcaagaaatttcataaaatacgttttcgcaaactggggacaaggaacattagtaacagtttcctcagcatcaacaaaaggaccatcagtattccccttagccccatgttcaagatcaacttcagaatcaaccgctgctctaggatgtcttgtaaaagactacttcccagaaccagtaacagtctcctggaactccggagcattaacatccggagttcacacattcccagcagtattacaatcatcaggactatactctctatcttcagttgtaacagttccatcttcaaatttcggaacacaaacatacacatgcaacgtagaccacaaaccatccaatacaaaagtagacaaaaccgtagaacgaaaatgttgcgtagaatgcccaccatgccccgcaccaccagtcgccggaccatccgtattcctattcccacccaaacccaaagatacattaatgatctcccgaactccagaagttacatgtgtagtagttgatgtttctcacgaggaccctgaagttcaattcaactggtatgtagacggcgttgaagttcacaacgcaaaaaccaaaccaagagaagaacaattcaactcaacattcagagtcgtctcagtactaacagtagtccatcaagactggctaaatggcaaagaatataaatgtaaagtctccaacaaaggactaccagcaccaatagaaaaaacaatctcaaaaacaaaaggccaaccacgagaaccccaagtatacacacttccgccatcccgcgaagaaatgacaaaaaatcaagtatcactaacatgcctagtaaaaggattctacccttcagacatagcagtcgaatgggaatctaacggacaaccagaaaacaactacaaaactacaccaccaatgctagactcagatggatcatttttcctatattccaaattaacagtagataaaagtagatggcaacaaggtaacgttttctcatgctccgtaatgcacgaagcattacataaccactatacacaaaaatcactatccttatcacccgga

SEQ ID NO: 46771 - RNA, 639 nt, synthetic construct
  misc_feature 1..639: note = derived and/or modified sequence opt6 from Vantictumab_LightChain1
  source 1..639: mol_type = other RNA
gacatagaattaacacaaccaccatcagtatcagtagcaccaggacaaacagcaagaatctcatgctcaggcgacaacataggatcattctacgtacactggtaccaacaaaaaccaggacaagcaccagtattagtaatatatgacaaatccaacagaccatcaggaataccagaaagattctcaggatcaaactcaggaaacaccgcaacactaacaatctccggaacacaagcagaagacgaagcagactactactgccaatcatacgcaaatacactatcattagtattcggaggaggaacaaaactaacagtactaggacaaccaaaagcagcaccatcagtaacactattcccaccatcatcagaagaattacaagcaaacaaagccaccctcgtatgcttaatatcagatttctatccaggagcagtaacagtagcatggaaagccgactcatcaccagtaaaagcaggcgtagaaacaaccacaccatcaaaacaatccaacaacaaatacgcagcatcatcatacctctccctaacaccagaacaatggaaatcacacagatcctactcatgccaagtaacacacgaaggatcaacagtcgaaaaaacagtagcaccaacagaatgctca

SEQ ID NO: 46772 - RNA, 1389 nt, synthetic construct
  misc_feature 1..1389: note = derived and/or modified sequence opt6 from Vanucizumab_HeavyChain1
  source 1..1389: mol_type = other RNA
caagtccaacttgtacaatcaggcgcagaagtaaaaaaaccaggagcctcagtaaaagtaagctgcaaagcatcaggatacacctttacaggatattacatgcattgggtaagacaagcaccaggccaaggactagaatggatgggatggataaaccccaacagcggaggaacaaattacgcacaaaaatttcaaggacgagtaacaatgaccagagacacatcaatatcaacagcatacatggaattatcacgacttcgatccgatgacacagcagtatactactgcgcaagatcccccaacccatactactatgactcatctggatattactatccaggagcattcgacatatggggacaaggcacaatggtaaccgtatcatcagcatccgtagccgcaccatcagtcttcatattcccacctagcgacgaacaactaaaaagcggaacagcatcagtagtatgcttattaaataacttctacccacgagaagcaaaagtacaatggaaagtagacaacgctctacaatcaggaaactcacaagaatcagtaacagaacaggactcaaaagactctacttattcactatcctcaaccctcacactatcaaaagcagactacgaaaaacataaagtctacgcatgtgaagtaacacaccaaggcctatcatcaccagtgacaaaatcattcaacagaggtgaatgtgacaaaacacatacatgtccaccatgccctgctccagaattattaggcggaccatccgttttcctatttccaccaaaacctaaagacacattaatgatcagtagaactccagaagttacctgcgttgttgtagatgtatcacatgaagacccagaagtaaaattcaactggtacgtagatggtgttgaagtacacaacgcaaaaacaaaacctagagaagaacaatacaactctacatacagagtagtatcagtactaaccgtattacatcaagactggttaaatggtaaagaatacaaatgcaaagtctcaaataaagcactaccagcacctatagaaaaaacaatatccaaagcaaaaggacaaccaagggaaccacaagtatgtacactaccaccatcaagagacgaactaacaaaaaatcaagtatctttatcatgcgcagtcaaaggattttacccatcagatatagcagtagaatgggaatcaaacggacaacccgaaaataactataaaacaacaccaccagtattagactcagatggatcattttttttagtatcaaaactgaccgtcgataaatcacgatggcaacaaggcaacgtgttctcatgctcagtcatgcacgaagcattacataaccactacacacaaaaatcattatcattatccccaggaaaa

SEQ ID NO: 46773 - RNA, 1359 nt, synthetic construct
  misc_feature 1..1359: note = derived and/or modified sequence opt6 from Vanucizumab_HeavyChain2
  source 1..1359: mol_type = other RNA
gaagtacaactagtagaatccggaggaggattagtacaacctggcggttcccttagattatcatgtgcagcatcaggttatacatttactaattatggaatgaactgggtccgacaagccccaggaaaaggattagagtgggtaggatggataaacacatatacaggagaaccaacatacgccgccgactttaaacgcagatttactttctctttagacacatcaaaatccacagcataccttcaaatgaattcactaagagcagaagacacagcagtatattactgcgcaaaatatccacactactacggatcctcacactggtacttcgacgtttggggacaaggcacattagtaacagtaagctcagcctcaactaaaggaccatcagtattccccttagcaccttcatcaaaatccacatccggaggtacagctgccctaggatgtttagtcaaagattacttccccgaaccagtaacagtatcatggaattcaggcgcactaacatctggagtccatacatttcccgcagtcttacaatcttcaggactatattccctatcatcagtagttaccgtaccctcatcatcattaggaacacaaacatacatatgcaatgtaaatcataaaccatcaaacacaaaagtagacaaaaaagtagaaccaaaatcctgtgataaaactcatacatgtccaccatgccccgcaccagaattactaggaggaccttcagtcttcttattcccacccaaaccaaaagatacattaatgatatccagaacaccagaagtaacatgcgtagtagtagacgtcagtcacgaagacccagaagtcaaatttaactggtatgtagatggtgtcgaagttcacaatgcaaaaacaaaaccccgagaagaacaatataactctacatacagagtagtatcagtattaacagtattacaccaagactggctcaacggaaaagaatacaaatgcaaagtatcaaacaaagcactaccagcaccaatagaaaaaacaatatcaaaagcaaaaggacaacccagagaaccacaagtatatacacttccaccctgcagagatgaattaactaaaaaccaggtatctttatggtgtctagttaaaggattctacccatcagacatagctgtagaatgggaatcaaacggacaacctgaaaacaactacaaaaccacaccccctgtccttgactccgacggatcatttttcctatactcaaaattaacagttgacaaatcacgatggcaacaaggaaatgtattcagttgttctgtaatgcacgaagcattacataatcattatactcaaaaatcactctctttatcacccggaaaa

SEQ ID NO: 46774 - RNA, 639 nt, synthetic construct
  misc_feature 1..639: note = derived and/or modified sequence opt6 from Vanucizumab_LightChain1
  source 1..639: mol_type = other RNA
caaccaggactaactcaaccaccatcagtatcagtagcaccaggacaaacagcaagaataacatgcggaggaaacaacataggatcaaaatcagtacactggtaccaacaaaaaccaggacaagctccagtactagtagtatacgacgactccgacagaccctcaggaatacccgaaagattctcaggatcaaattcaggaaacacagcaacattaacaatatctagagtagaagcaggagacgaagcagactactactgtcaagtctgggattcatcatcagaccactacgtattcggtacaggaacaaaagtcacagtactatcatcagcatcaacaaaaggaccatcagtatttccattagcaccatcatccaaatcaacatcaggaggcacagcagcactaggatgcctagtaaaagactactttccagaaccagtaacagtatcatggaactcaggagcattaacatccggagtacacacatttccagccgtattacaatcatcaggattatactcattatcttcagtagtaaccgtaccatcatcatcactaggcacccaaacatacatatgtaacgtaaaccacaaaccatcaaacacaaaagtagacaaaaaagtagaaccaaaatcatgc

SEQ ID NO: 46775 - RNA, 642 nt, synthetic construct
  misc_feature 1..642: note = derived and/or modified sequence opt6 from Vanucizumab_LightChain2
  source 1..642: mol_type = other RNA
gatatacaaatgacacaatcaccatcatcactatcagcatcagtaggagacagagtaacaataacatgctcagcatcacaagacatatcaaactacttaaactggtatcaacaaaaaccaggaaaagcacccaaagtactaatatacttcacatcctcactacactcaggagtaccatcaagattctcaggatcaggctcaggaacagacttcacactaacaatatcctctctacaaccagaagacttcgcaacatactactgccaacaatactcaacagtaccatggacatttggacaaggaacaaaagtcgaaataaaaagaacagtagcagccccatctgtattcatattcccaccatcagacgaacaattaaaatcaggaacagcatcagtagtatgcctactaaacaacttctacccacgcgaagcaaaagtacaatggaaagtagacaacgcactccaatccggaaactcacaagaatccgtaacagaacaagactcaaaagactcaacatattcactatcatcaacactaacactatcaaaagcagactacgaaaaacacaaagtatacgcatgcgaagtaacacaccaaggactatcatcaccagtaaccaaatcattcaaccgaggagaatgc

SEQ ID NO: 46776 - RNA, 1356 nt, synthetic construct
  misc_feature 1..1356: note = derived and/or modified sequence opt6 from Varlilumab_HeavyChain1
  source 1..1356: mol_type = other RNA
caagtacaactagtagaatcaggtggaggcgtagtccaaccaggaagaagtttaagactaagttgtgctgcatcaggattcactttttcatcttacgacatgcactgggtaagacaagcaccaggaaaaggactagaatgggtagcagtaatctggtacgacggatctaacaaatattacgcagactcagtcaaaggaagattcaccatctcaagagataattcaaaaaatactttatacctccaaatgaacagcctaagagcagaagacacagcagtttattattgcgcaagaggctcaggcaactggggattcttcgattactggggacaaggaacactagtaacagtatcttccgcatcaacaaaaggcccaagcgtctttccattagccccctcaagtaaatctacatctggcggaacagcagcattaggatgcctagtaaaagactatttcccagaaccagtaactgtctcatggaactcaggagcattaacatcaggagtacacacatttcctgcagtactacaaagcagtggcctatattcattatcatcagtagtcacagttccaagttcatcacttggtacacaaacatacatctgtaatgtaaaccataaaccatcaaacacaaaagttgataaaaaagtagaaccaaaaagttgcgataaaacacatacttgtcccccctgcccagcacccgaattattgggaggaccatcagttttcctattccccccaaaaccaaaagataccttaatgataagtagaacacccgaagtaacatgcgttgtcgtcgacgtatcacatgaagacccagaagttaaatttaactggtacgtagacggagtagaagtccacaacgcaaaaacaaaaccaagagaagaacaatacaactcaacatacagagtagttagcgtattaacagtcttacatcaagactggttaaacggaaaagaatacaaatgcaaagttagcaacaaagcattaccagccccaattgaaaaaacaatatcaaaagcaaaaggacaaccacgagaaccacaagtatatacactaccaccgtcaagagatgaactcaccaaaaaccaagtaagtttaacatgtctagtaaaaggattttatccatcagacatagcagtcgaatgggaatcaaacggacaaccagaaaacaactacaaaactacaccaccagtattagactcagacggttcattcttcctatatagtaaacttacagtagacaaatcacgatggcaacaaggtaacgtattcagttgttctgtaatgcacgaagcattacacaaccattatacacaaaaatcattatcactaagtccaggaaaaggatcatca

SEQ ID NO: 46777 - RNA, 642 nt, synthetic construct
  misc_feature 1..642: note = derived and/or modified sequence opt6 from Varlilumab_LightChain1
  source 1..642: mol_type = other RNA
gacatacaaatgacacaatctccatcaagcctatcagcatcagtaggagacagagtaacaataacatgcagagcatcacaaggaatatcaagatggctagcatggtaccaacaaaaaccagaaaaagcaccaaaatccttaatatacgcagcatcatcactacaatccggcgtaccatcaagattctcaggatcaggatcaggaacagacttcacactaacaatctcctcactacaaccagaagacttcgccacatactactgccaacaatacaacacatatccacgcacattcggacaaggaacaaaagtagaaataaaaagaacagtagcagcaccatcagtattcatattcccaccctcagacgaacaactaaaatcaggaacagcatcagtagtatgcctactaaacaacttctacccacgagaagcaaaagtacaatggaaagtagacaacgcattacaaagcggaaactcacaagaatccgtaacagaacaagactcaaaagactcaacatactcactatcatcaacattaacactatcaaaagcagactacgaaaaacacaaagtatacgcatgcgaagtaacacaccaaggactatcatcaccagtaacaaaatcattcaacagaggagaatgc

SEQ ID NO: 46778 - RNA, 1338 nt, synthetic construct
  misc_feature 1..1338: note = derived and/or modified sequence opt6 from Vatelizumab_HeavyChain1
  source 1..1338: mol_type = other RNA
caagtacaattacaagaatccggaccaggactagtcaaaccatcagaaacactttcactaacatgtacagtctccggcttctcactaaccaattacggaatacactggataagacaaccaccaggaaaaggactagaatggcttggagtaatatgggcacgaggatttacaaattacaactcagccttaatgtccagattaacaatcagtaaagataactcaaaaaatcaagtatcactaaaactcagttcagtaactgcagcagacacagccgtctattattgcgcacgagctaacgatggcgtatactacgcaatggattattggggccaaggaacactagtaacagtatcatccgcctcaactaaaggaccatcagtattccctttagcaccatgttccagatcaacatccgaatctaccgctgcccttggatgtttagtaaaagactacttcccagaaccagtaacagtatcttggaacagcggcgcattaacatcaggagttcacacattcccagcagtcctacaatcttctggactatattccttatcatcagtagtaacagttcccagctcatcactaggaaccaaaacttatacatgcaacgtagaccacaaaccatccaatacaaaagtcgataaaagagtagaatcaaaatacggaccaccatgcccatcttgtcccgctccagaatttttaggcggcccatcagtctttttatttccaccaaaaccaaaagataccctaatgatatccagaacaccagaagtcacatgtgtagtagtagacgtatctcaagaagacccggaagttcaattcaactggtacgtagatggagtagaagtccataacgcaaaaacaaaaccaagagaagaacaattcaattcaacctaccgagtcgtatcagtattaacagtattacaccaagactggcttaatggaaaagaatataaatgtaaagtatcaaataaaggattacctagctccatagaaaaaactatcagtaaagcaaaaggacaaccacgagaaccacaagtttatacactaccaccatcacaagaagaaatgacaaaaaaccaagtttccttaacatgcctcgtcaaaggattctatccctctgacatagccgtagaatgggaatcaaacggccaaccagaaaataattacaaaactacaccaccagtactcgattctgacggatctttcttcctatattctagactaactgtagacaaatcaagatggcaagaaggaaatgtcttttcctgttcagtaatgcatgaagcattacacaaccattacacacaaaaatctctttcactctcattaggaaaa

SEQ ID NO: 46779 - RNA, 639 nt, synthetic construct
  misc_feature 1..639: note = derived and/or modified sequence opt6 from Vatelizumab_LightChain1
  source 1..639: mol_type = other RNA
gacttcgtaatgacacaatcaccagcattcttatcagtaacaccaggagaaaaagtaacaataacatgctcagcacaatcatccgtaaactacatacattggtaccaacaaaaaccagaccaagcaccaaaaaaattaatatacgacacatccaaattagcatcaggagtaccatcaagattctcaggctcaggatcaggaacagactacacctttacaatatcatcattagaagcagaagacgcagcaacatactactgccaacaatggacaacaaacccactaacatttggacaaggaacaaaagtagaaataaaaagaacagtagcagcaccctctgtatttatattcccaccatcagacgaacaactaaaatccggcacagcatcagtagtatgcctattaaacaacttctacccacgagaagcaaaagtacaatggaaagtagacaacgcactacaatccggaaactcacaagaatctgtaacagaacaagactcaaaagactcaacatactcactatcatcaacattaacactatcaaaagcagactacgaaaaacataaagtatacgcatgcgaagtaacacaccaaggcctatcatccccagtaaccaaatccttcaaccgaggagaatgc

SEQ ID NO: 46780 - RNA, 1353 nt, synthetic construct
  misc_feature 1..1353: note = derived and/or modified sequence opt6 from Vedolizumab_HeavyChain1
  source 1..1353: mol_type = other RNA
caagtccagctagtccaatcaggagctgaagtcaaaaaacccggagcatcagtaaaagtatcttgtaaaggatcaggatacacattcacatcatattggatgcactgggtaagacaagcaccaggacaaagactcgaatggataggagaaatagatccatcagaatcaaatacaaactacaaccaaaaatttaaaggtagagtaacactaacagtagacataagtgcttctacagcatacatggaattatcatcattaagatcagaggacacagcagtatactactgtgcaagaggcggctatgacggatgggactacgcaatagactattggggtcaaggaactctcgtaaccgtatcatcagcatctacaaaaggaccatccgtcttccccctggcaccatcatcaaaatctacatcaggtggtaccgcagcactaggatgcttagtaaaagactactttcccgaacctgtcacagtatcatggaactctggagcattaacatcaggagtacacacattcccagcagttctacaatcatcaggactttattcactttcaagcgtcgtaacagtaccctcttcatcacttggcacacaaacttacatatgcaacgtaaaccacaaaccttcaaatactaaagtagataaaaaagtagaaccaaaatcatgcgataaaacacatacctgtccaccatgtccagcaccagaactagctggagcaccatcagtatttctattcccacccaaaccaaaagacacactaatgataagccgaacaccagaagtaacatgcgtagtagtagatgtatctcacgaagacccagaagtaaaatttaactggtacgtagacggagtcgaagtacataatgcaaaaaccaaacctagagaagaacaatacaactcaacatacagagtagtatccgtactaacagtactacaccaagactggttaaacggaaaagaatataaatgcaaagtctcaaacaaagcactaccagcaccaatagaaaaaaccatatcaaaagccaaaggacaaccccgagaaccacaagtctacactctaccaccatcacgcgatgaactaacaaaaaatcaagtatcattaacttgtttagtaaaaggattctacccatcagacattgctgtagaatgggaatccaatggtcaacccgaaaacaactacaaaacaactccaccagttttagattcagacggatcttttttcctatactcaaaactaacagtagacaaatcaagatggcaacaaggaaacgtcttttcgtgttcagtaatgcatgaagcactacataaccactacacacaaaaatcactttctctatcaccaggaaaa

SEQ ID NO: 46781 - RNA, 657 nt, synthetic construct
  misc_feature 1..657: note = derived and/or modified sequence opt6 from Vedolizumab_LightChain1
  source 1..657: mol_type = other RNA
gacgtcgtaatgacccaatccccactatcactacctgtaacaccaggagaaccagcatcaatatcatgcagatcatcacaatcactagcaaaatcatatggaaacacatacctatcatggtacctacaaaaaccaggacaatcaccacaactcttaatatacggaatatcaaacagattctcaggagtcccagacagattctcaggatcaggatcaggaacagacttcacattaaaaataagcagagtagaagcagaagacgtaggcgtatactactgcctacaaggaacacaccaaccatacacattcggacaaggaaccaaagtagaaataaaaagaacagtagcagcaccatcagtattcatatttccaccaagcgacgaacaactaaaatcaggaacagcatcagtagtatgtttactaaacaacttctacccaagagaagcaaaagtccaatggaaagtagacaacgcactacaatcaggtaactctcaagaatcagtaacagaacaagactcaaaagactcaacttactcactatcatcaacattaaccttatccaaagccgactacgaaaaacacaaagtatacgcttgtgaagtaacacaccaaggattatcatcaccagtaacaaaatccttcaacagaggagaatgc

SEQ ID NO: 46782 - RNA, 1353 nt, synthetic construct
  misc_feature 1..1353: note = derived and/or modified sequence opt6 from Veltuzumab_HeavyChain1
  source 1..1353: mol_type = other RNA
caagtgcaattacaacaatcaggcgcagaagtaaaaaaaccaggatcatcggtaaaagtctcatgcaaagcctcaggatacacatttacctcttacaacatgcactgggttaaacaagcaccaggacaaggactcgaatggataggcgcaatataccccggcatgggagatacatcctacaatcaaaaatttaaaggaaaagcaacccttacagcagacgaatccacaaatacagcttatatggaattatcatccttaagatcagaagacacagcattctactattgtgcaagatccacatactacggaggagattggtatttcgacgtatggggacaaggaacaactgtaacagtatcatctgcatcaacaaaaggtccttcagtcttcccactagcaccatcatcaaaatctacatcaggaggaacagccgccctagggtgcttagtcaaagactactttccagaaccagtaacagtctcatggaactcaggagcactaacatcaggagtccacacatttccagcagtactacaatcatctggattatactcactatcatcagtagtaacagtaccttcatcttcattaggaacacaaacctatatatgcaatgtaaaccacaaaccatcaaatacaaaagtagataaaagagtagaaccaaaatcctgcgacaaaacacacacatgtccaccatgcccagctccagaactactaggcggaccatcagtattcctattccccccaaaaccaaaagacactttaatgatctcacgaacaccagaagtaacatgcgttgtcgtcgacgtctctcacgaagacccagaagtaaaattcaactggtacgttgacggagtagaagtacataatgctaaaacaaaaccacgtgaagaacaatacaattccacatacagagtagtctctgtccttacagtattacaccaagactggctcaacggaaaagaatacaaatgcaaagtttcaaataaagcattaccagctccaatagaaaaaacaatctccaaagccaaaggacaacctagagaaccccaagtatacaccttaccaccctcacgagaagaaatgaccaaaaaccaagtatcactaacatgtctagtaaaaggattctatccctcagatatagcagtagaatgggaatcaaatggacaacccgaaaataactacaaaacaactccaccagttcttgactctgacggttcatttttcttatattctaaactaacagtcgacaaatcaagatggcaacaaggaaacgtattttcctgctcagtaatgcatgaagcattacacaaccactacacacaaaaatcactatcactatcacccggaaaa

SEQ ID NO: 46783 - RNA, 639 nt, synthetic construct
  misc_feature 1..639: note = derived and/or modified sequence opt6 from Veltuzumab_LightChain1
  source 1..639: mol_type = other RNA
gacatacaattaacacaatcaccatcttctctatcagcatcagtcggagaccgcgtaacaatgacatgcagagcatcatcatcagtatcatacatccattggttccaacaaaaaccaggaaaagccccaaaaccatggatatacgcaacatcaaatctagcatcaggagtaccagtaagattctcaggatcaggctcaggaacagactacacattcacaatatcatcactacaaccagaagatatagcaacatactactgccaacaatggacatcaaatccaccaacattcggaggaggaaccaaactagaaataaaaagaacagtagcagcaccatcagtattcatattcccaccctcagacgaacaactaaaatcaggcacagcatccgtagtctgtctactaaacaacttctacccaagagaagccaaagtccaatggaaagtagacaacgcactacaatcaggaaattcacaagaatctgtaacagaacaagactcaaaagactcaacatacagcctatcatccacactaacactatccaaagcagactatgaaaaacacaaagtatacgcctgcgaagtaacacaccaaggattatcatcaccagtaacaaaatcattcaatagaggcgaatgc

SEQ ID NO: 46784 - RNA, 1359 nt, synthetic construct
  misc_feature 1..1359: note = derived and/or modified sequence opt6 from Vesencumab_HeavyChain1
  source 1..1359: mol_type = other RNA
gaagtacaactagttgaatcaggaggaggtttagtccaaccaggaggatcattacgcctctcatgcgcggcatcaggcttcaccttctcatcatacgcaatgtcatgggtacgacaagcaccaggaaaaggactggaatgggtatcacaaatatccccagccggaggatacacaaactacgcagattctgtaaaaggaagattcacaatatccgccgatacttcaaaaaatactgcatatctacaaatgaattcattaagagcagaagacactgctgtatactactgtgcacgaggagagctcccttactacagaatgagcaaagtaatggacgtatggggtcaaggaacattagtaactgtatcatctgcttccacaaaaggaccatcagtttttcctcttgcaccttcatcaaaatcaacctcaggcggcacagcagccctaggttgcctagtaaaagactattttccagaaccagttacagtatcatggaacagcggagctttaacatccggagtacacacatttcctgcagtattacaatcatcaggcctatattcactatcttcagtcgtcacagtaccctcatcttcactcggaacccaaacatacatatgtaacgtaaatcataaaccctcaaataccaaagtagacaaaaaagtagaacccaaaagctgtgataaaacacatacatgtccaccatgcccagcaccagaactactaggaggtccctcagtattcttatttcctccaaaaccaaaagacacattaatgatatcaaggacacccgaagtaacttgcgtagtcgtagacgtatcacatgaagatccagaagtaaaattcaattggtacgtagatggcgtagaagtacataatgcaaaaacaaaaccaagagaagaacaatacaactctacctatcgagtagtatcagttttaacagtactacaccaagattggcttaacggaaaagaatataaatgcaaagtatcaaacaaagcacttccagcacccatagaaaaaacaatctctaaagcaaaaggacaaccaagagaaccacaagtctatacactcccaccatctagagaagaaatgacaaaaaaccaagtatcattaacatgcttagttaaaggattctatccttcagacatcgcagttgaatgggaatcaaacggacaacccgaaaataactataaaacaacaccaccagtactcgactcagacggaagctttttcctatactcaaaattaacagtagataaatccagatggcaacaaggaaacgtattctcctgttccgtaatgcacgaagccttacataaccactacacccaaaaaagcctatcactatcaccaggaaaa

SEQ ID NO: 46785 - RNA, 642 nt, synthetic construct
  misc_feature 1..642: note = derived and/or modified sequence opt6 from Vesencumab_LightChain1
  source 1..642: mol_type = other RNA
gacatacaaatgacacaatcaccatcatcactatcagcatcagtaggagaccgcgtaacaataacatgtcgcgcatcacaatacttctcatcatacttagcatggtaccaacaaaaaccaggaaaagcaccaaaactactaatatacggagcatcatcccgagcatcaggagtaccatcaagattctcaggctcaggatcaggaacagacttcacattaacaatatcatcattacaaccagaagacttcgcaacatactactgccaacaatacctaggatcaccaccaacattcggacaaggaacaaaagtagaaataaaaagaacagtagccgcaccatcagtattcatcttcccaccctcagacgaacaactcaaatcaggcacagcatcagtagtatgcttactaaacaacttctacccaagagaagcaaaagtacaatggaaagtagacaacgcattacaatccggaaactcacaagaatcagtaacagaacaagacagcaaagactcaacatactcattatcatcaacactaacactatcaaaagcagactacgaaaaacacaaagtatacgcatgcgaagtaacacaccaaggactatcctcaccagtaaccaaatccttcaacagaggagaatgc

SEQ ID NO: 46786 - RNA, 1338 nt, synthetic construct
  misc_feature 1..1338: note = derived and/or modified sequence opt6 from Visilizumab_HeavyChain1
  source 1..1338: mol_type = other RNA
caagtacaactagtacaatcaggcgcagaagtaaaaaaaccaggagcatcagtaaaagtatcatgcaaagcctcaggatacactttcatctcatacacaatgcattgggtaagacaagctccaggacaaggattagaatggatgggatacataaacccacgctcaggatatacccattataaccaaaaactaaaagacaaagccactttaacagcagataaatcagcctcaacagcatacatggaattatcaagtctaagatcagaagacacagcagtttactactgcgctagatccgcatattatgattatgacggcttcgcatattggggacaaggaacactagtaacagtatcttcagcaagcaccaaaggaccatcagtattccccttagcaccatgctcaagatcaacatcagaatcaacagcagcattaggatgcctagttaaagactattttcctgaaccagtaacagtatcatggaattctggagcattaacaagcggagttcacaccttcccagctgtcttacaatcaagcggcctttactcactctcatcagtagtaacagtaccatccagcaacttcggaacccaaacatacacatgcaacgtagaccataaaccatcaaacaccaaagtagacaaaacagtagaacgaaaatgctgcgtagaatgccctccatgcccagcaccaccagccgcagccccatcagtctttcttttcccaccaaaacccaaagatacactaatgatatcacgaaccccagaagtaacatgcgtagttgttgacgtaagtcacgaagatcctgaagtacaattcaactggtacgtcgacggtgtagaagtacacaacgcaaaaacaaaacccagagaagaacaattcaactccacatttagagtagtctctgtacttaccgtagtacatcaagattggttaaacggtaaagaatacaaatgcaaagtatcaaacaaaggactgccagcaccaatagaaaaaaccatatctaaaacaaaaggtcaaccacgagaaccacaagtatacactttaccaccctcaagagaagaaatgacaaaaaaccaagtatcactaacatgtttagtaaaaggattttatccatccgatatagcagtagaatgggaatccaacggacaacccgaaaacaactataaaaccacaccacctatgttagactctgatggatcattcttcctatactcaaaactcaccgtagataaatctagatggcaacaaggaaatgtattctcatgttcagtaatgcatgaagctttacataatcactatacacagaaatcattatccctatcaccatcaaaa

SEQ ID NO: 46787 - RNA, 639 nt, synthetic construct
  misc_feature 1..639: note = derived and/or modified sequence opt6 from Visilizumab_LightChain1
  source 1..639: mol_type = other RNA
gacatacaaatgacacaatcaccatcatcactatcagcctcagtaggagacagagtaacaataacatgctccgcatcatcatcagtatcatacatgaactggtaccaacaaaaaccaggaaaagcaccaaaacgactaatatacgacacatcaaaactagcatcaggagtaccaagccgattctccggatcaggctcaggaacagacttcacactcacaatatcatcactacaaccagaagactttgcaacatactactgccaacaatggtcatcaaacccaccaacattcggaggaggaacaaaagtagaaataaaaagaacagtagcagcaccatcagtattcatattcccaccatcagatgaacaactaaaatcaggaacagcatcagtagtatgcctactaaacaacttctacccacgagaagcaaaagtacaatggaaagtagacaacgcactccaatcaggaaactcacaagaatcagtaacagaacaagactcaaaagactcaacatacagcctatcatcaacattaacactatcaaaagcagactacgaaaaacacaaagtatacgcatgcgaagtaacccaccaaggcctatcatcaccagtaacaaaatcattcaacagaggagaatgt

SEQ ID NO: 46788 - RNA, 1353 nt, synthetic construct
  misc_feature 1..1353: note = derived and/or modified sequence opt6 from Volociximab_HeavyChain
  source 1..1353: mol_type = other RNA
caagtacaactaaaagaatcaggaccaggactagtagccccatcacaatcattatccatcacctgcacaatatctggattctcactaacagactacggagtacactgggtcagacaacccccaggaaaaggtctagaatggctagtagtaatatggtcagatggctctagtacatacaactcagctctcaaatcaagaatgacaataagaaaagacaactcaaaatcacaagtattcctaattatgaattcattacaaacagacgactcagctatgtattactgtgcccgtcacggaacatactatggcatgacaacaaccggagatgctcttgactactggggacaaggtacatcagtaacagtaagttcagcatccacaaaaggaccatctgtatttccattagctccatgctctcgaagcacatccgaatcaacagctgcactcggatgcctagtaaaagattattttccagaaccagtaacagtctcttggaactcaggagcattaacatcaggagtacatactttcccagcagtcctacaaagttcaggtctatactcattatcaagtgtagtaacagtaccatcatcaagtctaggaaccaaaacatatacatgtaatgtcgaccacaaaccttcaaatacaaaagtcgataaaagagtagaatcaaaatacggtccaccttgcccatcatgtcccgcccccgaattcttaggaggaccatcagtatttctattcccacctaaaccaaaagatacattaatgataagtagaaccccggaagtaacctgtgtcgtcgtagatgtatctcaagaagacccagaagtccaattcaactggtacgtagacggagtagaagtacataacgccaaaacaaaaccaagagaagaacaattcaactcaacataccgtgtagtatcagttcttaccgtactacaccaagactggctaaacggcaaagaatataaatgcaaagtatcaaacaaaggtttacctagttcaatagaaaaaacaatatctaaagcaaaaggacaaccacgagaaccacaagtatacacattaccacccagccaagaagaaatgactaaaaatcaagtctcattaacatgcctagtaaaaggattttacccatcagatatagccgtagaatgggaatctaacggacaaccagaaaataattacaaaaccacacctccagtcttagattcagacggatccttctttctatattcacgattaactgtagataaatcacgctggcaagaaggaaatgtattcagttgttctgtaatgcacgaagccctacataaccattacactcaaaaaagtctatcactatctcttggaaaa

SEQ ID NO: 46789 - RNA, 645 nt, synthetic construct
  misc_feature 1..645: note = derived and/or modified sequence opt6 from Volociximab_LightChain
  source 1..645: mol_type = other RNA
caaatagtattaacacaatccccagcaataatgtcagcatcactaggagaaagagtaacaatgacatgcacagcatcatcatcagtatcatccaactacctacactggtaccaacaaaaaccaggatcagcaccaaacttatggatatactccacatcaaacctagcatcaggagtacccgcaagattctcaggatcaggatccggcacatcatactcactaacaatatcatccatggaagcagaagacgcagcaacttactactgccaccaatacctaagatcacctccaacattcggaggtggaacaaaactagaaataaaacgaacagtagcagcaccatcagtattcatattcccaccatcagatgaacaactcaaatcaggaacagcatcagtagtatgcctactaaacaacttctacccacgagaagcaaaagtacaatggaaagtagacaacgcactacaatcaggaaactcacaagaatcagtaacagaacaagactcaaaagactcaacatactcattatcatcaacattaacattatcaaaagcagactacgaaaaacacaaagtctacgcatgcgaagtaacacaccaaggactatcctcaccagtaacaaaatcattcaacagaggagaatgt

SEQ ID NO: 46790 - RNA, 1344 nt, synthetic construct
  misc_feature 1..1344: note = derived and/or modified sequence opt6 from Vorsetuzumab_HeavyChain1
  source 1..1344: mol_type = other RNA
caagtacaattagtacaaagcggagcagaagtaaaaaaaccaggtgcttccgtaaaagtctcctgcaaagcatcaggatacacctttactaactatggaatgaactgggttagacaagcaccaggacaaggactaaaatggatgggatggataaatacatacacaggtgaaccaacctacgcagacgcattcaaaggaagagtcacaatgacaagagatacatcaatatctacagcatacatggaactatcacgactaagaagtgatgataccgcagtatactactgcgcaagagactacggagattatggaatggattactggggacaaggtacaaccgtaaccgtttcctcagcatcaacaaaaggaccctcagtattcccactagcaccatcctcaaaatcaacttctggaggaacagcagcactaggctgtttagtaaaagactatttccccgaaccagtaacagtctcatggaacagtggcgcactaacatcaggagtacacaccttccccgcagtattacaatccagcggattatactcattatcttctgtcgttacagtaccttcaagttcactaggaacacaaacctatatatgcaacgtaaaccacaaaccttctaacacgaaagtagacaaaaaagtagaaccaaaatcatgtgacaaaacacatacatgcccaccttgcccagccccagaattattaggaggaccttccgtatttctctttccaccaaaaccaaaagacacactaatgatctccagaacacccgaagttacatgtgtcgtcgtagacgtatcacacgaagaccccgaagttaaatttaactggtatgtagatggagtagaagtacacaatgctaaaactaaaccaagagaagaacaatacaactccacatacagagtcgtatcagtacttacagtactccaccaagactggctaaacggaaaagaatataaatgtaaagtatcaaacaaagccttacctgcccccatagaaaaaacaatttcaaaagccaaaggacaacctagagaaccccaagtatatacactcccaccctcacgagacgaactaacaaaaaaccaagtctctctaacatgcctcgtaaaaggtttctacccatcagatatagcagtagaatgggaatcaaacggacaacccgaaaacaactataaaacaacaccaccagtattagacagcgacggatctttcttcttatactcaaaactaacagttgacaaatccagatggcaacaaggaaatgtattctcatgctctgtaatgcacgaagcattacacaatcactacacacaaaaatcactttcattatctcccggcaaa

SEQ ID NO: 46791 - RNA, 654 nt, synthetic construct
  misc_feature 1..654: note = derived and/or modified sequence opt6 from Vorsetuzumab_LightChain1
  source 1..654: mol_type = other RNA
gatatagtgatgacacaatcaccagacagtctagcagtaagtttaggagaaagagcaaccataaactgtagagcaagcaaaagcgtaagcacaagcggatactcattcatgcactggtaccaacaaaaaccaggacaaccaccaaaactcctaatatacttagcatcaaatttagaaagcggagtaccagatagattctcaggatcaggctcaggcacagactttacattaacaataagctcactacaagcagaagacgtagcagtatactattgccaacactcaagagaagtaccatggacattcggacaaggaacaaaagtagaaataaaacgaacagtagcagcaccaagcgtattcatattcccaccatcagacgaacaactaaaatcaggcacagcatcagtagtatgcttattaaataacttttacccaagagaagcaaaagtacaatggaaagtagataacgcactacaaagcggaaactcacaagaaagcgtaacagaacaagatagcaaagactcaacatatagtctaagctcaacattaacattaagcaaagctgactacgaaaaacataaagtatacgcatgcgaagtaacacaccaaggattaagctcacctgtaacaaaaagctttaacagaggagaatgc

SEQ ID NO: 46792 - RNA, 1344 nt, synthetic construct
  misc_feature 1..1344: note = derived and/or modified sequence opt6 from Vorsetuzumab_mafodotin_HeavyChain1
  source 1..1344: mol_type = other RNA
caagttcaactagtacaatcaggagcagaagttaaaaaacccggagccagtgtcaaagtatcatgcaaagcatcaggatacacatttacaaactacggaatgaattgggttagacaagcacccggacaaggactaaaatggatgggatggataaacacttatacaggagaaccaacatacgccgatgcttttaaaggaagagttacaatgacacgagacacatcaatatcaaccgcatacatggaattatctagactaagatcagatgacacagcagtctattactgtgcaagagactacggcgactacggcatggactactggggacaaggaacaacagtcacagtatcatccgcatctacaaaaggtccctcggtattcccattagctccatcctcaaaatctacatcaggcggaaccgctgcattaggatgtttagtaaaagattacttcccagaacccgtaacagtatcatggaactccggagcactaacatcaggagtacacacatttccagcagtactacaatcatcaggcttatactcactctcatctgttgtaacagtaccatcttcatcactaggaacccaaacctacatatgcaatgtaaaccacaaaccaagcaacacaaaagtagataaaaaagttgaacccaaatcatgtgataaaacacacacctgcccaccatgccctgcaccagaattactcggaggaccatctgtcttcttattccctccaaaaccaaaagatactttaatgatatcaagaacaccagaagtaacatgtgttgtagtcgacgtatcccacgaagatccagaagtaaaatttaactggtacgtcgatggagtagaagttcacaatgcaaaaactaaaccaagagaagaacaatacaattctacataccgagtcgtatcagtactaaccgtactccatcaagattggctaaacggaaaagaatacaaatgcaaagtatctaataaagccctaccagcaccaatagaaaaaacaataagcaaagcaaaaggacaaccacgagaaccacaagtatacacactcccaccctccagagatgaattaactaaaaaccaagtctcactaacatgcctagtcaaaggattttatccatcagacatagcagtcgaatgggaatcaaacggacaaccagaaaataattacaaaacaaccccaccagttttagactctgacggatccttcttcctttattcaaaattaacagtagacaaatcaagatggcaacaaggaaacgtatttagttgctccgtcatgcacgaagcactacataaccactacacacaaaaatcattatcattatcaccaggaaaa

SEQ ID NO: 46793 - RNA, 654 nt, synthetic construct
  misc_feature 1..654: note = derived and/or modified sequence opt6 from Vorsetuzumab_mafodotin_LightChain1
  source 1..654: mol_type = other RNA
gatatagtaatgacacaatcaccagactcactagcagtatccttaggagaaagagcaacaataaattgcagagcatcaaaatcagtaagcacatcaggatactcattcatgcactggtaccaacaaaaacccggacaaccaccaaaactactaatatacctagcaagtaacctagaatccggagttccagacagattctcaggctcaggatcaggaacagacttcacactaacaatatcatcattacaagccgaagatgtagcagtatactattgccaacactcaagagaagtaccatggacattcggacaaggaacaaaagtagaaataaaaagaacagtcgcagcaccatctgtattcatatttccaccatcagacgaacaactaaaatcaggcacagcatcagtagtatgtctactaaacaacttttacccaagagaagcaaaagtacaatggaaagtcgacaacgcactccaatcaggaaactcacaagaatcagtaacagaacaagactcaaaagactcaacatacagcctatcatccaccttaacactatcaaaagcagattacgaaaaacacaaagtatacgcatgcgaagtaacacaccaaggattaagctcaccagtaacaaaatcattcaacagaggagaatgc

SEQ ID NO: 46794 - RNA, 1347 nt, synthetic construct
  misc_feature 1..1347: note = derived and/or modified sequence opt6 from Yttrium_(90Y)_clivatuzumab_tetraxetan_HeavyChain1
  source 1..1347: mol_type = other RNA
caagtacaattacaacaatccggcgccgaagttaaaaaacccggagcatcagtaaaagtatcatgcgaagcttccggatatacatttccctcctacgttttacactgggtaaaacaagcaccaggacaaggattagaatggataggatatataaatccatacaatgacggaactcaatataacgaaaaattcaaaggcaaagcaacactaacacgcgacacttcaataaatacagcatacatggaactatctagacttagaagtgacgacacagcagtatattattgcgcccgaggattcggaggaagttatggattcgcatattggggacaaggaaccctagtaacagtctcatcagcatcaacaaaaggaccatctgtattcccactagccccatcttcaaaatcaacatcaggaggcaccgctgcacttggatgcttagtaaaagattacttcccagaaccagtaacagtttcatggaactctggagcactaacaagcggtgtacatacattcccagcagtcttacaatcatcaggactatatagtttaagctcagtagtcaccgtaccttcatcttccttaggaacacaaacttatatatgcaatgtaaaccacaaaccaagtaacacaaaagtagacaaacgtgtcgaaccaaaatcatgcgacaaaacacacacatgcccaccatgccctgcaccagaactattaggaggaccaagtgtattcttattcccaccaaaaccaaaagacacattaatgatctctcgaacaccagaagtaacatgcgtcgtcgtagatgtctctcacgaagacccagaagtaaaattcaattggtacgtcgacggcgttgaagtacacaatgcaaaaacaaaacctagggaagaacaatataattcaacatacagagtagtatcagttcttacagtactacaccaagattggttaaatggaaaagaatacaaatgtaaagtatcaaataaagcactaccagcaccaatagaaaaaactatatcaaaagcaaaaggtcaaccaagagaaccacaagtatacaccctaccaccctcaagggaagaaatgactaaaaaccaagtctcccttacatgtctagttaaaggattctacccatcagacatcgcagtagagtgggaatcaaacggacaaccagaaaacaattacaaaacaacaccaccagtcttagactcagatggctcattcttcctatattctaaactaaccgtcgacaaatcacgctggcaacaaggaaatgtcttctcatgctctgttatgcacgaagcattacataatcattatacacaaaaatcactatccctatcaccaggaaaa

SEQ ID NO: 46795 - RNA, 645 nt, synthetic construct
  misc_feature 1..645: note = derived and/or modified sequence opt6 from Yttrium_(90Y)_clivatuzumab_tetraxetan_LightChain1
  source 1..645: mol_type = other RNA
gacatacaactaacacaatcaccatcatcattatcagcatccgtaggagacagagtaacaatgacttgctcagcatcatcatcagtatcatcatcatacttatattggtatcaacaaaaaccaggaaaagcaccaaaactatggatatactcaacatcaaacttagcatcaggagtaccagcaagattctcaggatccggatcaggaacagacttcacactaacaatatcctcattacaaccagaagactcagcatcatacttctgccaccaatggaacagatacccatacacattcggaggaggaacaagactagaaataaaaagaacagtagcagcaccatccgtattcatattcccaccatcagacgaacaactaaaatcaggaacagcctcagtagtatgcctattaaacaacttctacccaagagaagcaaaagtacaatggaaagtagacaacgcactacaatctggaaactcccaagaatcagtaacagaacaagactcaaaagactccacatactcactatcatcaactctaacactatccaaagcagactacgaaaaacacaaagtatacgcatgcgaagtaacacaccaaggcctatcatcaccagtaacaaaatcattcaaccgaggagaatgt

SEQ ID NO: 46796 - RNA, 1338 nt, synthetic construct
  misc_feature 1..1338: note = derived and/or modified sequence opt6 from Yttrium_Y_90_epratuzumab_tetraxetan_HeavyChain1
  source 1..1338: mol_type = other RNA
caagttcaattagtacaatcaggcgcagaagtaaaaaaaccaggttcatctgtaaaagtatcctgcaaagcctccggatacacattcacatcatactggttgcactgggtaagacaagcacctggccaaggactcgaatggataggatatataaaccccagaaatgactacacagaatacaaccaaaatttcaaagacaaagctactataacagcagatgaaagtacaaacactgcatacatggaactatcttctctaagatcagaagacacagcattttacttctgcgctcgccgagacataaccacattttattggggacaaggcaccaccgtaacagtatcatcagcatcaacaaaaggtccctcagtatttccactagcaccttcatcaaaatcaacatcaggaggaacagcagcattaggttgcctagtaaaagactacttcccagaaccagtaacagtttcatggaactcaggcgccttaacttcaggagtacatacattcccagcagtactacaatcatcaggcttatactcattatcatcagtagtaaccgtaccctcctcatctctaggaacacaaacatatatatgcaacgtaaaccacaaaccatcaaataccaaagttgacaaaagagtagaacctaaatcatgcgataaaacacatacatgcccaccatgcccagcacccgaactacttggaggcccaagcgtattcctatttcccccaaaacccaaagacacattaatgatctcaagaacaccagaagttacatgtgtagtagtagacgtatcacacgaagacccagaagttaaattcaactggtatgtagacggagtagaagtacacaatgcaaaaacaaaaccaagagaagaacaatacaactcaacatacagagtcgtatctgttttaacagtactacaccaagactggctaaatggcaaagaatacaaatgcaaagtatcaaacaaagcactaccagctccaatagaaaaaacaatatctaaagcaaaaggacaaccccgagaaccacaagtttacaccttacccccctctcgagaagaaatgaccaaaaaccaagtctctctaacatgtctagttaaaggattctacccatcagacattgcagtagaatgggaatcaaatggacaacctgaaaacaattacaaaacaacaccacccgtacttgattccgacggatcattcttcctctactcaaaacttactgtagacaaatctagatggcaacaaggaaacgtattctcttgctctgtaatgcatgaagcactacacaaccactacacacaaaaatcattatccctgtcaccaggaaaa

SEQ ID NO: 46797 - RNA, 657 nt, synthetic construct
  misc_feature 1..657: note = derived and/or modified sequence opt6 from Yttrium_Y_90_epratuzumab_tetraxetan_LightChain1
  source 1..657: mol_type = other RNA
gacatacaactaacacaatcaccatcatcactatcagcatccgtaggagacagagtaacaatgtcctgcaaatcatcccaatcagtattatactcagcaaaccacaaaaactacctagcatggtatcaacaaaaaccaggaaaagcaccaaaattactaatatactgggcatcaacaagagaatcaggagtaccatcaagattctcaggatccggatcaggaacagacttcacattcacaatatcatccttacaaccagaagacatagcaacctactactgccaccaatacctatcatcatggacattcggaggaggaacaaaagtacaaataaaaagaacagtagcagctccatcagtattcatattccccccctcagacgaacaactaaaatcaggaacagcatcagtagtctgcctactaaacaacttctacccaagagaagcaaaagtacaatggaaagtagataacgcactacaatcaggaaactcacaagaatcagtaacagaacaagactcaaaagactctacatactccctatcaagcacactaacactctcaaaagcagattacgaaaaacacaaagtatacgcatgcgaagtaacacaccaaggtttatcatcacccgtaacaaaatcattcaaccgaggagaatgc

SEQ ID NO: 46798 - RNA, 1326 nt, synthetic construct
  misc_feature 1..1326: note = derived and/or modified sequence opt6 from Yttrium_Y_90_epratuzumab_HeavyChain1
  source 1..1326: mol_type = other RNA
caagtacaactcgtccaatcaggagcagaagtaaaaaaaccaggatcatcagtaaaagtatcatgcaaagcctcaggctataccttcacatcatattggctacactgggtacgacaagcacccggccaaggcttagaatggatagggtacataaacccaagaaacgactacacagaatataaccaaaactttaaagacaaagctacaataacagcagacgaatccacaaatacagcatatgaactatcatcattaagatccgaagacacagccttctacttctgcgcaagacgagacataacaacattttactggggacaaggaaccacagtaacagtatcatccgcatctaccaaaggtccttcagtcttccctttagccccatcatcaaaaagcacatcaggaggaaccgccgcacttggatgcttagtcaaagactactttcctgaacccgtaaccgtatcatggaactctggtgctctaacatcaggagtacacacatttccagccgtactacaatcatccggcttatactcattatcatcagtagtaaccgtcccatcctcatcactaggcacacaaacatacatatgcaacgtaaatcataaaccatcaaataccaaagttgacaaacgtgtcgaaccaaaatcatgcgacaaaacacatacatgcccaccctgcccagcaccagaattactaggtggtccttccgtcttcctattcccacccaaacctaaagacaccctaatatctagaacaccagaagtcacttgcgtagtcgtagacgtatcacacgaagacccagaagtcaaatttaactggtacgtcgacggagtagaagttcacaatgcaaaaacaaaacccagagaagaacaatataactctacatacagagtagtttccgtcctaacagtcctacaccaagactggctcaatggaaaagaatacaaatgcaaagtatcaaacaaagctttaccagcaccaatagaaaaaacaatatcaaaagcaaaaggacaacctagagaaccacaagtatacaccctacctccatcaagagaagaaacaaaaaaccaagtttcattaacatgcttagtaaaaggtttctatccatcagacattgcagtagaatgggaatccaacggacaaccagaaaacaactacaaaactacaccaccagttttagactccgacggatcatttttcctatacagcaaacttacagtagacaaatcacgatggcaacaaggaaacgtattttcatgctccgtacacgaagccctacacaatcactatacccaaaaatctctctctctctcaccaggaaaa

SEQ ID NO: 46799 - RNA, 654 nt, synthetic construct
  misc_feature 1..654: note = derived and/or modified sequence opt6 from Yttrium_Y_90_epratuzumab_LightChain1
  source 1..654: mol_type = other RNA
gacatacaactaacacaatcaccatcttcactatccgcatcagtaggcgacagagtaacatcatgcaaatcatcccaatcagtattatactcagcaaaccacaaaaactacttagcatggtaccaacaaaaaccaggaaaagcaccaaaactactaatatactgggcctccacaagagaatcaggagtaccatccagattctccggatcaggatccggaaccgacttcacattcacaatatcatcactacaaccagaagacatagcaacatactactgccaccaatacttatcatcctggacattcggaggaggaacaaaagtacaaataaaaagaacagtagcagcaccatcagtatttatattcccaccatcagacgaacaattaaaatcaggaacagcatcagtagtatgcctactaaacaacttctacccaagagaagcaaaagtacaatggaaagtagacaacgccctacaaagcggaaactcacaagaatcagtaacagaacaagactcaaaagactcaacatactcactatcatcaaccctaacactatcaaaagccgactacgaaaaacacaaagtatacgcatgtgaagtaacacaccaaggattatcctcaccagtaacaaaatcatttaacagaggagaatgc

SEQ ID NO: 46800 - RNA, 1365 nt, synthetic construct
  misc_feature 1..1365: note = derived and/or modified sequence opt6 from Zalutumumab_HeavyChain1
  source 1..1365: mol_type = other RNA
caagtacaattagtcgaatcaggtggaggagtagtacaacctgggagatcattacgattatcatgtgctgcgtcaggatttacatttagtacttatggcatgcattgggtaagacaagcaccaggaaaaggactagaatgggttgcagtaatctgggatgatggctcatacaaatattatggagatagcgtaaaaggcagatttactatttcaagagataatagcaaaaacacattatacttacaaatgaatagcttaagagccgaagatacagctgtttattactgtgctagagacggaatcacaatggtaagaggagtaatgaaagactattttgattactggggacaaggaacactagttacggtatcaagtgcttcaacaaaaggaccatcagtgtttccactagcaccatcatcaaaatcaacatctggaggaactgcagcattaggatgtcttgtcaaagattacttcccagaaccagtaaccgtttcatggaattccggcgcattaacatccggagtacatacatttcccgccgtattacaatcaagcggattatacagcttatcatcagtagttactgtaccatcatcatctctaggtactcaaacatacatatgtaacgtaaaccataaaccaagcaatactaaagtagataaaagagtagaaccaaaaagctgcgacaaaacacatacatgtccaccatgtccagccccagaattactaggaggaccctcagtatttttattcccaccaaaaccaaaagatacattaatgataagtagaacacctgaagttacttgtgtagtagtagacgtatcacatgaagatccagaagtcaaattcaattggtatgtagatggagtagaagtacacaacgccaaaacaaaaccacgagaagaacaatataactcaacttatagagtagtatcagtactaacagtactccatcaagactggttaaacggaaaagaatataaatgtaaagtatcaaacaaagcattaccagcacctatagaaaaaaccatttcaaaagcaaaaggacaacctcgagaaccacaagtatatacattaccacctagtagagaagaaatgacaaaaaaccaagtttccctaacatgtttggtaaaaggattttatccttctgatatagcagtagaatgggaatccaatggacaaccagaaaacaattataaaacaacacccccagtactagactcagacggatcattttttctgtattcaaaattaacagtagataaatcaagatggcaacaaggaaatgtattttcatgcagcgtaatgcatgaagccttgcataatcactatacacaaaaaagtctctcattatcacctggcaaa

SEQ ID NO: 46801 - RNA, 642 nt, synthetic construct
  misc_feature 1..642: note = derived and/or modified sequence opt6 from Zalutumumab_LightChain1
  source 1..642: mol_type = other RNA
gcaatacaactaacacaatcaccatcatcactaagtgcaagcgtaggagacagagtaacaataacctgccgagcatcccaagacatatcctcagccctagtctggtaccaacaaaaaccaggaaaagcaccaaaactactaatatacgacgcatcatcactagaatcaggagtaccatcaagattttcaggatcagaatcaggaacagacttcacactaaccatatcctcactacaacccgaagacttcgcaacatactactgccaacaattcaattcatacccactaacattcggaggaggaacaaaagtagaaataaaacgtacagtagcagcaccatcagtatttatattcccaccatcagacgaacaactaaaatcaggaacagcatcagtagtatgcttactcaacaacttctacccaagagaagctaaagtacaatggaaagtagacaacgcattacaatccggaaactcacaagaatcagtaacagaacaagactcaaaagactcaacatacagcctatcatcaacactaacactatcaaaagcagactacgaaaaacacaaagtatacgcatgcgaagtaacacaccaaggactatcctcaccagtaaccaaatcattcaacagaggagaatgc

SEQ ID NO: 46802 - RNA, 1332 nt, synthetic construct
  misc_feature 1..1332: note = derived and/or modified sequence opt6 from Zanolimumab_H0_HeavyChain
  source 1..1332: mol_type = other RNA
caagtacaactacaacaatggggagcaggcttactaaaaccatccgaaactttatcactaacatgtgcagtatacggcggttccttttcaggatactactggtcatggataagacaaccaccaggaaaaggcctagaatggataggagaaataaaccactcaggatcaacaaactacaacccatcactaaaatcaagagtaactatatccgtagatacatcaaaaaaccaattctcactaaaactttcatctgtcacagcagcagacaccgcagtatactactgcgcacgtgtaataaactggttcgacccctggggacaaggaacactggttaccgtatcttcagcgtctacaaagggcccaagtgtattcccactagcaccttcatctaaatcaacatcaggaggaaccgccgcactaggatgtctagtcaaagactacttccccgaacccgtcacagtttcatggaattccggagcactaacatccggagtacacacattcccagcagtattacaatcctcaggcctatactcactatcatcatggactgtcccatcctcatcacttggaacacaaacttacatttgcaatgtaaactttataaaaccatcaaataccaaagttgacaaaaaagtcgaaccaaaatcatgcgacaaaacccacacctgcccaccctgtcctgcacccgaactactaggaggaccatcagtatttctatttcccccaaaaccaaaagataccttaatgatatctagaacaccagaagtcacatgcgtttgggacgtatctcatgaagatcctgaagtgaaattcaactggtacgtagatggcgtagaagtccataacgcaaaaactaaaccaagagaagaacaatacaactcaacttaccgagtcgtatccgtactaaccgtcctacaccaagattggttaaatggaaaagaatacaaatgtaaagtatcaaataaagcactcccagcaccaatagaaaaaacaatatcaaaagcaaaaggacaacctagagaaccacaagtatatacattaccaccatctagagaagaaatgacaaaaaatcaagtctcattaacctgcctagtaaaaggattctatccatcagacatagcagtagaatgggaatcaaatggtcaaccagaaaataattacaaaactacaccacctgttctcgactcagatggatcattctttctatactcaaaattaacagtagacaaatcaagatggcaacaaggaaacgtattctcatgctccgtaatgcatgaagcattacacaatcattacacacaaaaatccctaagcctatcaccaggaaaa

SEQ ID NO: 46803 - RNA, 642 nt, synthetic construct
  misc_feature 1..642: note = derived and/or modified sequence opt6 from Zanolimumab_L0_LightChain
  source 1..642: mol_type = other RNA
gacatacaaatgacacaatccccatcatcagtatcagcatcagtaggagacagagtaacaataacctgcagagcctcacaagacatatcttcatggttagcagtagtataccaacacaaacccggaaaagcaccaaaactactaatatacgcagcatcctcattacaatcaggagtaccctcacgattctcaggatcaggatcaggaacagacttcacactaacaatatcatctttacaaccagaagacttcgcaacatactactgccaacaagcaaactcattcccatacacatttggaggaggaacaaaactagaaataaaaagaacagtagcagcaccatcagtattcatattcccaccatcagacgaacaactaaaatccggcacagcatcagtagtatgcctactaaacaacttctacccaagagaagcaaaagtacaatggaaagtagacaacgcattacaatcaggcaactcacaagaatccgtaacagaacaagactcaaaagactcaacatactcattatcatcaacactaacactatcaaaagcagactacgaaaaacacaaagtatacgcatgcgaagtaacacaccaaggactatcctcaccagtaacaaaattcaacagaggagaatgc

SEQ ID NO: 46804 - RNA, 1344 nt, synthetic construct
  misc_feature 1..1344: note = derived and/or modified sequence opt6 from Zatuximab_HeavyChain1
  source 1..1344: mol_type = other RNA
caagtacaactccaacaaccaggagccgaactcgtagaacctggaggttcagtaaaactttcatgcaaagcatcaggatataccttcacatcccactggatgcactgggtgaaacaacgacctggccaaggactagaatggataggagaaattaacccaagttcaggacgaaacaactacaacgaaaaatttaaatctaaagcaacactaacagtagacaaatcaagttctacagcatacatgcaattctcatccctaacatcagaagactccgctgtatactactgcgtacgctattacggatatgacgaagcaatggactattggggacaaggaacatcagtaactgtttcatccgcaagtacaaaaggaccatcagtattcccactagccccttcctcaaaatcaacatctggcggaactgcagcactaggctgtttagtaaaagactactttcccgaaccagtcacagtaagttggaattctggagccctaacaagcggagtacacacattcccagcagtcttacaatcctcaggactatatagtttaagctcagtagtaaccgtaccttcatcatctctaggaacacaaacatatatatgtaatgtaaatcataaaccatcaaatactaaagtagacaaaagagtcgaacccaaatcttgcgacaaaacacacacatgcccaccatgccccgccccagaactactaggcggtccatcagtatttctattcccaccaaaaccaaaagatacactaatgatatctagaacaccagaagtaacatgcgtagtagtagacgtaagccatgaagacccagaagtaaaattcaactggtatgtagacggagtagaagtacacaatgccaaaacaaaaccaagagaagaacaatacaattcaacatacagagtagtttctgtattaacagtactacatcaagactggctaaacggtaaagaatataaatgtaaagtctctaataaagcactacctgcaccaatagaaaaaaccatatctaaagcaaaaggccaaccaagggaaccacaagtctatacattaccaccatcacgagaagaaatgacaaaaaatcaagtctccttaacctgtctagtaaaaggattctacccatcagacatcgcagtagaatgggaatcaaatggccaaccagaaaacaattacaaaacaacaccaccagtactagactcagacggatcattcttcttatactccaaattaacagtagacaaaagccgatggcaacaaggaaacgttttttcatgctcagtaatgcatgaagcactacacaatcactacacacaaaaatccctatcgttatcacccgga

SEQ ID NO: 46805 - RNA, 657 nt, synthetic construct
  misc_feature 1..657: note = derived and/or modified sequence opt6 from Zatuximab_LightChain1
  source 1..657: mol_type = other RNA
gacatagtaatgacacaagcagcattctcaaacccagtaacattaggaacatcagcatcaatatcatgcagaagctcaaaatcactactacactcaaacggaataacatatctatactggtacctacaaaaaccaggccaatcaccacaattattaatataccaaatgtcaaacctagcatcaggagtaccagacagattctcatcatcaggatcaggaaccgacttcacactaagaataagcagagtcgaagccgaagacgtaggagtatactactgcgcacaaaacctagaactaccatacacattcggcggaggaacaaaattagaaataaaaagaacagtagcagcaccatcagtattcatattcccaccatcagacgaacaactaaaatcaggaacagcatcagtagtatgcttactaaacaacttctacccaagagaagcaaaagtccaatggaaagtagacaacgcactacaatcaggaaactcacaagaatcagtaacagaacaagactcaaaagactccacatattcactatcctcaacactaacattatcaaaagcagactacgaaaaacacaaagtatacgcatgcgaagtaacacaccaaggattatcaagccccgtaacaaaatccttcaaccgaggagaatgc

SEQ ID NO: 46806 - RNA, 1356 nt, synthetic construct
  misc_feature 1..1356: note = derived and/or modified sequence opt6 from Actoxumab_HeavyChain
  source 1..1356: mol_type = other RNA
caagtacaattggtagaatcaggaggcggagtagtacaaccaggaagatcacttagactatcatgcgcagcatcaggattctcattctccaattacggaatgcactgggtccggcaagcgccagggaaaggactagaatgggtagcactaatatggtacgacggaagtaacgaagactacacagatagcgtaaaaggaagattcacaatttcaagagacaactctaaaaacacattatacctccaaatgaactctttaagagcagaagatacagcagtatactactgcgctagatggggtatggttagaggagtaatagatgtttttgacatctggggacaaggaacagtagtaaccgtatcttcagcaagtacaaaaggaccatcagtattcccactagctcccagttctaaatcaacatcaggaggcacagccgcactaggatgtttagtaaaagactattttccagaaccagtaactgtatcatggaatagcggagcattaacaagtggagtacacacatttccagcagtattacaatcatccggactatatagcttatcatctgtagttacagtaccatcatcatcattgggaacacaaacatacatctgcaatgtaaatcataaaccttcaaacacaaaggtagataaaagagtagaacctaaatcatgtgacaaaacacacacatgtcccccatgcccagcaccagaattattaggaggaccatcagtattcctattcccaccaaaacccaaagacacactaatgatatcacgaacacctgaagtaacatgcgtagtagtagatgtaagtcatgaagatccagaagtcaaattcaactggtacgtagatggcgtagaagtacataatgcaaaaacaaaacctagagaagaacaatacaactcaacatatagagtcgtatcagtattaacagtattacaccaagactggttaaacggaaaagaatataaatgcaaagtatcaaacaaagcactaccagcaccaatagagaaaacaatatccaaagctaaaggccaaccaagagaaccacaagtatacacattacctccatcaagggaagaaatgaccaaaaaccaggtatctctaacatgtttagtaaaaggattttacccaagtgacatagctgtagaatgggaaagtaacggacaaccagaaaacaactacaaaacaacacccccagtcttagactcagacggatcattcttcctatattcaaaattaacagtagataaaagtagatggcaacaaggaaatgtattctcatgcagtgtaatgcatgaagcactccacaatcactatacacaaaaatcactatcactatcaccaggaaaa

SEQ ID NO: 46807 - RNA, 642 nt, synthetic construct
  misc_feature 1..642: note = derived and/or modified sequence opt6 from Actoxumab_LightChain
  source 1..642: mol_type = other RNA
gacatacaaatgacacaatcaccatcatcagtatcagcatcagtaggagaccgagtaacaataacatgcagagcatcacaaggaatatcctcatggctagcatggtaccaacataaaccaggaaaagcaccaaaactattaatctacgcagcatcatcactacaatcaggagtaccatcaagattctcaggatcaggatcaggaacagacttcacactaaccatctcatcattacaaccagaagacttcgcaacatactactgccaacaagcaaactcattcccatggacattcggacaaggaacaaaagtagaaataaaaagaacagtagcagccccatcagtattcatattcccaccatccgatgaacaactaaaatcaggaacagcatccgtcgtatgcctattaaacaacttctacccaagagaagccaaagtacaatggaaagtcgacaatgctctacaaagcggaaactcacaagaatcagtaacagaacaagacagtaaagactcaacatacagtctatcatcaacactaacactatcaaaggcagactacgaaaaacacaaagtatacgcatgcgaagtaacacatcaaggactatcatcaccagtaacaaaatcattcaacagaggagaatgc

SEQ ID NO: 46808 - RNA, 1326 nt, synthetic construct
  misc_feature 1..1326: note = derived and/or modified sequence opt6 from Andecaliximab_HeavyChain
  source 1..1326: mol_type = other RNA
caagtccagttacaagaatcaggacccggtttagtaaaaccaagtgaaactttatcactgacatgtaccgtatccggattctcactattatcatatggagtacactgggtcagacaaccaccaggtaaaggactcgaatggttaggcgtaatctggacaggtggcactaccaactataattcagcactaatgagtagattcactataagcaaagacgactccaaaaataccgtatatctcaaaatgaactcactaaaaaccgaagatacagcaatatactattgcgcaagatattattacggaatggattattggggacaaggtactctagtaacagtatcatcagcatcaacaaaaggaccttcagtattcccattagcaccttgttcacgaagtacatcagaatcaaccgcagcgctcggatgtttagttaaagattacttcccagaaccagtaacagtaagttggaactcaggagctctaacctcaggcgtacacacatttccagcagtactacaatcatcaggtttatactccctatcatcagtcgtaacagtaccatcatcatcattaggaacaaaaacatatacatgcaacgttgaccacaaaccctcaaatacaaaagtagataaaagagtagaatcaaaatacggaccaccttgtccaccatgtccagcaccagaatttcttggtgggccctccgtattcttatttccaccaaaaccaaaagatacactcatgatatctagaacaccagaagtaacatgtgtcgttgtagatgtctcccaagaagatcctgaagtacaatttaattggtatgttgatggtgtcgaagtacataacgctaaaacaaaacctcgcgaagaacaatttaactcaacataccgcgtagtctccgtattaacagtactacaccaagactggctaaatggtaaagaatataaatgtaaagtatcaaacaaaggattaccatcatcaatagaaaagacaatatccaaagcaaaaggacaaccaagagaaccacaagtatatacattaccaccatcacaagaagaaatgactaaaaatcaagtatcactaacatgtctagtaaaaggattttatccatccgacatagcagttgaatgggaatcgaacggacaaccagaaaataattacaaaacaacaccaccggtattagattcagatggatcattcttcttatatagcagactaacagtagataaatctagatggcaagaaggaaatgtattttcatgttccgtaatgcatgaagcattacataaccattatactcaaaaatcattaagtctatcactcggaaaa

SEQ ID NO: 46809 - RNA, 642 nt, synthetic construct
  misc_feature 1..642: note = derived and/or modified sequence opt6 from Andecaliximab_LightChain
  source 1..642: mol_type = other RNA
gacatacaaatgacacaatctccatcatcactatcagcatcagtcggagacagagtaacaataacatgcaaagcatcacaagacgtaagaaatacagtagcatggtaccaacaaaaaccaggaaaagcaccaaaactactaatatacagcagttcatacagaaacacaggagtaccagacagattttcaggatcaggatcaggaacagacttcacactaaccatatcctcactacaagccgaagacgtagccgtatactactgccaacaacactacataacaccatacacattcggaggcggaacaaaagtagaaataaaaagaacagtagcagcaccatcagtattcatatttccaccatcagacgaacaactaaaatcaggaacagcatcagtagtatgcctattaaataacttctaccccagagaagcaaaagtacaatggaaagtagacaacgcactacaatcaggaaactcacaagaatcagtaacagaacaagactcaaaagactcaacatactcattaagctcaacattaactttatcaaaagcagactacgaaaaacataaagtatacgcatgcgaagtaacacaccaaggattatcatcaccagtaacaaaatcattcaacagaggagaatgc

SEQ ID NO: 46810 - RNA, 1353 nt, synthetic construct
  misc_feature 1..1353: note = derived and/or modified sequence opt6 from Aprutumab_HeavyChain
  source 1..1353: mol_type = other RNA
gaagtacaattattagaatcaggtggtggattagtacaaccaggaggatctctaagattatcatgcgcagcatcaggcttcacattctcaagctatgcaatgtcctgggtaagacaagcacctggaaaaggattagaatgggtatcagcaatatcaggatcaggaacgtcaacatattacgctgactccgtaaaaggacgcttcacaatctccagagataactcaaaaaacactttatacctacaaatgaactcattaagagcagaagacacagcagtttactactgtgctcgagttcgttacaattggaatcacggagactggttcgacccatggggacaaggtacattagtaacagtaagctcagcatcaacaaaaggaccatctgtctttccattagcaccaagttcaaaatccacatcaggcggaacagcagcactaggatgtctagtaaaagactatttccccgaacccgtaacagtatcatggaattcaggtgcactaacatctggagttcatactttcccagcagtattacaatcctcaggactatactccttatcatccgtcgtaacagtcccctcatcatcccttggaactcaaacatatatctgcaacgtgaaccacaaaccatcaaatacaaaagttgacaaaaaagtagaaccaaaatcatgcgacaaaactcacacttgcccaccctgtccagcaccagaattattaggaggaccatcagtattcttatttccaccaaaaccaaaagacactctaatgatatcaaggacacccgaagtaacctgcgtcgtagttgacgttagtcacgaagacccagaagttaaattcaactggtacgtagacggagtagaagtacataacgcaaaaacaaaacctagagaagaacaatacaactcaacatacagagtagtatcagtattaacagtactacatcaagactggttaaacggaaaagaatataaatgcaaagtatcaaataaagcactaccagcaccaatagaaaaaaccatctccaaagcaaaaggacaacccagagaaccacaagtatacactctaccaccatcaagagatgaactaacaaaaaatcaagtaagcctaacttgccttgttaaaggcttctacccatcagacatcgctgtagaatgggaatccaacggtcaacctgaaaataactacaaaacaacccccccagttttagattcagatggaagcttttttttatattccaaattaactgtagataaatccagatggcaacaaggaaacgtattctcctgttctgtaatgcacgaagctctacacaaccattacacccaaaaatcactcagcctatcaccagga

SEQ ID NO: 46811 - RNA, 648 nt, synthetic construct
  misc_feature 1..648: note = derived and/or modified sequence opt6 from Aprutumab_LightChain
  source 1..648: mol_type = other RNA
caatcagtactaacccaaccaccctccgcatcaggaacaccaggacaaagagtaaccatatcctgctccggatcctcatcaaacataggaaacaactacgtatcatggtaccaacaactaccaggaacagcaccaaaactactaatctacgaaaactacaacagaccagctggagtcccagacagattctcaggatcaaaatcaggtacatccgcatcactagcaatatcaggactaagatcagaagacgaagcagactactactgctcaagctgggatgactcactaaactactgggtattcggaggaggaacaaaattaaccgtactaggacaaccaaaagcagcaccatccgtaacactattccccccctcatccgaagaactacaagcaaacaaagcaacactagtatgcctaatatcagacttctacccaggagcagtcacagtagcatggaaagcagactcatcacctgtaaaagcaggagtcgaaacaacaacaccatcaaaacaatcaaacaacaaatatgcagcatcatcatacctatcactcacaccagaacaatggaaatcacaccgatcctactcatgccaagtaacacacgaaggatcaacagtagaaaaaacagtagcaccaacagaatgctca

SEQ ID NO: 46812 - RNA, 1341 nt, synthetic construct
  misc_feature 1..1341: note = derived and/or modified sequence opt6 from Azintuxizumab_HeavyChain
  source 1..1341: mol_type = other RNA
gaagtccaactagtagaatcaggaggcggattagttcaacccggaggctccctaagattatcttgcgcagcatctggatttacattctcagactactatatggcctgggtcagacaagcaccaggtaaaggactagaatgggtagcatcaataaactatgacggatccagcacctattatgtagactccgtcaaaggacgattcacaatatcaagagataacgcaaaaaattcactctatctacaaatgaactcactaagagcagaagacacagcagtatactactgcgcaagagacagaggatattattttgattactggggacaaggaacaacagtaactgtaagctcagcctcaacaaaaggcccatcagttttcccattagccccatcttccaaatctacaagtggtggtaccgctgcactaggttgccttgtaaaggattatttcccagaaccagtcacagtatcctggaacagcggcgcattaacatccggcgtccacacattcccagcagtattacaatcctccggtttatatagcttatcatcagtcgtaacagtaccctcctcaagtttgggaacacaaacttacatatgcaacgtaaaccataaaccatcaaacactaaagtagacaaaaaagtcgaaccaaaatcatgcgacaaaacacacacatgcccaccctgccccgcaccagaactactcggaggtccatctgtatttttattcccaccaaaacctaaagataccctaatgatatcacgtacaccagaagttacatgtgtagtagtagacgtctcacatgaagatcctgaagtaaaatttaattggtacgtcgacggagtagaagtacataatgccaaaactaaaccaagagaagaacaatataactcaacttacagagtagttagcgtactaacagtattacaccaagactggttaaatggaaaagaatacaaatgtaaagtatcaaacaaagcacttcctgcaccaatagaaaaaacaatatctaaagcaaaaggacaaccaagagaaccccaagtatatacactaccacctagcagagaagaaatgactaaaaatcaagtatccttaacatgtttagtaaaaggattctatccatcagacatagcagtagaatgggaatcaaacggacaaccagaaaataactataaaactacaccacctgtactagattcagatggatcattttttctatattctaaactaacagtagataaatccagatggcaacaaggaaatgtattcagttgttcagtaatgcatgaagcattacataaccactacacacaaaaatccctatcattatcccctggaaaa

SEQ ID NO: 46813 - RNA, 660 nt, synthetic construct
  misc_feature 1..660: note = derived and/or modified sequence opt6 from Azintuxizumab_LightChain
  source 1..660: mol_type = other RNA
gatgtcgtaatgacacaaacaccattatcactatcagtaacaccaggacaaccagcatcaatatcatgcagatcatcacaaagcctagtacattcaaatggaaacacatatttacattggtatctacaaaaaccaggacaatcaccccaactattaatatacaaagtatcaaacagattctcaggagtaccagacagattctccggatccggatccggaacagacttcacactaaaaatatcaagagtagaagcagaagacgtaggcgtatacttctgctcacaatcaacacacgtaccaccattcacattcggaggaggaacaaaagtagaaataaaaagaacagtagcagcaccatcagtattcatatttccaccatcagacgaacaactaaaatcaggaacagcatcagtagtatgcttactaaacaacttttacccacgagaagcaaaagtacaatggaaagtagacaacgcacttcaatcaggaaactcacaagaatccgtaacagaacaagactctaaagactcaacatactcattatcatcaacactaaccctatcaaaagccgactacgaaaaacacaaagtatacgcatgcgaagtaacacaccaaggattatcatcaccagtaaccaaatcattcaacagaggagaatgt

SEQ ID NO: 46814 - RNA, 366 nt, synthetic construct
  misc_feature 1..366: note = derived and/or modified sequence opt6 from Blinatumomab_HeavyChain1
  source 1..366: mol_type = other RNA
caagtacaattacaacaaagtggagcagaattagtaagaccaggaagtagtgtaaaaataagttgtaaagcaagtggatatgcatttagtagttattggatgaattgggtaaaacaaagaccaggacaaggattagaatggataggacaaatatggccaggagatggagatacaaattataatggaaaatttaaaggaaaagcaacattaacagcagacgaaagtagtagtacagcatatatgcaattaagtagtttagcaagtgaagatagtgcagtatatttttgtgcaagaagagaaacaacaacagtaggaagatattattatgcaatggattattggggacaaggaacaacagtaacagta

SEQ ID NO: 46815 - RNA, 363 nt, synthetic construct
  misc_feature 1..363: note = derived and/or modified sequence opt6 from Blinatumomab_HeavyChain2
  source 1..363: mol_type = other RNA
gacataaaactacaacaatcaggagcagaactagcaagaccaggagcatcagtaaaaatgtcatgcaaaacatcaggatacacattcacaagatacacaatgcactgggtaaaacaaagaccaggacaaggactagaatggataggatacataaacccatcaagaggatacacaaactacaaccaaaaattcaaagacaaagcaacactaacaacagacaaatcatcatcaacagcatacatgcaactatcatcactaacatcagaagactcagcagtatactactgcgcaagatactacgacgaccactactgcctagactactggggacaaggaaccacactaacagtatcatcagtagaa

SEQ ID NO: 46816 - RNA, 1494 nt, synthetic construct
  misc_feature 1..1494: note = derived and/or modified sequence opt6 from Blinatumomab_LightChain_HeavyChain_HeavyChain_LightChain
  source 1..1494: mol_type = other RNA
gatatacaactaacacaaagtccagcaagtctagcagtatcactaggacaaagagcaacaatatcatgtaaagcatcacaaagcgtagattatgatggtgattcatatctaaattggtatcaacaaatcccaggacaaccacctaaactactaatatatgatgcatcaaatttagtaagcggtataccacctagatttagtggaagtggttcaggaacagattttactttaaatatacacccagtcgaaaaagtagacgcagcaacttatcattgtcaacaatcaacagaagatccttggacctttggaggcggaacaaaattagaaataaaagggggaggaggatcaggaggaggaggatcaggtggcggaggatcacaagtacaattacaacaatcaggagcagaattagttagaccaggaagctcagtaaaaatatcatgtaaagcatcaggatatgcattttcaagttattggatgaactgggtcaaacaacgaccaggacaaggtctcgagtggataggacaaatatggccaggagacggtgatacaaactataatggtaaattcaaaggaaaagcaacacttacagctgatgaatcatcatcaacagcatacatgcaattaagttctctagcatcagaagactcagcagtatatttttgtgcccgaagagaaacaacaacagtaggaagatattattatgctatggactattggggccaaggaaccacagtcacagtgagctcaggaggaggaggatcagatattaaactacaacaatcaggagcagaattagcaagaccaggagcaagtgttaaaatgtcttgtaaaacatctggatatacatttacacgatatacaatgcattgggtaaaacaaagaccaggacaaggactagaatggattggatatataaatccatcacgaggttacacaaactataatcaaaaatttaaagataaagcaactctaacaactgataaaagcagctcaacagcttacatgcaactaagttcattgacaagcgaggattcagcagtatattactgtgcaagatattatgacgaccattactgtctagactattggggtcaaggtacaactctgacagtctcctctgtagaaggaggaagtggtggaagcggaggatcaggtggatcaggaggagtagatgatatacaattaacacaatcaccagcaataatgtcagccagcccaggagaaaaagtaacaatgacgtgcagagcaagtagcagtgtatcatatatgaattggtatcaacaaaaatccggcacaagccctaaaagatggatatatgacacaagtaaagtagcttctggagttccatatcgattttctggaagtggatcaggaacaagttattcattaacaatatcgtctatggaagcagaagatgccgctacgtattactgtcaacaatggagcagcaatcctctaactttcggagcaggaacaaaactagaattaaaa

SEQ ID NO: 46817 - RNA, 333 nt, synthetic construct
  misc_feature 1..333: note = derived and/or modified sequence opt6 from Blinatumomab_LightChain1
  source 1..333: mol_type = other RNA
gacatacaactaacacaatcaccagcatcactagcagtatcactaggacaaagagcaacaatatcatgcaaagcatcacaatcagtagactacgacggagactcatacctaaactggtaccaacaaataccaggacaaccaccaaaactactaatatacgacgcatcaaacctagtatcaggaataccaccaagattctcaggatcaggatcaggaacagacttcacactaaacatacacccagtagaaaaagtagacgcagcaacataccactgccaacaatcaacagaagacccatggacattcggaggaggaacaaaactagaaataaaa

SEQ ID NO: 46818 - RNA, 324 nt, synthetic construct
  misc_feature 1..324: note = derived and/or modified sequence opt6 from Blinatumomab_LightChain2
  source 1..324: mol_type = other RNA
gtagacgatatacaactaacacaatcaccagcaataatgagcgcaagcccaggagaaaaagtaacaatgacatgtagagcaagctcaagcgtaagttatatgaattggtatcaacaaaaatcaggaacaagcccaaaaagatggatatacgatacatcaaaagtagcatcaggagtaccatatagatttagtggaagcggaagcggaacatcatactcactaacaatatcaagcatggaagcagaagatgcagcaacatattactgtcaacaatggtcaagcaatccattaacatttggagcaggaacaaaattagaattaaaa

SEQ ID NO: 46819 - RNA, 1350 nt, synthetic construct
  misc_feature 1..1350: note = derived and/or modified sequence opt6 from Brazikumab_HeavyChain
  source 1..1350: mol_type = other RNA
caagtacaactagtagaatcaggtggaggagtagtacaacccggaagatcactaagactatcatgcgccgcatccggatttacctttagctcttatggaatgcattgggtgaggcaagcacctggaaaaggtctagaatgggtagcagtaatatggtacgacggctctaatgaatattatgccgacagcgtcaaaggacgattcacaatttctagagataattcaaaaaatactctatatttacaaatgaactcactaagagccgaagatactgctgtttactactgtgcccgtgatagaggatatacttcatcatggtatccagatgcatttgatatatggggacaaggtacaatggtaacagtatcttccgcatcaacaaaaggaccaagcgtatttcccctagccccatgctccagatcaacatctgaatcaacagccgcactaggatgcctagtaaaagattactttccagaaccagtaactgtaagctggaactctggagcattaacatcaggagttcacacttttccagcagtcctacaatcttctggattatactcactatcctcagtagtaaccgttccatcatcaaatttcggaacacaaacatatacatgcaatgtagatcataaaccaagcaatacaaaagttgataaaacagtagaaagaaaatgttgtgttgaatgcccaccctgcccagccccaccagtagctggaccatcagtattcttatttccacccaaaccaaaagacacactaatgatttcaagaactcctgaagtaacttgtgtagtagtagatgtctcccatgaagatcctgaagtacaatttaactggtatgtagacggagtagaagtacacaatgcaaaaacaaaacctagagaagaacaatttaattcaacattccgagttgtatcagtattaacagtagtccatcaagattggttaaacggaaaagaatataaatgcaaagtatcaaataaaggattaccagcacctatagaaaaaacaatatcaaaaacaaaaggccaaccaagagaaccacaagtatatacacttccaccttcaagagaagaaatgactaaaaaccaagtatctttaacatgtttagtaaaaggattttacccttccgatatagcagtagaatgggaaagtaatggacaaccagaaaacaattacaaaacaacacccccaatgctagactcagacggatcttttttcttatactcaaaactcacagtagacaaaagcagatggcaacaaggaaacgtgttctcttgttcagtcatgcacgaagcattacataatcactatacacaaaaatcactatcactatctcccggaaaa

SEQ ID NO: 46820 - RNA, 651 nt, synthetic construct
  misc_feature 1..651: note = derived and/or modified sequence opt6 from Brazikumab_LightChain
  source 1..651: mol_type = other RNA
caatcagtcctaacacaaccaccatcagtatcaggagcaccaggacaacgagtaacaatatcatgcacaggatcatcatccaacacaggagcaggatatgacgtacactggtaccaacaagtaccaggaacagcaccaaaactattaatatacggatctggaaacagaccatcaggagtaccagaccgattctcaggatccaaatcaggaacatcagcatccctagcaataacaggactacaagcagaagacgaagcagactactactgccaatcatacgactcatcactctccggatgggtattcggaggaggaacaagactaaccgtactaggacaaccaaaagcagctccatcagtaacactattccccccatcatcagaagaattacaagcaaacaaagcaacactagtatgtctaatatcagatttctacccaggagcagtaacagtagcctggaaagcagactcatccccagtcaaagcaggagtagaaacaacaacaccatcaaaacaatcaaataacaaatacgcagcatcctcatacttatcactaactccagaacaatggaaatcacatagatcatactcatgccaagtaacacacgaaggatcaacagtagaaaaaacagtagcacccactgaatgctca

SEQ ID NO: 46821 - RNA, 363 nt, synthetic construct
  misc_feature 1..363: note = derived and/or modified sequence opt6 from Brolucizumab_HeavyChain
  source 1..363: mol_type = other RNA
tcagaagtacaattagtagaaagtggaggaggattagtacaaccaggaggaagtctaagattaagttgtacagcaagtggatttagtttaacagattattattatatgacatgggtaagacaagcaccaggaaaaggattagaatgggtaggatttatagatccagatgatgatccatattatgcaacatgggcaaaaggaagatttacaataagtagagataatagtaaaaatacactatatttacaaatgaatagtttaagagcagaagatacagcagtatattattgtgcaggaggagatcataatagtggatggggattagatatatggggacaaggaacattagtaacagtaagcagt

SEQ ID NO: 46822 - RNA, 333 nt, synthetic construct
  misc_feature 1..333: note = derived and/or modified sequence opt6 from Brolucizumab_LightChain
  source 1..333: mol_type = other RNA
atggaaatagtaatgacacaatcaccatcaacactatcagcatcagtaggagacagagtaataataacatgccaagcatcagaaataatacactcatggctagcatggtaccaacaaaaaccaggaaaagcaccaaaactactaatatacctagcatcaacactagcatcaggagtaccaagcagattctcaggatcaggatcaggagcagaattcacactaacaatatcatcattacaaccagacgacttcgcaacatactactgccaaaacgtatacctagcatcaacaaacggagcaaacttcggacaaggaacaaaactaacagtacta

SEQ ID NO: 46823 - RNA, 1347 nt, synthetic construct
  misc_feature 1..1347: note = derived and/or modified sequence opt6 from Cabiralizumab_HeavyChain
  source 1..1347: mol_type = other RNA
caagtacaactagtacaatctggggcagaagtaaaaaaaccaggatcatccgtaaaagtatcatgcaaagcatcaggttacacattcaccgataactacatgatctgggtacgacaagcaccaggacaaggcttagaatggatgggcgacataaacccctacaacggtggaacaaccttcaatcaaaaatttaaaggaagagttacaataaccgctgacaaaagtacatcaacagcttatatggaactatcttcattaagatcagaagacacagcagtctattactgtgcacgtgaaagtccatacttctccaacctatacgtaatggattactggggacaaggaacactagtaaccgtctcaagcgcatcaacaaaaggaccatcagtattcccattagcaccatgttcaagatcaacctcagaatccacagccgcactaggttgtttagttaaagattacttccccgaaccagtaactgtttcatggaactcaggtgcattaacttcaggagtacacacatttccagcagttctacaatccagcggcctctattcactatcatcagtagtaaccgtaccatcatcatcattaggtacaaaaacttatacatgtaatgtcgaccataaaccttcaaacacaaaagttgataaaagagtagaatctaaatatggacctccatgccccccttgcccagccccagaattcctaggtggaccatcagtctttttattcccaccaaaaccaaaagatacactcatgatatcaagaacacctgaagtaacatgcgtagtagttgacgtctcacaagaagaccccgaagtccaatttaattggtatgtagatggagtagaagttcacaacgcaaaaacaaaaccaagagaagaacaatttaactcaacatacagagttgtatcagtattaacagtattacaccaagactggttaaacggcaaagaatacaaatgcaaagtaagtaataaaggactcccttcatcaatagaaaaaacaatcagtaaagcaaagggacaaccacgagaaccccaagtatacaccctaccaccctcacaagaagaaatgactaaaaatcaagtatcactaacctgtctagttaaaggattctacccctcagacatagcagtagaatgggaatccaatggacaaccagaaaacaactataaaacaacaccacccgttctagactcagacggatccttcttcttatactcaagattaacagtagacaaatccagatggcaagaaggaaacgttttcagttgttcagtcatgcacgaagcattacacaaccactacacacaaaaatcactatcattatctttaggaaaa

SEQ ID NO: 46824 - RNA, 654 nt, synthetic construct
  misc_feature 1..654: note = derived and/or modified sequence opt6 from Cabiralizumab_LightChain
  source 1..654: mol_type = other RNA
gaaatagtattaacacaatcaccagcaacactaagtctatcaccaggagaacgcgctacactatcatgcaaagcatcacaatctgtagactacgacggagacaactacatgaactggtaccaacaaaaaccaggacaagcaccaagattactaatatacgcagcatcaaacctagaatcaggaataccagccagattctcaggatcaggatcaggaacagactttacattaacaatatcatcactagaacccgaagattttgcagtatactactgtcacctatcaaacgaagacttatcaacattcggaggcggaacaaaagtagaaataaaaagaacagtagcagcaccatcagtattcatcttcccaccatcagacgaacaactaaaatcaggaacagcatcagtagtatgcttactcaacaacttctacccaagagaagcaaaagtacaatggaaagtagacaacgcactacaatcaggaaactcacaagaatcagtaacagaacaagactccaaagactcaacatactccctatcatcaacattaaccctatcaaaagcagactacgaaaaacacaaagtatacgcctgcgaagtaacacaccaaggactatcatcacccgtaacaaaatcattcaacagaggagaatgc

SEQ ID NO: 46825 - RNA, 1329 nt, synthetic construct
  misc_feature 1..1329: note = derived and/or modified sequence opt6 from Camrelizumab_HeavyChain
  source 1..1329: mol_type = other RNA
gaagtccaactcgtagaatcaggtggaggcttagtccaaccaggaggatcactccgattatcttgtgctgcatcaggatttacatttagctcatatatgatgtcatgggtaagacaagcccccggaaaaggtctagaatgggtagctaccatctctggaggaggagcaaacacatattaccctgactccgtaaaaggacgatttacaatatctagagataatgcaaaaaattccctatacctacaaatgaattcattaagagcagaagacacagctgtgtactactgcgcaagacaactatactactttgactattggggacaaggcacaacagttacagtatcatcagcatccacaaaaggaccatccgtatttccacttgcaccatgctcaagatcaactagcgaatcaacagccgcattaggatgtttagtaaaagattactttccagaaccagtaacagtatcatggaactctggagcactaacctcaggagtacatactttcccagcagtacttcaatcatcaggattatatagcctatcctcagttgtaacagttccatcctcatcacttggaacaaaaacctatacatgtaatgtagaccataaaccatcaaacacaaaagttgacaaacgtgttgaatccaaatatggtccaccttgccctccatgtcctgcacctgaattcctaggaggaccatcagtcttcctatttccaccaaaaccaaaagacacattaatgatatccagaacccctgaagtaacatgcgtagttgttgatgtatcacaagaagaccctgaagtacaatttaattggtacgtagacggagtagaagtacacaatgcaaaaacaaaaccacgagaagaacaattcaattccacctacagagtagtaagtgttttaaccgtacttcaccaagactggctaaatggaaaagaatacaaatgtaaagtatcaaataaaggactaccctcatcaatagaaaaaactatatccaaagctaaaggacaaccaagagaaccacaagtatatacattaccaccaagccaagaagaaatgactaaaaatcaagtatccttaacatgtttagtaaaaggattttatccctcagacatcgcagtcgaatgggaatccaacggccaaccagaaaataattataaaaccacaccacctgtactagactcagatggatcatttttcttatactctagacttaccgtcgacaaatcaagatggcaagaaggaaatgtattctcatgttcagtaatgcatgaagcattacataatcactatacacaaaaatcattaagcctaagtttaggaaaa

SEQ ID NO: 46826 - RNA, 642 nt, synthetic construct
  misc_feature 1..642: note = derived and/or modified sequence opt6 from Camrelizumab_LightChain
  source 1..642: mol_type = other RNA
gacatacaaatgacacaatccccatcatcactatcagcatcagtaggagacagagtaacaataacatgccttgcatcacaaacaataggaacatggttaacttggtaccaacaaaaacctggaaaagcaccaaaactactaatatacacagcaacatcactagcagacggagtaccatcaagattctcaggctcaggatcaggaacagacttcacattaacaatatcatccctacaaccagaagacttcgcaacatactactgccaacaagtatactcaataccatggacattcggaggaggaacaaaagtagaaataaaaagaacagtagcagcaccatcagtattcatcttcccaccaagtgacgaacaattaaaatcaggaacagcatcagtagtatgcctactaaacaacttctatccaagagaagcaaaagtccaatggaaagtagacaacgcactacaatcaggaaactcacaagaatccgtaacagaacaagactcaaaagactcaacatacagcctatcatcaaccctaacactatccaaagccgactacgaaaaacacaaagtatacgcatgcgaagtaacacaccaaggactaagttctccagtaacaaaatcattcaacagaggagaatgc

SEQ ID NO: 46827 - RNA, 777 nt, synthetic construct
  misc_feature 1..777: note = derived and/or modified sequence opt6 from Caplacizumab_HeavyChain
  source 1..777: mol_type = other RNA
gaagtacagctagtagaaagtggtggaggattagtacaaccaggaggttcattgagattaagttgtgctgcaagtggaagaacatttagttataatccaatgggatggtttagacaagcaccagggaaaggaagagaattggtggcagcaataagcagaacagggggatcaacatattatccagatagtgtagaaggaagatttacgattagtagagataatgcaaaaagaatggtatacttacaaatgaatagtttaagagcagaagatacagcagtatattattgtgcagctgcaggagtaagagcagaagatggaagagtaagaacattaccatctgaatatacattttggggacaaggaactcaagtaacagtaagtagtgcagcagcggaagtacaattagtagaaagtggtggaggattagtgcaaccaggaggaagtctaagattatcatgtgcagcaagtggaagaacatttagttataatccaatgggatggtttagacaagcaccaggaaaagggagagaattagttgcagcaataagcagaacaggtggatcaacatattatccagattcagtagaaggaaggtttacaataagcagagataatgcaaaacgaatggtatatttacaaatgaatagtttaagagcagaagacacagcagtttattactgtgcagcagcaggagtaagagcagaagatggaagagtaagaacattaccaagcgaatacacattttggggacaaggaacacaagtaacagtaagtagt

SEQ ID NO: 46828 - RNA, 657 nt, synthetic construct
  misc_feature 1..657: note = derived and/or modified sequence opt6 from Citatuzumab_bogatox_HeavyChain
  source 1..657: mol_type = other RNA
gaagtacaattagtacaatcaggaccaggattagtacaaccaggaggatccgtacgaattagctgcgcagcaagcggatacacattcacaaactatggaatgaactgggtaaaacaagcaccaggaaaaggattagaatggatgggatggataaatacatatacaggagaatcaacatatgcagattcatttaaaggacgattcacattttcactagacacaagcgcctcagcagcatatctacaaataaattcattaagagcagaagacacagcagtatattactgcgcaagattcgcaataaaaggagattactggggacaaggaacactattaactgtatcatcagcatcaacaaaaggaccatcagtattcccactagcaccatcatcaaaatcaacttcaggaggaacagcagcactaggatgcctagtaaaagactattttccagaaccagtaacagtatcatggaattcaggagcattaacatctggagtacacacatttccagcagtactacaatcatcaggactatactcattatcatcagttgtaactgtaccaagctcatcactaggaacacaaacatacatatgcaatgtaaatcacaaaccatcaaacacaaaagtagacaaaaaagtagaaccaaaatcttgc

SEQ ID NO: 46829 - RNA, 1356 nt, synthetic construct
  misc_feature 1..1356: note = derived and/or modified sequence opt6 from Cosfroviximab_HeavyChain
  source 1..1356: mol_type = other RNA
gacgtaaaactattagaatccggaggaggactagtacaaccaggaggatcattaaaactatcttgcgcagcatcaggattctctctatcaacatcaggagtcggcgtaggatggttcagacaaccatcaggcaaaggactagaatggttagcattaatatggtgggacgacgataaatactacaacccatcattaaaatcacaactctctatatcaaaagattttagcagaaaccaagtattcttaaaaatttccaacgtagatatagcagatactgcaacatactactgcgcaagacgagacccattcggatacgataacgcaatgggatattggggacaaggaacctcagtaacagtatcatctgcctcaacaaaaggcccatcagtttttccactagctccatcctccaaatccacttcaggaggaaccgcagcactaggatgcctagtaaaagactatttcccagaaccagttaccgtatcatggaactccggagcattaacatccggagtacatacattcccagcagtcctacaaagctcaggcttatactcactatcctcagtagtaacagtaccaagctcatcattaggtacacaaacatacatatgcaacgttaatcacaaaccatcaaacactaaagtcgacaaaagagtagaaccaaaatcctgcgataaaacacacacatgtccaccatgcccagcaccagaactactaggaggcccttcagtttttttatttccaccaaaacctaaagacacactaatgatatccagaacaccagaagtaacatgtgtagtagtagatgtttcacacgaagacccagaagtaaaattcaactggtacgtagacggagtagaagtccataacgctaaaaccaaaccaagagaagaacaatacaattcaacataccgagtagtatctgtcttaactgtactacatcaagactggctaaacggaaaagaatacaaatgtaaagtatcaaataaagcattacccgcaccaatcgaaaaaacaattagcaaagcaaaaggtcaaccaagagaaccacaagtatacaccctaccaccttcaagagatgaacttactaaaaaccaagtatcactgacatgcctagtaaaagggttctacccctcagatatagccgtagaatgggaatcaaacggacaaccagaaaacaactataaaacaacaccccccgtattagactccgacggatctttcttcttatacagtaaattaacagtagataaatccaggtggcaacaaggaaacgttttcagttgttccgtcatgcatgaagccctacataatcattacacacaaaaaagtcttagtttatccccaggaaaa

SEQ ID NO: 46830 - RNA, 639 nt, synthetic construct
  misc_feature 1..639: note = derived and/or modified sequence opt6 from Cosfroviximab_LightChain
  source 1..639: mol_type = other RNA
gacatagtaatgacacaatcaccactatcactatcaacatcagtaggagacagagtctcactaacatgcaaagcatcacaaaatgtaggaacagcagtagcatggtaccaacaaaaaccaggacaatcaccaaaactattaatatactcagcatcaaacagatacacaggagtacccgacagattcacaggatcaggatcaggaacagattttacactaacaatctccaatatgcaatcagaagacctagcagactacttctgccaacaatactcatcataccccttaacattcggagcaggaacaaaactagaactacgaacagttgccgcaccatcagtattcatattcccaccatcagacgaacaattaaaatcaggaacagcatcagtagtatgtctactaaacaacttctacccacgagaagcaaaagtacaatggaaagtcgataacgcactacaatcaggaaactcccaagaatcagtaacagaacaagactcaaaagactcaacatactcactatcctcaacactaacattatcaaaagccgactacgaaaaacacaaagtatacgcatgcgaagtaacacaccaaggactctcatccccagtaacaaaatcatttaacagaggagaatgc

SEQ ID NO: 46831 - RNA, 1344 nt, synthetic construct
  misc_feature 1..1344: note = derived and/or modified sequence opt6 from Crizanlizumab_HeavyChain
  source 1..1344: mol_type = other RNA
caagtacaactagtacagtcaggtgcagaagtaaaaaaacccggagcatctgtcaaagtttcttgtaaagtatcaggatacacattcaccagttacgatataaactgggtaagacaagcaccaggaaaaggattagaatggatgggatggatatatcccggagatggatcaatcaaatataatgaaaaatttaaaggaagagttacaatgacagtagacaaatcaacagacacagcatacatggaactaagctcattaagaagtgaagatacggcagtatactactgtgcaagacgaggtgaatacggaaactatgaaggtgccatggactactggggacaaggaaccctagtaacagtatctagtgcaagcacaaaaggaccctccgtatttccactagcaccatgtagtagatctacaagcgaatcaacagcagcattgggttgtctagtaaaagattacttcccagaacctgtaacagtatcatggaattcaggagcactaacaagcggtgtccatacatttcccgccgtattacagtcgagcggactatactcactatcttcagtagttacagtaacaagcagtaattttggaacacaaacatatacttgcaacgtagaccacaaaccatcaaatactaaagtagacaaaacagtagaaagaaaatgctgtgtagaatgtccaccatgccctgcaccaccagtagcaggaccatcagtattcttattcccaccaaaacctaaagacacactaatgatatcacgcactccagaagtgacatgtgttgtagtagatgtatcacacgaagaccccgaagttcaatttaactggtatgtagatggtatggaagtacacaatgctaaaacaaaaccacgtgaagaacaatttaattcaacattccgagtagtatcagtcctaaccgtagtccatcaagactggctcaacggtaaagaatataaatgcgcagtttcaaataaaggcttaccagcacccatagaaaaaacaatatcaaaaacaaaaggacaaccaagagaaccacaagtatataccctaccaccatcacgagaagaaatgacaaaaaatcaagtatctctaacatgcttagttaaaggtttttacccatcagacatagcagtcgaatgggaatcaaatggacaaccagaaaacaattacaaaacaacaccacctatgttagatagcgacggatctttcttcctctactcaaaactaacagtagacaaatccagatggcaacaaggtaacgtattctcatgttcagtaatgcacgaagccctacataatcactacacccaaaaatccctctcactatcaccaggaaaa

SEQ ID NO: 46832 - RNA, 654 nt, synthetic construct
  misc_feature 1..654: note = derived and/or modified sequence opt6 from Crizanlizumab_LightChain
  source 1..654: mol_type = other RNA
gacatacaaatgacacaatcaccatcttcactaagcgcctcagtaggagacagagtaacaataacatgcaaagcatcacaatcagttgactacgacggacactcatacatgaactggtaccaacaaaaaccaggaaaagcaccaaaattactaatatacgccgcaagcaacctcgaaagcggagtaccaagcagattctcaggatcaggatcaggaacagacttcaccctaacaatatcatcactccaaccagaagacttcgcaacctactattgccaacaatcagacgaaaacccactcacattcggaggaggaacaaaagtagaaataaaaagaaccgtcgcagcaccatcagtattcatattcccaccatcagacgaacaactaaaatcaggaacagcatcagtcgtatgcctactaaacaacttctacccccgagaagcaaaagtacaatggaaagtagacaacgcactacaatcaggaaattcacaagaatcagtaacagaacaagactcaaaagactcaacatactcattaagctcaacactaacactatcaaaagccgactacgaaaaacacaaagtatacgcatgcgaagtaacacaccaaggactatcatcaccagtaaccaaatcattcaacagaggagaatgc

SEQ ID NO: 46833 - RNA, 1365 nt, synthetic construct
  misc_feature 1..1365: note = derived and/or modified sequence opt6 from Crotedumab_HeavyChain
  source 1..1365: mol_type = other RNA
gaagtacaattagttgaatcaggaggcggtctagttcaacctggaggttctctaagactatcctgcgcagcgtcaggctttacattttcaaattacctaatgaattgggtcagacaagctccaggaaaaggactagaatggttagctaacatacaagaagacggcatagaaaaatactacgttgacagtgtcaaaggacgatttactataagcagagacaacgctaaaaattcactatatcttcaaatgaactccttacgagccgaagacacagccgtatactattgtgcaagagaaccatcacactatgacattttaacaggatacgactattactatggaatggacgtatggggacaaggaacaactgtaacagtttcatcagcatcaactaaaggaccctccgtcttccctttagccccttgtagcagatcaacatcagaatccacagctgcattaggatgtctagtaaaagactactttccagaaccagtaacagtatcatggaacagtggagcactaacatctggagtccacaccttcccggcagtattacaatcatcaggactatatagcttatcatcagtagtcacagtaccttcttcatcattaggaacaaaaacctacacatgcaatgtagaccataaaccatccaatacaaaggtagataaacgagtagaatcaaaatacggaccaccatgcccaccatgtccagcaccagaatttctaggaggaccatcagtatttttattcccacccaaaccaaaagatacattaatgatatccagaaccccagaagttacctgtgtagtcgtagacgtatcccaagaagatcccgaagtccaattcaactggtacgttgacggagtagaagtacacaacgccaaaaccaaacctagagaagaacaattcaactcaacataccgagtagtctcagtattaacagtcctacatcaagattggctaaatggcaaagaatacaaatgtaaagtatcaaataaaggactaccatcatcaatagagaaaacaatatcaaaagcaaaaggccaacctagggaaccacaagtatatacactaccaccaagtcaagaagaaatgactaaaaaccaagtatcattaacatgcttagtaaaaggattttatccatctgacatagccgtagaatgggaatcaaacggccaaccagaaaacaactacaaaacaacaccaccagtattagatagcgatggatccttctttttatactctagattaacagtcgataaatcaagatggcaagaaggaaacgtattctcatgctcagtaatgcacgaagcactacacaatcactacacacaaaaatcactatcattatcattaggcaaa

SEQ ID NO: 46834 - RNA, 642 nt, synthetic construct
  misc_feature 1..642: note = derived and/or modified sequence opt6 from Crotedumab_LightChain
  source 1..642: mol_type = other RNA
gatatacaaatgacacaatctccatcatcattaagcgcaagcgtaggcgaccgagtaacaataacatgtagagcaagccaaggaataagaaatgacctaggatggtaccaacaaaaaccaggaaaagcaccaaaaagattaatatatgcagcaagctcactacaatcaggagtaccatcaagattctcaggatcaggatccggaacagaatttatactaacagtctcatcactacaaccagaagactttgcaacttactactgcttacaatataactcaaacccattcacattcggaccaggaaccaaagtagatataaaaagaactgtagcagcaccaagcgtatttatattcccaccatcagacgaacaattaaaatcaggcacagcatcagtagtatgcttactaaataacttttacccaagagaagcaaaagtacaatggaaagtagataacgcattacaaagcggaaactcacaagaaagcgtaacagaacaagattcaaaagactcaacatattcactaagctcaacattaacactaagcaaagcagattacgaaaaacataaagtatacgcatgcgaagtaactcaccaaggattaagctcaccagtaaccaaaagttttaacagaggcgaatgc

SEQ ID NO: 46835 - RNA, 1356 nt, synthetic construct
  misc_feature 1..1356: note = derived and/or modified sequence opt6 from Dezamizumab_HeavyChain
  source 1..1356: mol_type = other RNA
caagttcaattagtccaatcaggcgcagaagttaaaaaaccaggatcatccgtaaaagtatcatgtaaagcatccggttttacatttgcaacatacaacatgcattgggtaagacaagctccaggacaaggactagaatggatgggatatatataccctggagatggaaatgctaactacaaccaacaattcaaaggtcgtgtaaccataacagccgataaatcaacatcaacagcatatatggaactatcatccctcagatcagaagacacagcagtatactattgcgcaagaggagattttgactacgatggaggatactacttcgactcatggggccaaggaacactcgtaacagtctccagcgcatcaactaaaggaccctcagtattcccactagcaccaagctcaaaatcaacatcaggaggaacagccgcattaggctgcctagtaaaagactatttcccagaaccagtaactgtaagttggaattccggagcactaacaagtggagtacacacattcccagcagtactacaatcatcaggactatactccctatctagtgtagtaacagtaccttcatcatcactaggaacacaaacatacatatgcaatgtaaatcacaaaccatctaacacaaaagtagataaaaaagtagaaccaaaatcatgcgataaaacacacacatgtccaccctgtcccgcaccagaattactaggaggaccatcagtcttcctattcccaccaaaaccaaaagacacactcatgatctccagaacccccgaagtcacttgcgtagtagtagacgtatcacatgaagacccagaagtaaaattcaattggtatgtagacggagtcgaagtccataacgccaaaactaaaccacgagaagaacaatataattcaacataccgggtagtatcagtcttaacagtactacaccaagattggctaaacggtaaagaatacaaatgtaaagtatcaaataaagcactccccgctccaatagaaaaaaccatatcaaaagcaaaaggacaaccaagagaaccacaagtatatacactcccaccctccagagacgaattaacaaaaaatcaagtatcactaacatgcctagttaaaggattctatccatcagatatagcagtagaatgggaatcaaacggacaaccagaaaataactacaaaacaacaccacccgtactagattcagacggatcatttttcctatactcaaaactaacagtagacaaatcaagatggcaacaaggaaatgtattttcctgttcagtaatgcacgaagcactacacaaccactacacacaaaaaagcctatccctatctcctggaaaa

SEQ ID NO: 46836 - RNA, 642 nt, synthetic construct
  misc_feature 1..642: note = derived and/or modified sequence opt6 from Dezamizumab_LightChain
  source 1..642: mol_type = other RNA
gacatacaaatgacacaatcaccatcatccttaagcgcatcagtaggcgacagagtaacaataacatgccgagcatcagaaaacatatactcatacctagcatggtaccaacaaaaaccaggaaaagcaccaaaactcctaatacataacgcaaaaacactagcagaaggagtaccaagcagattctcaggatcaggttcaggaacagacttcacactaacaatatcatcactacaaccagaagacttcgcaacatactactgccaacaccactacggagcaccattaacattcggacaaggaacaaaactcgaaataaaaagaaccgtagccgcaccatcagtattcatattcccaccatcagacgaacaactaaaatcaggaacagcatcagtagtctgcctattaaacaacttctacccaagagaagcaaaagtacaatggaaagtagataacgcactccaatccggaaactcccaagaatcagtaacagaacaagactcaaaagactcaacatactcactatcatcaacactaacattatcaaaagcagattacgaaaaacacaaagtatacgcatgcgaagtaacacaccaaggcctatcatctccagtaacaaaatcattcaacagaggcgaatgc

SEQ ID NO: 46837 - RNA, 1506 nt, synthetic construct
  misc_feature 1..1506: note = derived and/or modified sequence opt6 from Duvortuxizumab_Chain1_scFv
  source 1..1506: mol_type = other RNA
gaaaacgtattaacacaaagtcctgctacattatctgtaactccaggcgaaaaagcaacaataacatgtagagcatcacaatcagtatcatacatgcactggtatcaacaaaaaccaggccaagcaccaagacttcttatctacgacgcatcaaatagagcatctggagtaccttcaagattctcaggaagtggatcaggtactgatcacacactcacaatatcaagtttagaagctgaagatgctgcaacatactactgttttcaaggatcagtatatccattcacctttggccaaggtacaaaactagaaataaaaggcgggggaagcggtggcggaggagaagtacaattagttgaatccggaggcggattagtccaaccaggtggatcactaagactatcttgcgcagcttctggattcacattttctacttacgcaatgaactgggtaagacaagccccaggaaaaggattagaatgggtaggaagaataagatcaaaatacaacaattacgctacctattatgcagactcagttaaaggtaggtttacaataagcagagacgattctaaaaacagcctatacctacaaatgaacagtctaaaaaccgaagatacagcagtatactactgcgtcagacatggtaatttcggaaattcttacgtaagctggtttgcatactggggacaaggaactctcgttacagtttcatctgcctcgacaaaaggtgaagttgcagcatgcgaaaaagaagtagctgcattagaaaaagaagtcgcagcattagaaaaagaagtagcagcattagaaaaaggaggcggagacaaaacacatacatgcccaccatgtccggcaccagaagcagccggcggacctagtgtatttttattcccaccaaaaccaaaagacacattaatgatatcaagaacaccagaagtaacatgcgtagtcgtagatgtaagtcacgaagatcctgaagttaaattcaactggtacgtagatggggtagaagttcacaatgcaaaaacaaaaccaagagaagaacaatataattcaacctatagagttgttagcgttttaacagtactacatcaagattggctaaacggaaaagaatataaatgcaaagtatcaaacaaagccctaccagcaccaattgaaaagaccatttcaaaagctaaaggccaacctagggaaccgcaagtctatacactaccaccttcccgagaagaaatgactaaaaatcaagtctcattatggtgcttagtaaaaggcttttacccaagcgatatagcagtagaatgggaaagtaatggccaaccagaaaataattacaaaacaacaccaccagtattagactcagacggttcatttttcctatattcaaaactaacagtagataaaagccgatggcaacaaggaaacgtattcagctgctctgtcatgcatgaagcattacataatcattacacgcaaaaatcactatcactatcaccaggtaaa

SEQ ID NO: 46838 - RNA, 813 nt, synthetic construct
  misc_feature 1..813: note = derived and/or modified sequence opt6 from Duvortuxizumab_Chain2_scFv
  source 1..813: mol_type = other RNA
caagcagtggtaacacaagaaccatcattaacagtaagtcctggtggaacagttacattaacctgtagatcaagcacaggagctgtaacaacatcgaactatgcaaattgggtacaacaaaaaccaggacaagccccaagaggactaatcggaggaacaaataaaagagcaccttggacaccagcaagatttagcggaagtttattaggaggaaaagcagcactaacaataacaggagcacaggcagaagatgaagcagactattactgtgcactatggtatagtaatctatgggtatttggaggaggaacaaaattaacagtgttaggaggaggaggaagtggcggtggaggacaagtaacattaagagaaagtggaccagctctagttaaaccaacacaaacactaacattaacatgtacatttagcggattcagtttatcaacaagtggaatgggcgtaggatggataagacaaccaccaggaaaagcattagaatggttagcacatatatggtgggatgacgacaaaagatacaatccagcactaaaaagcagactaacaatatcaaaagacacaagtaaaaatcaagtattcttaacaatgacaaatatggatccagtagacacagcaacatactattgcgctagaatggaactatggtcatactattttgattactggggacaaggaacaacagtaacagtaagctcagcaagtacaaaaggaaaagtagcagcttgtaaagaaaaagtagcagcactaaaagaaaaagtagcagcattaaaagaaaaagtagcagcactaaaagaa

SEQ ID NO: 46839 - RNA, 681 nt, synthetic construct
  misc_feature 1..681: note = derived and/or modified sequence opt6 from Duvortuxizumab_Chain3_h-CH2-CH3
  source 1..681: mol_type = other RNA
gacaaaacacacacatgcccaccatgcccagcaccagaagcagcaggaggaccatcagtattcttattcccaccaaaacccaaagacacactaatgatatcaagaacaccagaagtaacatgcgtagtagtagacgtaagccatgaagacccagaagtaaaatttaactggtacgtagacggagtagaagtacataatgcaaaaacaaaaccaagagaagaacaatacaactcaacatacagagtagtatccgtactaacagtcctacaccaagactggctaaacggaaaagaatataaatgcaaagtatcaaataaagctctaccagcaccaatcgaaaaaacaatatcaaaagcaaaaggacaaccaagagaaccacaagtatacacactaccaccatcaagagaagaaatgacaaaaaaccaagtatcactatcatgcgcagtaaaaggattctacccatcagacatagcagtagaatgggaatcaaacggacaaccagaaaacaactacaaaacaacaccaccagtactagactcagacggatcattcttcttagtatcaaaattaacagtagacaaatcaagatggcaacaaggaaacgtattttcatgctccgtaatgcacgaagcattacataacagatatacacaaaaatcactatcactctccccaggaaaa

SEQ ID NO: 46840 - RNA, 360 nt, synthetic construct
  misc_feature 1..360: note = derived and/or modified sequence opt6 from Efungumab_HeavyChain
  source 1..360: mol_type = other RNA
atggcagaagtacaattagtagaaagcggagcagaagtaaaaaaaccaggagaaagtttaagaataagctgtaaaggaagcggatgcataatatcaagctattggataagctgggtaagacaaatgccaggaaaaggattagaatggatgggaaaaatagatccaggagactcatacataaactatagcccaagttttcaaggacacgtaacaataagtgcagacaaaagtataaacacagcatatttacaatggaatagtttgaaagcaagcgatacagcaatgtattactgtgcaagaggaggaagagatttcggagactcatttgattactggggacaaggaacactagtaacagta

SEQ ID NO: 46841 - RNA, 750 nt, synthetic construct
  misc_feature 1..750: note = derived and/or modified sequence opt6 from Efungumab_HeavyChain_LightChain
  source 1..750: mol_type = other RNA
atggcagaagtacaattagtagaaagcggagcagaagtaaaaaaaccaggagaaagtctaagaataagttgtaaaggaagcggatgtataataagttcatattggataagttgggtaagacaaatgccaggaaaaggattagaatggatgggaaaaatagatccaggagacagttatataaattattcaccaagttttcaaggacatgttactataagtgcagataaaagcataaatacagcatatttacaatggaatagtttaaaagcaagtgatacagcaatgtattattgtgcaagaggaggaagagactttggagactcatttgattattggggacaagggacattagtaacagtaagttcaggaggaggaggaagtggaggaggaggaagtggaggaggaggaagtgatgtagttatgacacaatcaccatcatttttaagtgcatttgtaggagatcgaataacaataacatgtagagcgagtagtggaataagtagatatttagcatggtatcaacaagcacctggaaaagcaccaaaactattaatatacgcagcaagtacattacagacaggagtaccaagcagatttagtggatcaggctcaggaacagaatttacactaacaataaattcattacaaccagaagattttgcaacatattattgtcaacatctaaactcatatccacttacattcggaggaggaacaaaagtagatattaaaagagcagccgcattagaa

SEQ ID NO: 46842 - RNA, 339 nt, synthetic construct
  misc_feature 1..339: note = derived and/or modified sequence opt6 from Efungumab_LightChain
  source 1..339: mol_type = other RNA
gacgtagtaatgacacaatcaccatcattcctatcagcattcgtaggagacagaataacaataacatgccgagcatcatcaggaatatcaagatacctagcatggtaccaacaagcaccaggaaaagcaccaaaactactaatatacgcagcatcaacactacaaacaggagtaccatcaagattctcaggatcaggatcaggaacagaattcacactaacaataaactcattacaaccagaagacttcgcaacatactactgccaacacctaaactcatacccactaacattcggaggaggaacaaaagtagacataaaaagagcagcagcactagaa

SEQ ID NO: 46843 - RNA, 1350 nt, synthetic construct
  misc_feature 1..1350: note = derived and/or modified sequence opt6 from Elezanumab_HeavyChain
  source 1..1350: mol_type = other RNA
gaagtccaactagtacaaagtggagctgaggtaaaaaaaccaggcgctagcgttaaagtatcatgtaaagcaagcggatacacattcacaagtcatggaatatcatgggtaagacaagcaccaggacaaggcctagattggatgggatggatatcaccatactcaggaaatacaaactacgctcaaaaactacaaggaagagtaacaatgacaacagacacatcaacaagtaccgcatacatggaattgtcaagcctacgatctgaagatacagcagtatactattgcgcccgagttggatcaggaccatattactacatggacgtatggggacaaggcacactcgtaacagtatcatcagcctcaacaaaaggaccctcagtattcccactagctccctcatcaaaatcaacaagtggaggaacagcagcattaggatgcctagtaaaagactacttcccagaaccagtaacagtatcctggaactcaggagcattaacctctggcgttcatacattcccagctgtattacaatcatcaggattatactcactatcaagcgtagtaacagtcccatcctctagcttaggaacacaaacatatatatgcaacgtaaaccacaaaccatccaatacaaaagttgacaaaaaagtagaaccaaaatcatgcgacaaaacacatacatgcccaccctgtccagctccagaagcagcaggaggtccatcagtattcttattcccaccaaaacctaaagatcaattaatgatatctcgaacacccgaagtaacatgcgtagtcgtagacgtctcacatgaagatccagaagttaaatttaactggtatgtagacggagtagaagtacacaatgcaaaaacaaaaccaagagaagaacaatacaactcaacctacagagtagtatcagtactaacggtattacaccaagactggctcaatggtaaagaatacaaatgcaaagttagtaacaaagcattaccagcaccaatagaaaaaacaatctctaaagcaaaaggccaaccaagagaaccacaagtctatacattacccccaagcagagaagaaatgactaaaaatcaagtaagccttacctgtctagtaaaaggattttacccatcagacatagccgtggaatgggaaagtaacggtcaaccagaaaataattacaaaacaacaccaccagtactagacagcgacggctcattcttcttatactcaaaacttacggtagacaaatcacgatggcaacaaggcaatgtctttagctgctcagtactacacgaagcattacacaaccactacacacaaaaatcactttctctatcaccaggaaaa

SEQ ID NO: 46844 - RNA, 645 nt, synthetic construct
  misc_feature 1..645: note = derived and/or modified sequence opt6 from Elezanumab_LightChain
  source 1..645: mol_type = other RNA
caatcagcactaacacaaccaagatcagtctcaggatcaccaggacaatctgtaacaatatcatgcacaggaacatcatcatcagtaggcgactcaatatacgtatcatggtaccaacaacacccaggaaaagcaccaaaactaatgctatacgacgtaacaaaacgaccatcaggagtaccagacagattctcaggatcaaaatccggtaacacagcatcactaacaataagcggactacaagccgaagacgaagcagattactactgctactcctacgcaggaacagatacactatttggaggaggaacaaaagtaacagtcctaggacaaccaaaagcagcaccatcagtaacactattcccaccatcatcagaagaattacaagcaaacaaagcaacactagtatgcctaatatcagacttctacccaggcgcagtcacagtagcctggaaagcagactcatcaccagtaaaagcaggagtagaaacaaccacaccatcaaaacaatcaaacaacaaatacgcagcatcatcttacctatcattaacaccagaacaatggaaatcacacagatcatactcatgccaagtaacacacgaaggatcaacagtagaaaaaacagtagccccaacagaatgctcc

SEQ ID NO: 46845 - RNA, 1359 nt, synthetic construct
  misc_feature 1..1359: note = derived and/or modified sequence opt6 from Emapalumab_HeavyChain
  source 1..1359: mol_type = other RNA
gaagtacaattactagaaagcggaggaggattagtacaaccaggaggcagccttcgactatcatgcgcagcatctggcttcacattttcatcctatgcaatgtcatgggtcagacaagctcccggcaaaggactagaatgggtatccgcaatatcaggctcaggaggatccacatactatgctgattcagtcaaaggaagattcacaataagcagagacaattccaaaaacacactatacctacaaatgaactcactaagagcagaagacacagctgtatactattgtgctaaagatggtagctccggatggtacgtaccacattggtttgacccatggggacaaggaactctagtcacagtatcatctgcatcaacaaaaggtccatcagtatttccactagcaccaagttcaaaatcaacatcaggcggcacagcagctctaggatgtctagtaaaagactattttcctgaacccgtaacagtatcatggaactcaggcgcacttaccagtggagtacacacatttccagcagtattacaatcttcaggactatattcattatcatcagtagtaacagtcccatcatcatcattaggaacacaaacatatatatgcaacgtaaaccataaaccatcaaacacaaaagttgacaaaagagtcgaaccaaaatcatgtgacaaaacacatacatgcccaccatgcccagcaccggaattactaggaggcccatccgtattcttatttccaccaaaaccaaaagatacacttatgatatctagaactccagaagttacttgtgtagtagtagacgtaagccatgaagatccagaagtaaaattcaattggtatgtagatggagtagaagtacataatgcaaaaacaaaaccacgagaagaacaatataactctacttatagagtagtttctgtactaactgtactacaccaagactggctaaacggaaaagaatataaatgtaaagtatcaaacaaagccttaccagcaccaatagaaaagacaatatcaaaagctaaaggacaaccacgagaaccacaagtttatacattaccaccatcaagagaagaaatgactaaaaaccaagtttcattaacatgtttagtcaaaggattttacccatcagatatagctgtcgaatgggaatccaatggtcaacccgaaaacaattacaaaacaacacccccagttttagattcagacggctcatttttcttatattcaaaattaacagtagacaaaagtagatggcaacaaggaaacgtattctcatgctccgttatgcacgaagcacttcacaatcactatacacaaaaatcactttcactatcaccaggaaaa

SEQ ID NO: 46846 - RNA, 651 nt, synthetic construct
  misc_feature 1..651: note = derived and/or modified sequence opt6 from Emapalumab_LightChain
  source 1..651: mol_type = other RNA
aacttcatgctaacacaaccacactcagtatcagaatcaccaggaaaaacagtaacaatatcctgcaccagatcatcaggctcaatagcatcaaattacgtacaatggtaccaacaaagaccaggatcctcaccaacaacagtcatatacgaagacaaccaaagaccatcaggagtaccagacagattctcaggatcaatagactcatcatcaaattccgcatctctaacaatatcaggactaaaaacagaagatgaagcagactactactgccaatcatatgacggatctaatagatggatgttcggaggaggaacaaaactaacagtcttaggacaaccaaaagcagcaccatcagtaacattattcccaccatcatcagaagaactacaagcaaacaaagcaacactagtatgcttaatatcagacttctacccaggcgcagtaacagtagcatggaaagcagactcctcaccagtaaaagcaggagtagaaacaacaacaccctcaaaacaatcaaacaacaaatacgcagcatcatcatacctatcactaacaccagaacaatggaaatcacacagatcatactcatgccaagtaacacacgaaggatctacagtcgaaaaaacagtagcaccaacagaatgctca

SEQ ID NO: 46847 - RNA, 1341 nt, synthetic construct
  misc_feature 1..1341: note = derived and/or modified sequence opt6 from Enoblituzumab_HeavyChain
  source 1..1341: mol_type = other RNA
caagtagaactagtagaatcaggaggaggattagtacaaccaggtggaagtttaagactatcttgcgcagcatcgggctttacattcacatcctactggatgtcttgggtaagacaagcaccaggaaaaggcttagaactagtatcatccataacatcatacggtagcttcacatattacgctgattcagtcaaaggaagattcacaatatctagagacaactccaaaaacacattataccttcaaatgaattcactcagggcagaagacacagcagtatattactgtgcaagaaatatgtacacacattttgactcctggggacagggaactctcgtaaccgtaagcagcgcatctactaaaggaccatcagttttcccattagcaccatcatcaaaatcaacatcaggaggaaccgccgccttaggatgcctagttaaagactattttcccgaacccgttacagtatcttggaattcaggtgctcttacctccggcgttcatacattccctgcagtactacaaagttctggattatattccctctcctcagttgtaacagtaccctcatcttcactcggaacacaaacatacatatgcaatgtaaatcacaaaccctcaaacacaaaagtagacaaaaaagtagaaccaaaatcctgcgacaaaacacacacctgtccaccatgtccagcacccgaactattaggaggaccatcagtattcttattcccacctaaaccaaaagacacactcatgatatcaagaacaccagaagtaacatgcgtagtcgtagacgtctcccatgaagaccccgaagtcaaatttaactggtacgttgatggagtagaagtacataacgccaaaacaaaacctagagaagaacaatacaactcaacttaccgtgtagtctcagtactaacagtactccaccaagattggttaaatggtaaagaatataaatgtaaagtttccaacaaagcactaccagcaccaatagaaaaaacaatatcaaaagccaaaggacaaccacgcgaaccacaagtatacacactaccaccaagtagagatgaattaacaaaaaaccaagtatcactcacatgtctagtaaaaggtttctatccatctgacatagcagtagaatgggaatcaaacggccaacctgaaaacaactacaaaacaacaccaccagtattagactcagatggatcattttttctatactctaaactaacagtagacaaatcacgatggcaacaaggaaatgtattttcatgttcagtaatgcacgaagccctacacaaccactacactcaaaagtcactatcactaagcccaggaaaa

SEQ ID NO: 46848 - RNA, 648 nt, synthetic construct
  misc_feature 1..648: note = derived and/or modified sequence opt6 from Enoblituzumab_LightChain
  source 1..648: mol_type = other RNA
gacatagtattaacacaaccaccatcagtatccggagcaccaggacaacgagtaacaatctcctgctcaggatcatcatccaacataggatcaaactccgtatcatggtaccaacaactaccaggaaccgcaccaaaactactaatatacgacaattcaaaacgaccatcaggagtcccagacagattctcaggaagcaaaagcggaacatcagcatcactcgcaataacaggattacaatcagaagacgaagcagactactactgccaatcaagagacacttacggctactactgggtattcggaggaggaacaaaattaacagtactaggccaaccaaaagcagcaccaagtgtaacactattcccaccatcatcagaagaactacaagcaaacaaagcaacactcgtatgtctaatatcagacttttacccaggagcagtaacagtagcttggaaaggagatagttcaccagtaaaagcaggagtagaaacaacaacaccatcaaaacaatcaaacaacaaatacgcagcatcatcatacctatcactaacacccgaacaatggaaatcacacagatcatacagttgtcaagtaacacacgaaggaagtacagtcgaaaaaacagtagcaccaacagaatgttca

SEQ ID NO: 46849 - RNA, 1323 nt, synthetic construct
  misc_feature 1..1323: note = derived and/or modified sequence opt6 from Eptinezumab_HeavyChain
  source 1..1323: mol_type = other RNA
gaagttcaattagtagaatctggaggaggactcgttcaaccaggtggatctctaagattatcatgtgcagtatcaggaattgatctttctggctattacatgaactgggtccgacaagctccaggcaaaggattagaatgggtaggagtaattggaataaacggagctacctactatgcatcttgggctaaaggaagatttacaatttccagagataactcaaaaacaacagtatacctacaaatgaactctctacgagcagaagacacagcagtatatttttgtgcacgaggtgacatatggggacaaggcaccctagtaacagtctcatctgcctcaacaaaaggaccatccgtatttccattagccccatcatcaaaatcaacatcaggaggtacagcagcattaggctgtctagttaaagactactttcccgaacccgtaactgtatcctggaactctggagctctaacatccggtgtacacacttttccagcagtattacaatcatcaggattatattcactatcatcagtagtaaccgtaccctcatcatcactaggcacacaaacatatatatgcaacgtaaaccataaaccatcaaacacaaaagtagacgcaagagtagaaccaaaatcatgtgacaaaacacatacctgtccaccatgccccgcaccagaactattaggaggcccttctgtaacactatttcctcctaaaccaaaagatacactaatgatctcaagaacaccagaagtaacatgtgtagtggttgatgtatcacatgaagacccagaagtaaaattcaactggtacgtagacggtgtagaagtacacaatgctaaaacaaaaccacgagaagaacaatatgcatcaacatatagagtagtatccgtactcacagtcctacatcaagattggctaaatggaaaagaatataaatgcaaagtcagcaataaagctctacctgctccaatagaaaaaacaatatctaaagccaaaggccaacccagagaaccacaagtttacacactacctccatctagagaagaaatgacaaaaaatcaagtatctctaacatgtctagtaaaaggattctacccctccgatatagcagtagaatgggaaagtaacggacaacctgaaaataattacaaaacaacaccacctgtattagacagtgatggatcattctttctttattcaaaattaacagtagacaaaagccgatggcaacaaggaaatgtattttcatgtagtgtcatgcatgaagcactacacaatcactatacacaaaaaagtctatcactatcaccaggtaaa

SEQ ID NO: 46850 - RNA, 657 nt, synthetic construct
  misc_feature 1..657: note = derived and/or modified sequence opt6 from Eptinezumab_LightChain
  source 1..657: mol_type = other RNA
caagtattaacacaatcaccctcaagtctaagcgcaagcgtaggagatagagtaacaataaactgccaagcaagtcaatcagtataccataatacatacttagcatggtaccaacaaaaaccaggtaaagtaccaaaacaattaatatatgatgcaagcacactagcaagcggagtacctagcagattctcgggatcaggctcaggaacagattttaccttaacaataagctcactacaaccagaagatgtagcaacatactattgcttaggctcatacgattgcacaaacggagactgtttcgtattcggaggaggaacaaaagtagaaataaaacgaacagtagcagcaccaagcgtattcatattcccaccctcagacgaacaactaaaatcaggcacagcatcagtagtatgcttattaaataacttttacccacgagaagcaaaagtacaatggaaagtagataacgcactccaaagcggaaactcacaagaaagtgtaacagaacaagatagcaaagactcaacatatagcttatcatcaacattaacattaagcaaagcagattacgaaaaacataaagtatacgcatgcgaagtaacacaccaaggactaagctcgccagtgaccaaatcatttaacagaggagaatgc

SEQ ID NO: 46851 - RNA, 1368 nt, synthetic construct
  misc_feature 1..1368: note = derived and/or modified sequence opt6 from Erenumab_HeavyChain
  source 1..1368: mol_type = other RNA
caagtacaactagtagaatcaggaggcggagtagtacaaccaggacgatctctaaggctctcatgcgcagcatcaggcttcacatttagttcatttggaatgcattgggtacgacaagcccctggaaaaggactagaatgggtagcagtcatatcattcgacggaagcataaaatattcagtcgactcagtaaaaggaagatttacaatatcaagagataactccaaaaatacactattcctacaaatgaactcattacgagcagaagacacagcagtatactattgcgccagagatagattaaactattacgattcatccggatactatcactacaaatattacggaatggcagtatggggacaaggaactacagttacagtatcatcagcaagcacaaaaggaccatcagtattccctttagccccctgttcaagatcaacatctgaatctacagcagcactaggctgtctagtaaaagattacttcccagaaccagttaccgtatcctggaacagcggcgccctaacatcaggagtccacaccttccctgctgtcttacaatctagtggactgtactctttaagctcagtcgtaactgtaccaagtagcaatttcggtacacaaacttatacatgcaacgtagatcataaacccagcaacacaaaagtcgataaaacagtcgaacgaaaatgctgtgtagaatgtccaccatgtccagctccaccagtcgcaggcccatccgtttttctttttccacccaaaccaaaagatacactcatgatctctagaacaccagaagtaacatgcgtagtcgtagacgtatcacatgaagatccagaagtacaatttaattggtatgtagacggagtagaagtacataatgcaaaaactaaaccacgagaagaacaatttaactccacttttagagtagtttcagtcttaacagtagtacatcaagattggttaaatggtaaagaatataaatgtaaagtatcaaacaaaggacttccagcaccaatagaaaaaacaatctcaaaaacaaaaggacaaccaagagaaccacaagtatacacattaccaccatcaagagaagaaatgacaaaaaaccaagtatcattaacctgcttagtcaaaggattctatccatcagatatagcagtagaatgggaaagcaatggacaaccagaaaacaactacaaaaccacaccaccaatgttagacagcgacggaagctttttcctatactctaaattaactgtagataaaagcagatggcaacaaggaaacgtattttcttgctccgtaatgcatgaagcattacacaaccattatacacaaaaatcattatcactatcaccaggaaaa

SEQ ID NO: 46852 - RNA, 648 nt, synthetic construct
  misc_feature 1..648: note = derived and/or modified sequence opt6 from Erenumab_LightChain
  source 1..648: mol_type = other RNA
caatccgtactaacacaaccaccatcagtatcagcagcaccaggacaaaaagtcactatatcctgctcaggatcaagttcaaacataggaaacaactacgtatcatggtaccaacaactaccaggcacagcaccaaaactactaatatacgacaacaacaaaagaccatcaggaataccagacagattctcaggctcaaaatcaggaacatcaacaacactaggaataacaggactacaaacaggcgacgaagcagactactattgcggaacatgggactcaagactatcagcagtagtattcggaggaggaacaaaactaacagttttaggacaaccaaaagcaaaccccacagtaacactattcccaccatcatcagaagaactacaagcaaacaaagcaacattagtatgtctaatatcagacttctaccccggagcagtaacagtagcatggaaagcagacggatcaccagtaaaagccggcgtagaaacaacaaaaccatccaaacaatcaaacaacaaatacgcagcctcatcatacctatccctaacaccagaacaatggaaatcacatagatcatactcatgccaagtaacacacgaaggatcaacagtcgaaaaaacagtagcaccaacagaatgcagc

SEQ ID NO: 46853 - RNA, 1344 nt, synthetic construct
  misc_feature 1..1344: note = derived and/or modified sequence opt6 from Fremanezumab_HeavyChain
  source 1..1344: mol_type = other RNA
gaagtacaacttgttgaatcgggaggaggcctagtacaacccggaggatctttaagactttcatgtgcagcatcaggattcacattcagtaattactggatatcatgggttagacaagcaccaggaaaaggactagaatgggtagctgaaataagatcagaatccgatgcatccgcaacccattacgcagaagcagtaaaaggaagattcacaatatcaagagataacgctaaaaactctttatacttacaaatgaatagcctaagagcagaagatacagcagtttactattgcctagcatatttcgattatggactagcaatacaaaactactggggacaaggaacattagtcacagtatcctcagcatctacaaaaggaccctcagtattccccttagcaccctgctcaagatcaacatccgaaagtacagcagcattaggatgtctagtaaaagattactttcccgaaccagttacagtaagctggaacagtggagcccttacaagtggagtccatacatttcccgcagtattacaatcatcaggactctatagcttatcatcagtagtaacagtaccctccagtaacttcggaactcaaacatatacctgcaacgttgaccacaaaccatccaatacaaaggtagataaaacagtagaaagaaaatgctgtgtagaatgcccaccctgtccagcacccccagtagcaggacccagtgtatttttattcccaccaaaaccaaaagacacattaatgatctcacgaacccccgaagtaacatgtgtagtagtagacgtatcacatgaagatccagaagtccaatttaattggtacgtagatggagtagaagtacacaatgcaaaaaccaaaccaagagaagaacaatttaactcaacatttagagtagtttcagtcctaaccgtagtacatcaagattggttaaacggcaaagaatataaatgtaaagtttccaacaaaggcctaccatcttctatagagaaaacaatttcaaaaacaaaaggtcaacccagagaaccacaagtatatacactaccaccatcacgtgaagaaatgactaaaaatcaagtatctctaacatgcctagtaaaaggattctacccatcagacatagcagtcgaatgggaatcaaatggacaaccagaaaacaattacaaaacaacaccaccaatgttagattcagacggatcatttttcttatactcaaaacttaccgtagacaaatcaagatggcaacaagggaacgtattctcatgttcagtaatgcatgaagcactacacaatcactatacacaaaaatcactaagtctaagcccaggtaaa

SEQ ID NO: 46854 - RNA, 642 nt, synthetic construct
  misc_feature 1..642: note = derived and/or modified sequence opt6 from Fremanezumab_LightChain
  source 1..642: mol_type = other RNA
gaaatagtactaacacaatcaccagccaccctatcactaagcccaggcgaaagagcaacactatcatgcaaagcatcaaaacgagtcacaacatacgtatcatggtaccaacaaaaaccaggacaagcaccaagactcctaatatacggcgcatcaaacagatacctaggaataccagcaagattctcaggatcaggatcaggaacagacttcacactaacaatttcatctctagaacccgaagactttgcagtatactattgctcacaatcatacaactacccatacacattcggccaaggaacaaaactagaaataaaacgaacagtagcagccccatcagtattcatattcccaccatcagacgaacaactaaaatcaggaacagcatcagtcgtatgcctactcaacaatttctacccaagagaagcaaaagtacaatggaaagtagacaacgcactacaatccggaaactcacaagaatcagtaacagaacaagactcaaaagactcaacatactcactatcctcaaccctaacactatcaaaagcagactatgaaaaacataaagtatacgcatgtgaagtaacacaccaaggactatcatcaccagtaacaaaatccttcaaccgaggcgaatgc

SEQ ID NO: 46855 - RNA, 1371 nt, synthetic construct
  misc_feature 1..1371: note = derived and/or modified sequence opt6 from Frunevetmab_HeavyChain
  source 1..1371: mol_type = other RNA
caagtacaattagtagaaagcggagcagaattagtacaaccaggagaatcacttcgactaacatgcgcagcaagtggattctcactaactaacaataatgtaaactgggtccgtcaagcaccaggtaaaggtctagaatggatgggcggcgtatgggcaggaggagcaacagactacaactcagcgctaaaatctcgactaacaatcactcgagacacatctaaaaataccgttttcctacaaatgcatagtctacaatctgaagatacagcaacatattattgcgcaagagacggcggatactcatcctcaacattatacgcaatggacgcatggggccaaggaacaaccgtaacagtatcagcagcatcaactactgcaccatcagtattcccactagcaccatcttgcggcactacatccggagcaacagtagcactcgcttgcctagtattgggatattttccagaacctgtaacagtatcatggaatagtggtgcattaacttcgggagtacatacctttccagctgtacttcaagcatctggattatattcactttcatcaatggttaccgttccctcctcaagatggctctcagacacatttacatgtaatgtagcccacccaccctctaacacaaaagtagacaaaactgttcgtaaaactgaccacccaccaggcccaaaaccatgtgactgcccaaaatgcccaccaccggaaatgctaggaggaccatcaatattcatatttcctcccaaaccaaaagatacattatcaatatcaagaacacctgaagtaacatgcctagttgtagacctaggtccagatgactctgatgtacaaataacatggtttgtagacaatactcaagtttacacagccaagacatcaccacgagaagaacaattcaactcaacttaccgcgtagtatcagttttacctattctacatcaagactggttaaaaggtaaagaatttaaatgcaaagtaaattccaaaagtttaccttctccaatagaacgaacaatatcaaaagcaaaaggacaaccacatgaaccccaagtttatgtactcccaccagcacaagaagaactctcaagaaataaagtatcagttacatgcttaataaaatcattccacccaccagacatagccgtcgaatgggaaataacaggacaaccagaaccagaaaataactatcgaaccacaccaccacaactagattccgacggaacctatttcgtctactctaaactatctgtagataggtctcattggcaacgtggaaatacctacacttgctctgtatcacatgaagcattacactcacatcacactcaaaaatcattaacacaatcgcctggaaaa

SEQ ID NO: 46856 - RNA, 651 nt, synthetic construct
  misc_feature 1..651: note = derived and/or modified sequence opt6 from Frunevetmab_LightChain
  source 1..651: mol_type = other RNA
gatatagaaatgacacaatcaccactatcactatcagtcacaccaggcgaatcagtatcaatatcatgcagagcatcagaagacatatacaacgccttagcatggtacttacaaaaaccaggaagatcaccaagactactaatctacaacacagacacactacacacaggagtaccagacagattctcaggatcaggctcaggaacagactttacattaaaaatatccagagtacaaacagaagacgtaggagtatacttctgccaacactacttccactacccaagaacattcggacaaggaacaaaactagaactaaaaagatcagacgcacaaccatcagtattcctattccaaccatcactagacgaactacacacaggatcagcatcaatagtatgcatactaaacgacttctacccaaaagaagtcaacgtaaaatggaaagtagacggcgtagtacaaaacaaaggaatacaagaatcaacaacagaacaaaactcaaaagacagtacatattcactatcatcaacactaacaatgtcatcaacagaataccaatcccacgaaaaattctcatgcgaagtcacacacaaatcattagcatctactctagtaaaatcatttaacagaagcgaatgccaaagagaa

SEQ ID NO: 46857 - RNA, 1341 nt, synthetic construct
  misc_feature 1..1341: note = derived and/or modified sequence opt6 from Gatipotuzumab_HeavyChain
  source 1..1341: mol_type = other RNA
gaagttcaattagtagaatccggaggcggcttagtacaaccaggaggatctatgagattatcctgcgtagcaagcggattcccattctcaaattactggatgaactgggtaagacaagcacctggaaaaggcttagaatgggtaggtgaaataagattaaaatctaacaactataccactcactacgcagaaagcgtcaaaggaagatttacaatatcaagagacgactcaaaaaattcactttatctacaaatgaactccctaaaaacagaagatacagcagtctattattgtacaagacactattacttcgactactggggacaaggaacattagtaacagtctcatcagcctcaacaaaaggtccatccgtattccctctagcaccatcatcaaaatcaacatcaggaggcaccgcagctctaggatgtctagttaaagactacttccccgaaccagttactgtatcatggaactcaggcgcactaacatcaggcgtacacacattcccagcagtactacaatcatcaggactatactcactatcaagcgttgtcacagtaccctcatcatcactaggaacccaaacatatatctgcaacgtaaatcataaaccctcaaatacaaaagtagacaaaaaagtagaaccaaaatcctgcgataaaacacacacctgcccaccatgcccagcacccgaactcctaggaggcccttcagtcttcctatttcctccaaaaccaaaagacacactcatgatatcaagaacacctgaagtaacatgcgtcgttgtcgacgtatcccatgaagatccagaagtaaaattcaactggtatgtagatggagtcgaagtacataacgccaaaacaaaaccaagagaagaacaatacaactctacatacagagtagtctcagtactaacagtcctacaccaagactggctaaacggaaaagaatacaagtgtaaagtatcaaacaaagcactcccagcaccaatagaaaaaacaatatcaaaagcaaaaggtcaaccaagagaaccacaagtatacaccctaccaccatcacgagatgaattaaccaaaaaccaagtatcactaacatgtctagtcaaaggattctacccttctgacatagcagtagaatgggaatctaacggtcaaccagaaaataactacaaaactacaccaccagttctagattctgacggatccttcttcttatattcaaaactaactgtagataaaagtagatggcaacaaggaaacgtattctcatgttcagtaatgcacgaaggattacacaatcactacacacaaaaatcattatcattatcaccaggaaaa

SEQ ID NO: 46858 - RNA, 657 nt, synthetic construct
  misc_feature 1..657: note = derived and/or modified sequence opt6 from Gatipotuzumab_LightChain
  source 1..657: mol_type = other RNA
gatatagtaatgacacaatcaccactatcaaacccagtaacaccaggagaaccagcatcaatatcatgccgatcctcaaaatcactactacactcaaacggaataacatacttcttctggtacttacaaaaaccaggacaatcaccacaactactcatctaccaaatgtcaaacctagcatcaggagtaccagaccgattctcaggatcaggatcaggaacagacttcacattaagaatatccagagtagaagcagaagacgtcggagtatactactgcgcacaaaacttagaactacccccaacattcggacaaggaacaaaagtagaaattaaaagaactgtagcagcaccatcagtcttcatattcccaccatcagacgaacaattaaaatcaggcacagcatcagtagtatgcctactaaacaatttctacccaagagaagcaaaagtacaatggaaagtagacaacgcactacaatcaggaaactcacaagaatcagtaacagaacaagactcaaaagactcaacatattcactatcctcaacactaacattatcaaaagccgactacgaaaaacacaaagtatacgcatgcgaagtaacacaccaaggactatcatcaccagtcacaaaatctttcaacagaggtgaatgc

SEQ ID NO: 46859 - RNA, 1365 nt, synthetic construct
  misc_feature 1..1365: note = derived and/or modified sequence opt6 from Gedivumab_HeavyChain
  source 1..1365: mol_type = other RNA
gaggtacaattagttgaaagtggaggaggcgtcgtacaaccaggaaaatctctacgattatcatgcgctgcatcaggcttaacattcagctcctacgccgtccattgggtcagacaagcaccaggcaaaggattagaatgggtcacactaatatcatatgacggagcaaatcaatattatgccgacagcgtaaaaggaagatttacaatatcccgagacaactcaaaaaatacagtctacttacaaatgaactctttaagacccgaagacacagcagtatactactgtgcagtacccggaccagtatttggaatattccccccctggtcttacttcgataactggggacaaggaatactagtaacagtatcctcagcatctacaaaaggcccaagtgtatttccattagccccatcatccaaatcaacatcaggaggaacagcagcacttggatgtctggttaaagactactttccagaaccagtaacagtatcatggaattcaggagcattaacatctggagtccatacattccccgctgtactccaatcatcaggactatactcactctcatcagttgtcacagtaccttcatccagcctcggtacacaaacatacatttgtaatgtaaaccataaaccctcaaatacaaaagtagacaaaaaagtagaaccaaaatcatgtgacaaaacacacacatgcccaccatgtcctgcacctgaactactaggaggaccatcagtattcctatttccacctaaaccaaaagacacactaatgatctcacgaacaccagaagtaacatgcgtcgtcgtagacgtatcccacgaagaccccgaagtaaaattcaattggtatgtagacggagtagaagttcacaacgccaaaaccaaacctagagaagaacaatacaattcaacttatagagtagtctcagtattaacagtattacaccaagactggctaaatggaaaagaatacaaatgcaaagtatcaaacaaagcactaccagcaccaatagaaaaaacaatatcaaaagcaaaaggacaacccagagaaccacaagtatacacactaccaccaagtcgagaagaaatgacaaaaaaccaagtatcattaacttgcctcgttaaaggattctatccttcagacatcgcagtcgaatgggaatcaaatggacaaccagaaaacaactacaaaacaacacctcccgtattagactcagacggctctttcttcctatactctaaactaactgtagacaaatcaagatggcaacaaggaaacgtcttctcctgctcagtaatgcacgaagcacttcacaatcactacactcaaaaatctttatccttaagtccaggtaaa

SEQ ID NO: 46860 - RNA, 648 nt, synthetic construct
  misc_feature 1..648: note = derived and/or modified sequence opt6 from Gedivumab_LightChain
  source 1..648: mol_type = other RNA
gaaatagtactcacacaatcaccagccacactaagtgtatcaccaggagaaagagcaacactatcatgcagagcctcacaagtaatatcacacaacctagcatggtaccaacaaaaaccaggacaagctccaagactactaatatacggagcatcaacaagagcatcaggaataccagccagattttcaggatcaggatcaggcacagactacaccttaacaataacatcactacaaagcgaagacttcgcagtatactactgccaacattacagcaattggccaccaagactaacattcggaggaggaacaaaagtagaaataaaaagaacagtagcagcaccatcagtattcatattcccaccatcagatgaacaattaaaatcaggaacagcatcagtagtatgcctattaaacaacttctacccaagagaagcaaaagtccaatggaaagtagacaacgcactacaaagcggaaattcacaagaatcagtaacagaacaagacagcaaagactcaacatactcactaagctcaacactaacattatcaaaagccgactacgaaaaacacaaagtatacgcatgcgaagtaacacaccaaggactatcatccccagtaacaaaatcattcaacagaggagaatgc

SEQ ID NO: 46861 - RNA, 1329 nt, synthetic construct
  misc_feature 1..1329: note = derived and/or modified sequence opt6 from Gemetuzumab_HeavyChain
  source 1..1329: mol_type = other RNA
gaagtacaactcgtacaatctggagctgaagtaaaaaaaccaggttccagtgttaaagtatcttgcaaagcatccggatatacaatcaccgattcaaacatacactgggtaagacaagcacctggacaatcattagaatggataggatacatatatccatataatggaggcacagactataatcaaaaattcaaaaaccgcgcaacactaacagttgacaaccccacaaacacagcatacatggaattatcctctttacgttcagaagacacagcattctactattgcgtaaatggcaacccgtggctagcctactggggacaaggaacactagtcacagtaagctccgcctcaacaaaaggaccatctgtatttccgttagccccatgttcaagatcaacaagtgaatcaacagcagcattaggatgcctagtaaaagattactttcctgaacctgtcaccgtatcatggaattccggagcattaacatccggagtacacacattcccagctgtattacaatcatcaggattatactcattatcatccgtagttaccgtaccaagttcatccttaggaacaaaaacatatacctgcaacgtagatcataaaccatcaaatacaaaagtagataaaagagtagaatcaaaatacggaccaccatgccctccatgtccagcaccagaattcctaggaggcccatcagtatttctattcccaccaaaaccaaaagacacactaatgatatcacgaacacctgaagtaacatgtgtagtagtagacgtatcacaagaagaccctgaagtccaatttaattggtacgtagatggagtagaagtacacaatgcaaaaacaaaaccaagagaagaacaatttaactcaacctaccgagtcgtatcagtattaaccgtattacatcaagactggttaaacggaaaagaatacaaatgtaaagtttcaaacaaaggcctaccatcatcaatagaaaaaactatatccaaagcaaaaggacaacccagagaaccacaagtatacacacttccaccatcacaagaagaaatgactaaaaaccaagtatcattaacatgtttagtaaaaggcttctacccatcagacattgcagtagagtgggaatcaaacggacaaccagaaaataactacaaaacaactcccccagtactagattcagacggctcattcttcctatatagcagactaaccgtagacaaatcccgttggcaagaaggaaacgtattttcatgctccgtaatgcacgaagcattacataaccactacacccaaaaatcactatcactcagcttaggaaaa

SEQ ID NO: 46862 - RNA, 654 nt, synthetic construct
  misc_feature 1..654: note = derived and/or modified sequence opt6 from Gemetuzumab_LightChain
  source 1..654: mol_type = other RNA
gacatacaattaacacaatcaccctcaacactatcagcaagcgtaggagaccgagtaacaataacatgcagagcatcagaatcactagacaactatggaataagattcttaacatggttccaacaaaaacctggaaaagcaccaaaactactaatgtacgcagcatcaaaccaaggatcaggcgtaccaagtagattctcaggatcaggatcaggaacagaattcacattaaccatatcctcactacaaccagacgacttcgcaacatactactgccaacaaacaaaagaagtaccatggtcattcggacaaggaacaaaagtagaagtaaaaagaacagtagcagcaccatcagtcttcatcttcccaccatcagacgaacaactaaaatcaggaacagcatcagtagtatgcctactaaacaacttctacccacgagaagcaaaagtccaatggaaagtagacaacgcactacaaagcggaaattcacaagaatcagtaacagaacaagacagcaaagactcaacatactcattatcatcaacactaacactatcaaaagcagactacgaaaaacacaaagtatacgcatgcgaagtcacacaccaaggcctaagttcaccagtaacaaaatccttcaacagaggagaatgc

SEQ ID NO: 46863 - RNA, 1365 nt, synthetic construct
  misc_feature 1..1365: note = derived and/or modified sequence opt6 from Gilvetmab_HeavyChain
  source 1..1365: mol_type = other RNA
gaagtacaattagtacaaagtggaggagatctagttaaaccaggaggaagcgtaagactatcttgtgttgcaagtggatttaatattaaaaatacatacatgcattgggtaagacaagcaccaggaaaaggattacaatggataggccgaatagcaccagcgaatgtagacacaaaatacgctccaaaattccaaggtaaagcaactatatcagcagacacagccaaaaatacagcatacatgcaactcaacagcctaagagcagaagacactgcagtatactattgcgtactaatttactacgattatgacggagatatagatgtatggggtcaaggaactctagtaacagtatcttcagcatcaacaactgctcccagtgtatttccattagcaccatcatgcggaagtacatctgggtcaacagtagctcttgcatgcttagtatcaggttattttccagaaccagtaacagtaagctggaatagcggatcacttacatcaggagttcacacctttccatcagtcttacaatcctcaggtctatactcattatcatctatggttacagtaccaagttcaagatggccatccgaaaccttcacatgtaacgtcgcacacccagcatccaaaacaaaagtagataaacctgtacccaaacgagaaaatgggagagtaccaagaccaccagactgccccaaatgtccagcaccagaaatgttaggaggtccatcagtattcatatttccaccaaagccaaaagatacactactaattgctaggacaccagaagttacatgtgtagttgtagctttagatcccgaagaccccgaagtacaaatatcatggtttgttgatggtaaacaaatgcaaacagcaaaaactcaaccaagagaagaacaatttgcaggcacttatagagtagtatcagtactaccaataggccatcaagattggctcaaaggtaaacaattcacatgtaaagtaaacaataaagctctaccatcacctatagaaagaaccatctcaaaagcaaggggacaagcacaccaaccatcagtatatgttttacccccatcaagagaagaattatccaaaaatacagtatcacttacatgtctaataaaagatttcttcccacctgacatagacgtagaatggcaatccaacggtcaacaagaacctgaatccaaatatcgaacaacacctccacaactagatgaagatggatcttacttcttatattcaaaactatctgtagataaatcacgatggcaaagaggagatacttttatatgtgcagtaatgcacgaagcattacataaccattatacacaagaatcactatcacactcccccggaaaa

SEQ ID NO: 46864 - RNA, 654 nt, synthetic construct
  misc_feature 1..654: note = derived and/or modified sequence opt6 from Gilvetmab_LightChain
  source 1..654: mol_type = other RNA
gacatagtaatgacacaaacaccactatcactatcagtatcattaggcgaaccagcatccatatcatgccacgcatctcaaaacataaacgtttggctatcatggtatagacaaaaaccaggacaaataccccaactactaatatacaaagcatcacacctacacacaggagtcccagacagattctcaggatcaggctcaggaacagacttcacactaagaatatcaagagtagaagccgacgacgcaggcgtatactattgccaacaaggacaatcctggccactaacattcggacaaggaacaaaagtagaaataaaaagaaacgacgcacaaccagcagtatacctattccaaccatcaccagaccaattacacacaggatcagcatcagtagtatgcttactaaactcattctacccaaaagatataaacgtaaaatggaaagtagacggagtaatacaagacacaggaatacaagaatcagtaaccgaacaagactcaaaagactcaacatactcactatcatcaacactaaccatgtcctcaacagaatatctatcacacgaactatactcatgcgaaataacacacaaatcactaccatcaacattaataaaatcattccaaagatcagaatgccaaagagtagac

SEQ ID NO: 46865 - RNA, 1344 nt, synthetic construct
  misc_feature 1..1344: note = derived and/or modified sequence opt6 from Ifabotuzumab_HeavyChain
  source 1..1344: mol_type = other RNA
caagtccaactagtacaatcaggagcagaagtaaaaaaaccaggagcaagcgtaaaagtatcctgtaaagcatcaggatacacattcaccggatattggatgaattgggtaagacaagcacccggtcaaggattagaatggatgggtgacatatatccaggatcaggaaatacaaactatgacgaaaaattccaaggaagagtaacaatgacaagagacacttcaataagcacagcatatatggaattaagtagattaagatcagatgatacagcagtatattactgtgcacgaggaggatactatgaagacttcgatagctggggacaaggcacaacagtcacagttagctctgcatcaacaaaaggcccgtcagtcttccctctagcaccgagtagcaaaagtacaagcggaggaaccgcagcattaggatgtttagttaaagactacttcccagaaccagtaacagtatcatggaattcaggagcactaacatcaggcgtacatacattccccgcagtcttacaatcaagcggactatactcactatcatcagtagtaacagtaccctcatctagcctaggaacacaaacatacatatgcaacgtcaatcacaaaccatcaaatacaaaagtagacaaaagagtagaaccaaaatcatgtgataaaacacatacatgcccaccatgcccagcaccagaattattaggaggaccatcagtattcctatttccaccaaaacctaaagacacactcatgatatcaagaacacctgaagttacatgcgtagtagtagacgtatcacatgaagatccagaagtaaaatttaactggtatgtagacggcgtagaagtacataacgcaaaaacaaaaccaagagaagaacaatacaactcaacatatagagtagtttcagtattgacagtactacaccaagactggctaaatggcaaagaatataaatgtaaagtatcaaacaaagcactaccggcaccgatagaaaaaacaataagtaaagcaaaaggacaaccaagagaaccacaagtatataccttaccacccagcagagaagaaatgactaaaaatcaagtatcactaacatgcctagttaaaggtttctacccaagcgacatagcagtagaatgggaatcaaatggacaacctgaaaataactataaaacaacaccaccagttttagactccgatggatcattctttctatactccaaactaacagtagacaaatcaagatggcaacaaggaaacgtattttcatgttcagtgatgcatgaagcattacacaaccattacacccaaaaaagcttaagcttatcacccggaaaa

SEQ ID NO: 46866 - RNA, 642 nt, synthetic construct
  misc_feature 1..642: note = derived and/or modified sequence opt6 from Ifabotuzumab_LightChain
  source 1..642: mol_type = other RNA
gacatacaaatgacacaatcaccatcattcttatcagcatcagtcggcgacagagtaacaataacatgcagagcctcccaaggaataatatcatacctagcatggtaccaacaaaaaccagaaaaagcacccaaaagactaatctacgcagcctcctcactacaatcaggagtaccatcaagattctcaggatccggctcaggtacagaattcacactaacaatatcatcactacaacccgaagacttcgcaacatactactgcggacaatacgcaaattacccatacacattcggacaaggaaccaaactcgaaataaaaagaacagtagcagcaccatccgtattcatattcccaccatccgacgaacaactaaaatcaggaacagcatcagtcgtatgcttactcaacaacttctacccaagagaagcaaaagtacaatggaaagtagacaacgcactacaatccggaaactcacaagaatcagtaacagaacaagactcaaaagactcaacatactcactatcatcaacactaacactttcaaaagcagactacgaaaaacacaaagtatatgcatgcgaagtaacacaccaaggattatcctcaccagtcacaaaatcattcaacagaggagaatgc

SEQ ID NO: 46867 - RNA, 1323 nt, synthetic construct
  misc_feature 1..1323: note = derived and/or modified sequence opt6 from Iratumumab_HeavyChain
  source 1..1323: mol_type = other RNA
caagtccaacttcaacaatggggagcaggtctactaaagccatcagaaacactatccctaacatgcgcagtctacggaggaagtttctcagcctactactggtcatggatacgtcaaccaccaggtaaaggactagaatggataggagacatcaaccacggaggaggaacaaactataacccatccttaaaatcacgagtcaccatatctgtagacacatcaaaaaaccaattctcattaaaactcaacagtgtaacagcagcagacaccgccgtctattactgcgccagcctaacagcatactggggacaaggatcattagtaactgtctcatcagcctcaacaaaaggaccatcagtctttccattagcaccttcatctaaatcaacttcaggaggaacagcagcactaggctgcttagtaaaagactacttcccagaaccagttacagtaagttggaattcaggagcactcacctcaggagtccatacattccccgcagtactccaatcatcaggactatactcactctcaagtgtagtaacagtaccatcatcatcccttggaacacaaacatacatttgtaacgtaaaccacaaaccatcaaacacaaaagtagataaaaaagtagaacccaaatcctgtgataaaactcacacatgcccaccatgtcccgcacctgaattactcggaggtccctcagtatttttatttccaccaaaaccaaaagatacactaatgatatcacgtacaccagaagtaacatgcgtagtcgtagacgtatcacatgaagacccagaagtcaaattcaattggtacgtcgacggagtagaagtacacaacgctaaaacaaaacctagagaagaacaatataatagcacttacagagttgtatcagtattaacagtactccatcaagactggctaaacggaaaagaatacaaatgtaaagtatccaacaaagctctaccagcaccaatagaaaaaacaatttctaaagcaaaaggtcaaccaagagaaccacaagtatatacactcccaccatcaagagatgaactaaccaaaaatcaagtatctcttacatgcctagtaaaaggcttttacccatcagatatagcagtagaatgggaatccaatggtcaacccgaaaacaactacaaaacaacacctccagtcctcgactcagacggttcattctttctctactccaaactaacagtagacaaaagccgatggcaacaaggaaatgtattctcatgttcagtaatgcacgaagcacttcacaaccatacacaaaaatccttatcactatcaccaggaaaa

SEQ ID NO: 46868 - RNA, 642 nt, synthetic construct
  misc_feature 1..642: note = derived and/or modified sequence opt6 from Iratumumab_LightChain
  source 1..642: mol_type = other RNA
gacatacaaatgacccaatcacccacatccctaagcgcatcagtaggagaccgagtaacaataacatgccgagcatcccaaggaatatcctcatggctaacatggtaccaacaaaaaccagaaaaagctccaaaatcactaatatacgcagcatcatctctccaatcaggagtaccatcaagattctccggatcaggctcaggaacagactttacactaacaatatcatcactccaaccagaagacttcgcaacatactactgccaacaatacgactcatacccaatcaccttcggacaaggaacaagacttgaaataaaaagaacagtagcagcaccatcagtattcatattcccaccatccgacgaacaattaaaatcaggcacagcatcagtagtatgcctactaaacaacttttacccaagagaagcaaaagtccaatggaaagtagacaacgcactacaatcaggaaactcacaagaatcagtaacagaacaagactcaaaagactcaacatactcactatcatcaaccttaacactaagcaaagcagactacgaaaaacacaaagtatacgcctgcgaagtcacacaccaaggactatcatctcccgtcacaaaatccttcaacagaggcgaatgc

SEQ ID NO: 46869 - RNA, 1344 nt, synthetic construct
  misc_feature 1..1344: note = derived and/or modified sequence opt6 from Lacnotuzumab_HeavyChain
  source 1..1344: mol_type = other RNA
caagtacaactccaagaatcaggaccaggacttgtcaaaccctcacaaacactatcactaacatgcaccgtatcagactactccataacatcagattatgcatggaattggatacgccaattcccaggcaaaggactagaatggatgggatacatatcttattcaggatcaacatcatacaacccatcattgaaatcaagaataacaatatcaagagatacatctaaaaaccaatttagcctacaactcaacagcgtaaccgctgcagatactgcagtatactactgcgcctcattcgactacgcacacgcaatggactactggggacaaggaacaactgtcacagtaagttccgcatctacaaaaggaccctcagtattccccctagcaccctcatcaaaatccacatcaggaggaacagcagcattaggctgcctcgttaaagattattttcccgaaccagttacagtctcatggaactcaggagcattaacatcaggtgtacacacattcccagcagtattacaatcatccggattatattcactatcatcagttgtaacagtaccatcctcatcattaggcacacaaacctatatatgcaacgtaaaccataaaccatccaatacaaaagtagacaaaagagtcgaacccaaatcatgtgataaaacacatacatgcccaccatgccccgcaccagaactactaggaggaccctccgtatttctatttccaccgaaaccaaaagacacactaatgatatcacgaacaccagaagtaacatgtgtagtcgtagacgtatcacatgaagatccagaagtaaaatttaactggtacgtagacggtgtcgaagtacacaacgccaaaacaaaaccccgcgaagaacaatacaactcaacctacagagttgtttcagttcttaccgtcttacaccaagactggctcaacggcaaagaatacaaatgtaaagtatccaacaaagcactcccagcaccaattgaaaaaacaatatcaaaagcaaaaggacaaccaagagaaccacaagtttacacattaccaccctcaagagaagaaatgactaaaaatcaagtatcattaacatgcctagtcaaaggcttctacccctcagacatagcagtagaatgggaatcaaatgggcaaccagaaaataattacaaaacaacaccacctgtactagactccgacggatcctttttcttatactccaaattaacagtagataaatcccgatggcaacaaggaaacgtattttcttgctctgtaatgcacgaagcacttcacaatcactacacacaaaaatctctctcattatcacctggaaaa

SEQ ID NO: 46870 - RNA, 642 nt, synthetic construct
  misc_feature 1..642: note = derived and/or modified sequence opt6 from Lacnotuzumab_LightChain
  source 1..642: mol_type = other RNA
gacatagtattaacacaatcacccgcattcctatcagtaaccccaggcgaaaaagtaacattcacctgtcaagcatcacaatcaataggcacatcaatacactggtaccaacaaaaaacagaccaagcaccaaaactactaataaaatacgcatcagaatcaataagcggaatcccatcaagattctcaggctcaggctcaggaacagacttcacactaacaatatcatcagtcgaagcagaagacgcagcagactactactgccaacaaataaactcatggccaacaacattcggaggaggtacaaaactagaaataaaaagaacagtagcagcaccatcagtattcatattcccaccatcagacgaacaactaaaatcaggcacagcatctgtagtatgcctactaaacaacttctacccaagagaagcaaaagtacaatggaaagtcgacaacgcactacaaagcggaaactcacaagaaagcgtaacagaacaagactcaaaagactcaacatacagcctatcatcaacactaacattatcaaaagcagactacgaaaaacacaaagtatacgcatgcgaagtcacacaccaaggattatcatcaccagtaaccaaatccttcaacagaggagaatgc

SEQ ID NO: 46871 - RNA, 1347 nt, synthetic construct
  misc_feature 1..1347: note = derived and/or modified sequence opt6 from Larcaviximab_HeavyChain
  source 1..1347: mol_type = other RNA
gaagtacaactccaagaatcaggcccagaactagaaatgccaggagcatctgtaaaaatttcctgtaaagcatcaggatcatcattcactggtttctccatgaactgggttaaacaatcaaacggaaaatcactagaatggattggaaatatagatacatattacggaggaactacatataatcaaaaattcaaaggaaaagcaacactcaccgtagacaaaagctcatcaacagcctatatgcaactaaaatccctcacttcagaagattcagcagtatactattgtgcaagaagcgcatactacggatcaacttttgcatactggggacaaggcacactagtaacagtctcagcagcttcaacaaaaggaccatcagtattcccacttgcaccatcatcaaaatcaacatcaggaggtacagcagcattaggatgtctagtaaaagactacttcccagaacccgtcacagtatcatggaattcaggagcattaactagtggagtacatacattccctgcagtcctacaatcatccggactctatagcttatcttcagtagtcactgtcccatcatcatcactcggaacacaaacatatatatgtaacgtcaatcataaaccatcaaatacaaaagtagacaaaagagttgaacctaaatcctgtgacaaaactcacacatgccccccatgccctgcaccagaactattaggaggcccatctgtattcctattcccaccaaaaccaaaagacaccctaatgatatcaagaacaccagaagtaacatgcgtcgtagttgacgtttcacacgaagacccagaagtaaaatttaattggtacgtagacggcgtagaagtacacaacgcaaaaacaaaaccaagagaagaacaatataactcaacatatagagtagtttcagtattaacagtactacatcaagattggctcaacggaaaagaatacaaatgcaaagtatcaaacaaagcccttccagcacctatagaaaaaacaatctcaaaagcaaaaggacaaccaagagaacctcaagtttacaccctacccccctcgagagatgaattaaccaaaaatcaagtatcccttacttgcttagtcaaaggattttatcccagcgacatagcagtcgaatgggaatccaacggacaaccagaaaacaactataaaacaaccccaccagtacttgacagtgacggatcattcttcctctactcaaaactaacagtagacaaatcaagatggcaacaaggcaacgtattctcttgttcagtcatgcatgaagcattacacaatcactatacacaaaaatccttatctttatctccaggcaaa

SEQ ID NO: 46872 - RNA, 642 nt, synthetic construct
  misc_feature 1..642: note = derived and/or modified sequence opt6 from Larcaviximab_LightChain
  source 1..642: mol_type = other RNA
gacatacaaatgacacaatcaccagcatcattaagcgcatcagtaggagaaacagtcacaataacatgcagagcatcagaaaacatatactcatacctagcatggtaccaacaaaaacaaggaaaatccccacaactattagtatacaacgcaaaaacactaatagaaggagtaccatcaagattctcaggatcaggatcaggaacacaattctcactaaaaataaactcactacaaccagaagacttcggatcatacttctgccaacaccatttcggaacaccattcacattcggatcaggaacagaactagaaataaaacgaacagtagcagccccaagcgtattcatatttccaccatcagacgaacaactaaaatcaggaacagcatcagtagtatgcctactaaacaacttctacccacgagaagccaaagtacaatggaaagtcgacaacgcactacaatcaggaaactcacaagaatcagtaaccgaacaagattcaaaagactcaacttactcactatcatcaacactaacattaagcaaagcagactacgaaaaacacaaagtatacgcatgcgaagtcacacaccaaggcctaagctcaccagtaacaaaatcattcaacagaggagaatgc

SEQ ID NO: 46873 - RNA, 1338 nt, synthetic construct
  misc_feature 1..1338: note = derived and/or modified sequence opt6 from Lendalizumab_HeavyChain
  source 1..1338: mol_type = other RNA
caagtacaattagtacaatctggagctgaagtaaaaaaacccggtgcctcagtcaaagtatcatgcaaagcatcaggatatacattcacagattacagtatggattgggtacgtcaagcaccaggccaaggactagaatggatgggtgcaatacatttaaacacaggatatacaaattacaatcaaaaattcaaaggaagagtcacaatgacacgcgacacctctacatcaacagtatatatggaactaagctcactaagatctgaagacactgcagtatactactgtgcaagaggcttttacgacggatattcaccaatggactactggggacaaggaacaacagtcacagtaagttcagcgtcaacaaaaggcccatcagtcttccccttagcaccatgctcaagatcaacctcggaatcaaccgcagccctaggatgcttagtaaaagactacttcccagaaccagtaacagtaagttggaactctggagcactaaccagtggagtacatacatttccagccgtcttacaatcatcaggattatactcattatcatccgtagttaccgtaccatctagcaacttcggaacacaaacttacacctgtaatgttgaccataaaccaagtaatactaaagttgacaaaacagtagaacgaaaatgttgcgtcgaatgccctccatgcccagctcccccagtagcaggaccaagtgtattcttatttccaccaaaaccaaaagacacattaatgatatcacgcacaccagaagtaacatgtgtagtcgttgatgtatcacaagaagatccagaagttcaattcaactggtacgtagacggagttgaagtacacaatgcaaaaaccaaaccaagagaagaacaattcaacagcacttatagagtagtaagcgtattaacagtcttacaccaagattggttaaatggaaaagaatacaaatgcaaagtatcaaacaaaggactaccatcatccatagaaaagacaataagtaaagcaaaaggacaacccagagaaccacaagtatacacactaccaccttctcaagaagaaatgacaaaaaaccaagtaagcttaacatgcctcgtaaaaggtttctatccatcagatatcgcagtagaatgggaaagtaacggccaaccagaaaacaactataaaacaacacccccagtcttagattcagacggaagcttttttctatactccagattaacagttgacaaatctagatggcaagaaggaaacgtatttagttgctcagtaatgcacgaagcactacataatcactatacacaaaaatccctaagcttatcactaggaaaa

SEQ ID NO: 46874 - RNA, 654 nt, synthetic construct
  misc_feature 1..654: note = derived and/or modified sequence opt6 from Lendalizumab_LightChain
  source 1..654: mol_type = other RNA
gacatccaaatgacacaaagcccatcaagcctaagcgcaagcgtaggcgaccgagtaacaataacatgcagagcatcagaaagcgtagactcatacggaaactcattcatgcactggtaccaacaaaaaccaggaaaagcaccaaaactattaatatacagagcaagcaaccttgaatcaggagtaccatcaagattctcaggctcaggatcaggaacagactttacactaacaatatcatcactacaaccagaagacttcgcaacatactactgccaacaatcaaacgaagacccatacacattcggaggcggaacaaaagtagaaataaaaagaacagtagcagcaccaagcgtattcatatttccaccatcagacgaacaactaaaatcaggcacagcatcagtagtatgcttactaaacaacttctacccaagagaagcaaaagtacaatggaaagtagacaatgcactacaaagcggaaactcacaagaatcagtaacagaacaagactcaaaagactccacatactcactaagctcaacactaacattaagcaaagcagattacgaaaaacataaagtatacgcatgtgaagtaacacaccaaggactatcatcacctgtaacaaaatcattcaacagaggagaatgc

SEQ ID NO: 46875 - RNA, 1359 nt, synthetic construct
  misc_feature 1..1359: note = derived and/or modified sequence opt6 from Lesofavumab_HeavyChain
  source 1..1359: mol_type = other RNA
gaagtacaacttgtacaatcaggagcagaagtaaaaaaaccaggagaatcgttaaaaatatcatgtaaagtttctggatattcattcacctcacaatggatcggatgggttagacaaatgccaggcaagggactagaatggattggaatgatgtatccaggagaatcagaaacaatatactcaccatcattccaaggacaagtaacaatatcagcagacaactcaatatcaacagcatacttacaatggtcttctttaaaagcatctgacaccgctatatattattgtgcatcaggccccggatactcaggttaccactacggttggttcgacacatggggacaaggaacactagtaacagtctcctccgcatcaacaaaaggaccctcagtattcccactagcaccctcaagcaaaagcacatcaggtggtacagcagcactaggttgcctagtaaaagattacttccccgaaccagtaacagtttcatggaacagcggagcactaacatcaggagttcacacatttccagcagtcctacaatccagtggcttatactcattatcttcagtagtaacagtaccttcatcctcacttggcactcaaacttacatatgcaacgtaaatcataaaccatcaaatacaaaagtagataaaaaagtagaaccaaaatcatgtgacaaaacacacacatgcccaccatgcccagcacccgaacttctaggcggaccatcagtatttttattcccaccaaaaccaaaagatacattaatgatatcaagaactccagaagtaacatgcgtagtggtagacgtctcacacgaagaccccgaagtaaaattcaattggtacgtagatggagtagaagtacacaacgcaaaaacaaaacctagagaagaacaatacaattcaacatatagagtagtatcagtattaaccgttctacaccaagactggctaaacggaaaagaatataaatgcaaagtatcaaataaagcactacccgcccccattgaaaaaaccatatcaaaagcaaaaggacaaccaagagaacctcaagtatacacactaccaccatccagagaagaaatgacaaaaaatcaagtaagtctaacatgcctagtaaaaggattctacccctcagacatcgctgtagaatgggaatccaatggccaaccagaaaataactacaaaacaacaccaccagtactagattcagacggatcattctttctttactcaaaactaacagtagataaatctagatggcaacaaggcaacgtattttcatgttcagttatgcatgaagcattacataaccactacacacaaaaatccttatctttatcacccggaaaa

SEQ ID NO: 46876 - RNA, 657 nt, synthetic construct
  misc_feature 1..657: note = derived and/or modified sequence opt6 from Lesofavumab_LightChain
  source 1..657: mol_type = other RNA
gacatcgtaatgacccaaagccccctatcactaccagtaaccccaggagaaccagcatcaatatcatgcagaagctcacaatcattactaagatcaaacggatacaactacttagactggtacctacaaaaaccaggacaatcaccccaactactaatatacctaggatcaaacagagcctcaggagttccagacagattttcaggctcaggatcaggcacagacttcacactaaaaatatcaagagtagaagcagaagacgtaggagtatactactgcatgcaagcactacaaacaccatacacattcggacaaggaacaaaactagaaataaaaagaacagtagcagcaccatcagtattcatattcccaccctcagacgaacaactaaaatcaggcacagcatcagtagtatgcctactaaacaacttctacccacgagaagctaaagtacaatggaaagtagacaatgcactacaaagtggaaactcacaagaatcagtaacagaacaagactcaaaagactcaacatattcactatcatccacactaacactatcaaaagcagactacgaaaaacacaaagtatatgcatgcgaagtcacacaccaaggattatcatcaccagtaacaaaatcattcaacagaggagaatgc

SEQ ID NO: 46877 - RNA, 1059 nt, synthetic construct
  misc_feature 1..1059: note = derived and/or modified sequence opt6 from Letolizumab_HeavyChain
  source 1..1059: mol_type = other RNA
gaagtacaactattagaatcaggcggtggattagtacaacccggaggatcactaagactaagctgcgcagcatcaggattcacatttaattgggaattaatgggctgggcaagacaagcacctggaaaaggtctagaatgggtatcaggaatagaaggacctggagatgtaacttattatgcagattcagtaaaaggcaggtttacaatatctagagacaattccaaaaacacactatacctacaaatgaatagtctaagagcagaagacacagcagtatattactgcgttaaagtaggaaaagacgcaaaatcagactacagaggccaaggaactctagtgacagtatcaagcgcatcaacagaaccaaaaagtagcgataaaacccatacatcaccaccatcaccagcaccagagttattaggaggatcaagtgtattcctattcccaccaaaaccaaaagacacactaatgatatcaagaacacccgaagtaacatgcgtagtcgtagatgtaagccatgaagacccagaagtaaaattcaattggtacgtagacggagtagaagtacacaatgcaaaaacaaaaccaagagaagaacaatataactcaacatacagagtagtatcagtattaacagtactacaccaagattggctaaacggaaaagaatataaatgtaaagtcagcaacaaagcattacccgcaccaatagagaaaacaatctcaaaagcaaaaggacaacccagagaaccacaagtatacacattaccaccatcaagagacgaattaactaaaaaccaagtatcactaacatgcctagtcaaaggcttctacccatccgacatagcagtagaatgggaaagtaacggacaaccagaaaacaactataaaacaacaccgccagtcttagacagcgatggatcattcttcctatattctaaattaacagtagataaaagcagatggcaacaaggaaacgttttctcatgcagtgtaatgcacgaagccttacataaccactatacacaaaaatcattaagcctaagcccaggtaaa

SEQ ID NO: 46878 - RNA, 1338 nt, synthetic construct
  misc_feature 1..1338: note = derived and/or modified sequence opt6 from Losatuxizumab_HeavyChain
  source 1..1338: mol_type = other RNA
gaagtacaactacaagaatccggcccaggactagtcaaaccatcacaaaccctaagcctaacctgcacagtatcaggatactcaatttcaagagactttgcttggaactggattaggcaacccccaggaaaaggattagaatggatgggctacatttcatacaatggcaacacaagatatcaaccatctttaaaatcaagaataacaataagtagagatacctcaaaaaatcaattcttcctaaaactaaacagtgtaacagcagcagatacagcaacttactattgcgtaacagcaagcagaggattcccatactggggacaaggaacactagtaacagtttcctcagcatcaacaaaaggaccctccgtattcccactagcaccttcatcaaaatcaacatccggcggaacagccgcgctaggatgtttagttaaagactacttcccagaacccgtaacagtatcatggaactccggcgccctaacaagcggagtacataccttcccagcagtacttcaatcctcaggactttactccctatcatctgtagttacagtaccatcatccagcctaggaactcaaacatacatatgtaacgtaaaccacaaaccatcaaacaccaaagtcgataaaaaagtagaacctaaatcatgcgacaaaacacacacctgcccaccatgtccagcacccgaattattaggcggaccatcagttttcttatttcccccaaaaccaaaagatactctaatgatatccagaacaccagaagtcacatgtgtcgtagtcgacgtatcacatgaagaccccgaagtaaaatttaactggtacgtagacggagtagaagtccacaatgcaaaaacaaaaccacgagaagaacaatacaactcaacataccgcgtagtatcagtactaacagttctacaccaagactggctaaacggcaaagaatacaaatgcaaagtatcaaataaagcattaccagcaccaatagaaaagacaatatcaaaagccaaaggacaaccacgagaacctcaagtctacacactacctccctctagagaagaaatgacaaaaaaccaagtatcactaacctgtctagtaaaaggattttacccatcagacatagcagtagaatgggaatctaacggacaaccagaaaacaattacaaaactacaccaccggtactcgactcagacggatcattcttcctctattccaaactaacagtagacaaaagtcgatggcaacaaggaaatgttttttcttgttcagtaatgcatgaagccttacataaccactacacacaaaaatcattaagcctatccccaggcaaa

SEQ ID NO: 46879 - RNA, 642 nt, synthetic construct
  misc_feature 1..642: note = derived and/or modified sequence opt6 from Losatuxizumab_LightChain
  source 1..642: mol_type = other RNA
gacatacaaatgacacaatcaccatcaagcatgagcgtatcagtaggagaccgagtaacaataacatgccactcaagccaagacataaactcaaacataggatggctacaacaaaaaccaggaaaatcattcaaaggattaatataccacggaacaaacttagacgatggagtaccaagcagattctcaggatcaggatcaggaacagactacaccctaacaataagttcactacaaccagaagacttcgcaacatactactgcgtacaatacgcacaattcccatggacattcggaggaggaacaaaactagaaataaaaagaacagtagcagcaccaagcgtattcatattcccaccatcagacgaacaattaaaatcaggaacagcatcagtagtatgcttattaaacaacttctacccaagagaagcaaaagtacaatggaaagtcgacaacgcactacaatcaggaaactcacaagaatcagtaacagaacaagacagcaaagactcaacatactcattaagctcaacactaacactaagcaaagccgactacgaaaaacacaaagtatatgcatgcgaagtcacacaccaaggattaagctctcccgtaacaaaatcattcaacagaggcgaatgc

SEQ ID NO: 46880 - RNA, 1338 nt, synthetic construct
  misc_feature 1..1338: note = derived and/or modified sequence opt6 from Lupartumab_HeavyChain
  source 1..1338: mol_type = other RNA
gaagtacaattattagaatccggcggaggactcgtacaacctggtggcagcttaagattatcatgtgcagcatcaggtttcacattttcaaacgcttggatgtcttgggtaagacaagcaccaggaaaaggcctagaatgggtatcctacatatcatcatctggatcaaccatatactatgccgactcagtaaaaggaagatttacaatatcacgagataacagcaaaaatactttatacctccaaatgaattcccttagagctgaagacacagcagtatactactgcgcacgagaaggactctgggcatttgattactggggacaaggaacattagtcactgtatcatcagcaagcacaaaaggcccatcagtctttcctctagcaccatcatctaaatcaacatctggaggcacagcagccttaggatgtttagtaaaagattactttccagaaccagtaaccgtttcctggaactcaggagcattaacatcaggagtacacaccttcccagcagtccttcaatcaagtggcttatattcactatcatctgtagtaaccgtaccatcatcaagtctaggcacacaaacatacatatgtaacgtcaatcataaaccatccaacacaaaagtagataaaaaagtagaaccaaaatcttgtgacaaaacacatacatgtcctccatgcccagcaccagaattactcggtggtccatcagtattcctgttcccaccaaaaccaaaagacacactaatgattagcagaacaccagaagtcacctgcgtcgtcgtagatgtatcacacgaagaccccgaagtaaaattcaactggtacgtagacggagttgaagttcacaacgcaaaaacaaaaccaagagaagaacaatataatagtacataccgagtagtatccgtgctaacagtactacatcaagactggcttaacggaaaagaatacaaatgtaaagtcagcaataaagcattaccagcacccatagaaaaaactatatctaaagccaaaggacaaccaagagaacctcaagtatatacactaccaccctcaagagatgaattaactaagaaccaagtatcactaacatgcttagttaaaggattttacccatcagatatagctgtagaatgggaatcaaacggacaacctgaaaataactacaaaaccacaccacccgtcctagattcagacggaagcttctttctttattcaaaattaacagtagataaatctagatggcaacaaggaaacgtattcagttgctctgtcatgcacgaagcacttcacaaccactacacccaaaaatcattatctctatcaccagga

SEQ ID NO: 46881 - RNA, 651 nt, synthetic construct
  misc_feature 1..651: note = derived and/or modified sequence opt6 from Lupartumab_LightChain
  source 1..651: mol_type = other RNA
gaatcagtactaacacaaccaccatcagtatcaggagcaccaggtcaaagagtaacaatatcatgcacaggatcatcctcaaatataggagcaggatacgtagtacactggtaccaacaattacctggaacagccccaaaattactaatctatgacaacaacaaaagaccatcaggagtaccagacagattctcaggatcaaaatcaggaacctcagcatcattagcaatatcaggattaagatcagaagacgaagcagactactactgcgcagcatgggacgacagactaaatggaccagtattcggaggaggaacaaaactaacagtcctaggacaaccaaaagccgcaccatcagtaaccctattcccaccatcatcagaagaattacaagccaataaagcaacactagtttgcctaatatcagacttctacccaggagcagtaacagtagcatggaaagcagactcaagcccagtaaaagcaggagtagaaacaacaacaccatcaaaacaatcaaacaacaaatacgccgcaagctcatacctatcactaactccagaacaatggaaatcacacagatcatactcatgccaagtaacacacgaaggatcaacagtagaaaaaacagtagcaccaacagaatgctcc

SEQ ID NO: 46882 - RNA, 1731 nt, synthetic construct
  misc_feature 1..1731: note = derived and/or modified sequence opt6 from Lutikizumab_HeavyChain
  source 1..1731: mol_type = other RNA
gaagtacaattagtagaaagtggaggaggagtagtacaaccaggtagaagcctaagattatcatgttctgcaagcggatttatttttagtagatatgacatgagctgggtaagacaagcacctggtaaaggactagaatgggttgcatacatttcacacggaggggcaggtacttactatcccgacagtgtaaaaggaagatttaccataagtcgagataatagtaaaaatacattgtttttacaaatggactcactacgacctgaagatacaggagtatatttttgcgcaagaggcggtgtgacaaaaggatattttgatgtatggggacaaggaaccccagtcactgtaagtagcgcaagtaccaaaggtccccaagtacaattagtagaatcgggaggaggagtagtacaaccaggaagatctttaaggctaagctgcacagcaagcgggtttacattttctatgtttggagtacactgggttagacaagcacctggtaaaggattagaatgggtagcagcagtatcatatgatggatctaataaatattacgcagaaagtgtaaaaggccgattcacaattagcagagataattccaaaaatatattatttttacaaatggattcactaagactcgaagatacagcagtatattactgtgccagaggtagaccgaaagttgtaatcccagcacctctagcacactggggccaaggaacattagtaactttttcaagcgcatcaaccaaaggaccatcagtatttccacttgcaccaagctccaaatctacaagtggtggaacagcagcattaggatgtctagtgaaagattatttcccagaaccagttacagttagttggaacagcggagctcttacatcaggggtacatacatttcctgcagtattacaatcatccggattatactcattaagttcagtagtaaccgtaccgagttcatctttaggaacacaaacatacatatgtaatgtaaatcacaaaccatcaaatactaaagtagataagaaagtagaaccgaaaagctgtgacaaaactcatacctgtccaccttgtcctgcaccagaagcagcaggcggaccatccgtatttttgtttcctccaaaaccaaaagacacattaatgatatcacgaactccagaagtaacatgcgttgtagtagacgtaagccatgaagacccagaagtaaaatttaattggtacgtagatggtgtagaagtgcataacgccaagacaaaaccaagagaagaacaatacaattcaacatatcgagtcgtatcagtactaaccgttctacatcaagattggctaaatggaaaagaatataaatgtaaagtatcaaacaaagcattaccagcccctatagagaaaactatatctaaagctaaaggacaacctagagaacctcaagtatatactttaccaccatcacgagaagaaatgactaaaaaccaagtatcactaacatgcctagtaaaaggtttttacccaagtgatatagcagtagaatgggaatcaaacggtcaacccgaaaataattataaaacaacaccaccagtattagatagtgatggatcattctttctttattcaaaattaacagtagataaaagccgatggcaacaaggaaatgtcttttcatgcagtgtaatgcatgaagcactacacaatcattatacacaaaaatcattatcattaagtccaggaaaa

SEQ ID NO: 46883 - RNA, 981 nt, synthetic construct
  misc_feature 1..981: note = derived and/or modified sequence opt6 from Lutikizumab_LightChain
  source 1..981: mol_type = other RNA
gacatacaaatgacacaaagtccatcatcattatcagcatcagtcggagatagagttacaatcacatgcagagcatcaggaaatatacataactacttaacatggtaccaacaaacaccaggcaaagcaccaaaattactaatatataacgccaaaacattagcagacggagtaccatcaagattctctggctcaggatcaggtacagactacaccttcactatatcctcattacaaccagaagacatagcaacatactactgccaacacttctggtccataccatacacattcggacaaggaaccaaactacaaataacaagaacagtagcagccccagatatacaaatgacacaatcaccatcatctgtatctgcaagtgtaggcgacagagtaactataacatgccgagcatcacaaggaatatcatcatggctcgcatggtaccaacaaaaaccaggaaaagcaccaaaactactaatttacgaagcatcaaacttagaaaccggtgttccatcaagattttcaggatccggatccggatctgactttacactaaccatatcttccctccaaccagaagatttcgccacatactattgccaacaaacatcctcattcctactatccttcggaggaggtacaaaagtcgaacacaaacgcacagtagcagcaccatcagtattcatattcccaccatctgatgaacaactcaaatcaggcacagcatcagtagtatgtctactaaataacttttatccaagagaagccaaagtacaatggaaagttgacaacgcactacaaagcggaaactcacaagaatcagtaacagaacaagattccaaagactctacttattccctatcttcaacattaacattatcaaaagcagactacgaaaaacacaaagtatacgcatgtgaagttacacatcaaggactatcctctccagtaaccaaatcatttaacagaggcgaatgc

SEQ ID NO: 46884 - RNA, 1341 nt, synthetic construct
  misc_feature 1..1341: note = derived and/or modified sequence opt6 from Oleclumab_HeavyChain
  source 1..1341: mol_type = other RNA
gaagtacaattactagaatcaggaggaggactagtacaaccaggaggttccttaagattatcatgcgcagcatctggcttcactttctcatcttacgcctattcttgggtaagacaagctcccggcaaaggacttgaatgggtatcagccatatcaggatcaggaggaagaacatactatgctgacagtgtaaaaggaagatttacaatatcaagagacaattccaaaaacacactctatttacaaatgaattctctaagagcagaagatacagcagtatattattgtgcacgactaggttacggaagagtagatgaatggggaagaggaactttagtaaccgttagctcagcatcaacaaaaggtccatctgtctttcccttagcaccatcatcaaaaagtacttcaggcggaaccgcagcactaggatgcttagtaaaagattactttccagaaccagtaacagtatcatggaactcaggagcattaacttcaggagtacatacctttccagctgtgctacaatcatcaggtctatattcactatctagtgttgtaaccgtaccctcatcatcattaggaactcaaacatatatatgcaatgtcaatcacaaaccgtctaacaccaaagttgataaaagagtagaacctaaatcatgtgacaaaacccatacatgtccaccatgccctgcaccagaatttgaaggtggaccttcagtattccttttcccaccaaaacctaaagatacattaatgatatcaagaaccccagaagtaacttgtgtagttgttgacgtaagccatgaagatccagaagtaaaattcaattggtatgtagatggcgtagaagtacacaatgcaaaaactaaaccaagagaagaacaatacaactcaacatacagagtagtatcagtacttacagttcttcatcaagattggttaaacggaaaagaatacaaatgtaaagtatcaaacaaagctctacctgcatccatagaaaaaacaatatcaaaagcaaaaggacaaccaagagaacctcaagtatataccctaccaccatcaagagaagaaatgacaaaaaaccaagtcagcctaacatgcctggtcaaaggattttacccgtcagacatagcagtagaatgggaatcaaatggacaacccgaaaataattacaaaactactccacccgtcttagactcagacggatcattctttctctactctaaactaacagttgataaatcacgctggcaacagggaaacgtattctcatgttctgtcatgcacgaagcattacacaaccattatacacaaaaatcactatcactttcaccaggaaaa

SEQ ID NO: 46885 - RNA, 648 nt, synthetic construct
  misc_feature 1..648: note = derived and/or modified sequence opt6 from Oleclumab_LightChain
  source 1..648: mol_type = other RNA
caatcagttttaacacaaccaccatcagcctcaggaacacctggacaaagagtcacaatatcatgctcaggatcattatcaaacataggaagaaaccccgtaaactggtaccaacaactaccaggaacagcaccaaaactactaatatacttagacaatctaagactatccggcgtcccagacagattttcaggatcaaaatcaggaacatctgcatctctagcaatatcaggactacaatctgaagacgaagcagactactactgcgcaacatgggacgactcacatccaggatggacattcggaggaggaacaaaactaacagtattaggacaaccaaaagcagcaccctcagtaacactattcccaccatcttcagaagaactacaagcaaacaaagcaacactagtatgcttaatatcagacttctacccaggagcagtaacagtagcttggaaagcagactcctcaccagtaaaagcaggcgtagaaacaaccacaccatcaaaacaatcaaacaacaaatatgcagccagctcatacctatcactaacaccagaacaatggaaatcacacagatcatactcatgccaagtaacacacgaaggatccacagtagaaaaaacagtagcaccaacagaatgctca

SEQ ID NO: 46886 - RNA, 1449 nt, synthetic construct
  misc_feature 1..1449: note = derived and/or modified sequence opt6 from Otlertuzumab_HeavyChain
  source 1..1449: mol_type = other RNA
gaagtacaattggtacaaagtggagcagaagtcaagaaaccaggtgaatcactaaaaatcagttgtaaaggaagtggatactcctttacaggttataatatgaattgggtaagacaaatgcccggaaaaggattagaatggatgggaaatatcgacccctattatggaggaactacttacaatagaaaatttaaaggacaagtaacaataagtgcggataaaagtataagtacagcatatttacaatggtcatctctaaaagcatctgatacagcgatgtattattgcgcaagaagtgtaggaccattcgatagttggggacaaggaactctagtgacagtaagcagcggaggaggaggaagtggaggaggaggatcaggtggaggaggaagtggaggaggcggatcaggaggtggaggatcagaaattgtccttacacaatcaccagcaacattatcattaagtccaggagaaagggccacattatcatgtagggcatccgaaaatgtatattcatatctagcatggtatcagcaaaaaccaggacaagcaccgagacttttaatatattttgcaaaaacattagcagaagggataccagcaagatttagtggatcaggaagtggaacagattttacacttacaattagctcactcgaaccagaagattttgcagtatactattgccaacatcactcagataacccttggacatttggacaaggaacaaaagtagaaatcaaaggagatcaagaaccaaaatcatcggataaaacgcatacgtcaccaccatgtccagcaccagaactattaggtggaccttcagtattcttattcccaccaaaacccaaagatacattaatgatatcaagaacaccagaagtaacgtgtgttgtcgtcgatgtcagccatgaagatcctgaagtaaaatttaattggtatgtagatggtgtagaagtacataatgcaaagaccaaaccaagagaagaacaatataattcaacatatagagtagtctcagtattaacagtactacatcaagactggttgaatggaaaagaatacaaatgtaaagtaagtaataaagcattacctgcacctatagagaaaacaataagcaaagctaaaggacaaccaagagaaccacaagtatacacattaccaccaagtagggatgaattaactaaaaaccaagttagtttaacatgcctagttaaaggattctatccaagcgatattgcagtagaatgggaaagcaatggacaaccagaaaataattataaaacaactccaccagtattagacagcgatggcagcttctttttatacagcaaactaacagtagataaaagtagatggcaacaaggaaatgtattttcatgctcagtaatgcatgaagcattacataaccattatacacaaaaatcactaagtttatcaccaggaaaa

SEQ ID NO: 46887 - RNA, 339 nt, synthetic construct
  misc_feature 1..339: note = derived and/or modified sequence opt6 from Ozoralizumab_HeavyChain
  source 1..339: mol_type = other RNA
gaagtacaattagtagaaagcggaggaggattagtacaaccaggaggaagcttaagattaagctgtgcagcaagcggattcacattcagtgactattggatgtactgggtaagacaagcaccaggaaaaggattagaatgggtaagcgaaataaatacaaatggactaataacaaaatatccagatagtgtaaaaggaagatttacaataagcagagacaatgcaaaaaacacattatatttacaaatgaatagcttaagaccagaagatacagcagtatattactgtgcaagaagcccaagcggattcaatagaggacaaggaacattagtaacagta

SEQ ID NO: 46888 - RNA, 1089 nt, synthetic construct
  misc_feature 1..1089: note = derived and/or modified sequence opt6 from Ozoralizumab_HeavyChain_HeavyChain_HeavyChain
  source 1..1089: mol_type = other RNA
gaagtacaattagtagaaagcggaggaggtctagtacaaccaggaggaagtttaagacttagctgtgcagcttcaggatttacattttcagattattggatgtattgggtaaggcaagcaccaggaaaaggactagaatgggtaagcgaaataaatacaaatggactaataactaaatacccagatagcgtgaaaggaagatttacaatatctagagacaatgctaaaaatacattatatctacaaatgaatagtttacgacctgaagacacagcagtatattattgtgcaagatcaccatcaggttttaatagaggacaaggaacattagtaactgtaagttcaggaggaggaggaagtggaggaggaagtgaagtacaattagtagaatcagggggagggctagtacaacctggaaatagtttaagattaagttgtgcagcttcgggttttacatttagtagttttggaatgtcgtgggttagacaagcaccaggaaaaggtctagaatgggtaagctcaataagtggtagtggaagtgatacactatatgcagatagtgtaaaaggaagatttacaataagcagagataatgcaaaaacaacattatacttacaaatgaatagtttaaggccagaagataccgcagtatactactgtacaataggaggatctcttagtagatcatcacaaggtacattagtaacagtaagctcaggaggaggagggtccggaggaggaagtgaggtacaattagtagaaagtggaggaggattggtacaaccaggaggaagcctaagactatcttgtgcagcttcaggatttacatttagtgattattggatgtattgggtaagacaagcaccaggaaaaggactagaatgggtgagtgaaataaatacaaatggattaataacaaaatatccagattcagttaaaggaagatttacaataagtagagacaatgccaaaaatacattatatttacaaatgaactcattacgaccagaagatacagctgtatattattgtgcgagatcaccatccggatttaataggggtcaaggtacattagttacagtaagtagt

SEQ ID NO: 46889 - RNA, 1494 nt, synthetic construct
  misc_feature 1..1494: note = derived and/or modified sequence opt6 from Pasotuxizumab_HeavyChain_LightChain_HeavyChain_LightChain
  source 1..1494: mol_type = other RNA
caagtacaattggtagaaagtgggggaggattagtaaaaccaggagaaagtttaagattatcttgtgcagctagtgggtttacatttagtgattattatatgtattgggtgagacaagcaccaggaaaaggactagaatgggtagcaataatatcagatggaggatattatacatattattcagatataataaaaggtcgatttacaataagtagggacaatgcgaaaaatagtctgtatttacaaatgaatagtctaaaagcagaagacactgctgtatattattgcgcaagaggatttccgcttctaaggcatggagcgatggactattggggacaaggaacgttggtaacagttagtagtggaggaggaggatcaggaggaggaggcagtggtggcgggggtagtgatatacaaatgacacaatctcctagtagtctaagtgctagtgtaggagatagggtaacaataacatgtaaagcatctcaaaatgtagatacaaatgttgcatggtaccaacaaaaaccaggacaagccccaaagagtttaatatatagtgcatcatataggtacagtgacgttccaagcagatttagcggaagcgcaagtggaactgattttactttaacaataagcagtgtacagagcgaagattttgctacatactattgtcaacaatatgattcatatccatacacgtttggaggaggaacaaaactagaaataaaaagtggcggaggaggaagtgaagtccaattagtagaaagtggaggaggtttagtacaacccggaggatctttgaaattgagctgtgctgcaagcggatttacatttaataaatatgcaatgaattgggtaagacaagcaccaggtaaaggattagaatgggtagcaagaatacgaagcaaatataataactacgcaacgtattatgcagatagtgtaaaagatagatttacgattagcagagacgatagtaaaaatacagcatatttacaaatgaataatttaaaaacagaggatacggctgtatattactgtgtaagacatggaaattttggaaattcatacataagctattgggcatattggggacaggggactttagtaactgtatcaagcggaggaggagggagtggaggaggaggaagtggaggaggaggaagtcaaacagtggtaacacaagaaccaagtttaacagtatcaccaggaggaacagtaacattaacatgtggaagtagtacaggggcagtaacttcaggaaattatcccaattgggtacaacaaaagccaggacaagcaccaagaggacttatagggggaacaaaatttttagctccaggaacaccagctaggtttagtggatcattattaggtgggaaagcagcattaacattatcaggagtacaaccagaagacgaagcagaatattattgtgtactatggtatagtaatagatgggtgtttggaggaggtacaaaattaacagtatta

SEQ ID NO: 46890 - RNA, 357 nt, synthetic construct
  misc_feature 1..357: note = derived and/or modified sequence opt6 from Pasotuxizumab_HeavyChain1
  source 1..357: mol_type = other RNA
caagtacaattagtagaaagtggaggaggattagtaaaaccaggagaaagtttaagattaagttgtgcagcaagtggatttacatttagtgattattatatgtattgggtaagacaagcaccaggaaaaggattagaatgggtagcaataataagtgatggaggatattatacatattatagtgatataataaaaggaagatttacaataagtcgagataatgcaaaaaatagtttatatttacaaatgaatagtctaaaagcagaagatacagcagtatattattgtgcaagaggatttccattattaagacatggagcaatggattattggggacaaggaacattagtgacagta

SEQ ID NO: 46891 - RNA, 369 nt, synthetic construct
  misc_feature 1..369: note = derived and/or modified sequence opt6 from Pasotuxizumab_HeavyChain2
  source 1..369: mol_type = other RNA
gaagtacaactagtagaatcaggaggaggattagtacaaccaggaggatcactaaaactatcgtgcgcagcatcaggatttacatttaacaaatacgcaatgaattgggtaagacaagcaccaggaaaaggactagaatgggtagcaagaataagatcgaaatataacaattacgcaacatattacgcagactcagtaaaagacagattcacaatatcaagagatgactcaaaaaatacagcatacttacaaatgaacaatctaaaaacagaagacacagcagtatactattgcgtaagacatggaaatttcggaaactcatacataagctattgggcatactggggacaaggaacactagtaacagta

SEQ ID NO: 46892 - RNA, 321 nt, synthetic construct
  misc_feature 1..321: note = derived and/or modified sequence opt6 from Pasotuxizumab_LightChain1
  source 1..321: mol_type = other RNA
gacatacaaatgacacaatcaccatcatcactatcagcatcagtaggagacagagtaacaataacatgcaaagcatcacaaaacgtagacacaaacgtagcatggtaccaacaaaaaccaggccaagcaccaaaatcactaatatactcagcatcatacagatactcagacgtaccatcaagattctcaggatcagcatcaggaacagacttcacactaacaatatcatcagtacaatcagaagacttcgcaacatactactgccaacaatacgactcatacccatacacattcggaggaggaacaaaactagaaataaaa

SEQ ID NO: 46893 - RNA, 327 nt, synthetic construct
  misc_feature 1..327: note = derived and/or modified sequence opt6 from Pasotuxizumab_LightChain2
  source 1..327: mol_type = other RNA
caaacagtagtaacacaagaaccatcattaacagtatcaccaggaggaacagtaacattaacatgtggatcatcaacaggagcagtaacatcaggaaactatccaaattgggtacaacaaaaaccaggacaagcaccaagaggattaataggaggaacaaaattcttagcaccaggaacaccagcaagattttcaggatcattactaggaggaaaagcagcactaacactatcaggagtacaaccagaagatgaagcagaatattactgtgtattatggtattcaaatagatgggtatttggaggaggaacaaaattaacagtacta

SEQ ID NO: 46894 - RNA, 1023 nt, synthetic construct
  misc_feature 1..1023: note = derived and/or modified sequence opt6 from Placulumab_HeavyChain
  source 1..1023: mol_type = other RNA
gacatacaaatgacacaatcaccatcatcactctcagcatcagtaggagacagagtcacaataacatgtagagcatctcaagccatagactcatacctgcactggtaccaacaaaaaccaggcaaagcaccaaaactcctaatctattcagcatcaaacttagaaaccggcgttccatcaagattttcaggatccggctcaggcacagactttacattaaccatatcatcactattaccagaagactttgccacatactactgtcaacaagtagtctggcgcccatttacattcggccaaggcacaaaagtagaaataaaacgcgtagaaccaaaatcatccgacaaaacacacacatgcccaccctgcccagcaccagaactattaggaggaccatcagtatttttattcccaccaaaaccaaaagacacattaatgatatcaagaacaccagaagttacatgcgtagtagtagacgtctctcacgaagacccagaagtcaaattcaattggtatgttgacggagtagaagtccataacgcaaaaacaaaaccaagagaagaacaatacaattcaacctacagagtagtctcagtattaacagtcttacaccaagactggttaaacggaaaagaatacaaatgcaaagtatcaaacaaagcactacccgcaccaatagagaaaacaatatccaaagcaaaaggacaaccacgagaaccacaagtatacacattaccaccatcaagagacgaactcaccaaaaaccaagtatcattaacatgcttagtaaaaggcttttatccctcagacattgcagtagaatgggaatccaatggacaaccagaaaacaactataaaacaacaccacctgtactcgactcagacggatcattctttttatattccaaattaaccgttgacaaatcaagatggcaacaaggaaacgtattttcatgctcagtaatgcacgaagcactacataaccactacacacaaaaatccctatcattatcaccaggaaaa

SEQ ID NO: 46895 - RNA, 1353 nt, synthetic construct
  misc_feature 1..1353: note = derived and/or modified sequence opt6 from Porgaviximab_HeavyChain
  source 1..1353: mol_type = other RNA
gaagtacaactacaagaatccggaggaggtctaatgcaaccaggaggatcaatgaaactatcatgcgtagcatctggattcacattctcaaactactggatgaactgggtacgacaatcacccgaaaaaggattagaatgggtagcagaaataagattaaaatcaaacaactacgcaacccactatgcagaatccgtcaaaggaagattcacaataagtcgtgacgactccaaaagatcagtatacctacaaatgaataccttaagagcagaagacactggaatatattactgcacaagaggaaatggaaactatagagcaatggactactggggacaaggaacaagtgtaacagtaagtagtgcctcgacaaaaggaccatcagtatttccactagcaccatcttcaaaaagtacatcaggaggaacggcagcattaggctgtttagtaaaagactacttcccagaaccagtaactgtttcatggaacagtggcgcactaacctcaggagtacacacattcccagcagtcttacaaagctcaggcttatattccctttcatcagtcgtcacagttccatcatcttcactaggaacacaaacatacatatgcaacgtaaatcacaaaccatcgaacacaaaagtagataaacgcgtagaaccaaaatcatgcgataaaacacatacctgcccaccatgcccagctccagaactactaggcggaccatcagtatttttattccccccaaaaccaaaagacacactaatgataagcagaacgccagaagtaacatgcgtagtagtagacgtatcacatgaagacccagaagtaaaatttaactggtatgtagacggcgtcgaagttcataatgccaaaacaaaaccaagagaagaacaatacaactcaacctacagagtagtatctgtattaacagtcctacaccaagactggttaaatggaaaagaatacaaatgtaaagtaagtaacaaagcattaccagcacctatagaaaaaacaatatcaaaagcaaaaggtcaaccaagagaaccccaagtatatacactaccaccatcacgagatgaactaacaaaaaaccaagtaagtctaacttgtcttgtaaaaggcttctatccttcagatatagcagtagaatgggaatcaaatggccaacctgaaaacaactacaaaacaacaccaccagtactagacagtgatggatctttctttttatactccaaattaacagtagacaaatcaagatggcaacaaggaaacgtattcagttgcagcgtaatgcacgaagcattacataaccattatacacaaaaatcattatcactctcaccaggtaaa

SEQ ID NO: 46896 - RNA, 642 nt, synthetic construct
  misc_feature 1..642: note = derived and/or modified sequence opt6 from Porgaviximab_LightChain
  source 1..642: mol_type = other RNA
gatatacaaatgacgcaatcaccagcatcattaagcgtaagtgtaggagaaacagtaagcataacatgtagagctagcgaaaacatttacagctcattagcatggtaccaacaaaaacaaggaaaatcaccacaactattagtatatagcgcaacaatattagcagacggagtaccaagcaggttctcaggatcaggatcaggaacacaatattcattaaaaataaactcactacaatcagaagactttggaacatactattgccaacacttttggggaacaccatacacattcggaggaggaacaaaactagaaataaaaagaacagtagcagcaccaagcgtattcatattcccaccatcagacgaacaattaaaatcaggaacagcatcagtcgtttgcttactaaataacttttatccaagagaagcaaaagtccaatggaaagtagataacgcactccaaagcggaaactcacaagaatcagtgacagaacaagatagtaaagactcaacatatagtctatcatcaacattaacattaagcaaagcagattacgaaaaacataaagtatacgcatgcgaagtcacacaccaaggattaagctcaccagtaacaaaatcatttaacagaggagaatgc

SEQ ID NO: 46897 - RNA, 1341 nt, synthetic construct
  misc_feature 1..1341: note = derived and/or modified sequence opt6 from Prezalumab_HeavyChain
  source 1..1341: mol_type = other RNA
gaagtacaattagtcgaatcaggaggcggactagtgcaaccaggaggatcacttcgcctttcatgtgcagcatccggattcacattctcaagttattggatgtcatgggttagacaagcaccaggaaaaggacttgaatgggtagcatacatcaaacaagatggaaacgaaaaatattatgtcgattctgtcaaaggaagattcacaatcagccgagataacgcaaaaaactctctataccttcaaatgaattcattacgagcagaagatacagctgtatattattgtgcaagagaaggaatattatggtttggagatttacctacattttggggacaaggaacattagtaactgtatcatctgcatctacaaaaggaccatctgtatttcccctagcaccttgctctagatcaacctcagaaagcactgcagcactaggttgtctagtaaaagactattttccagaacccgtaacagtatcatggaactctggtgctttaacatcaggagtccatacatttccagcagtactacaaagttccggactatattcactatcatcagtagtaacagtaccttcatcaaatttcggtacgcaaacatatacatgtaatgtagaccataaaccttcaaatacaaaagtagataaaacagtagaaagaaaatgctgtgtagaatgccccccatgcccagcaccaccagtagcaggcccatcagtattcttattcccacccaaaccaaaagacacattaatgatctcacgcaccccagaagtaacctgcgttgtcgttgacgtaagccacgaagacccagaagtacaattcaactggtatgtagacggagttgaagttcacaatgcaaaaactaaaccaagagaagaacaatttaattccacattcagagtcgtaagtgtactaacagttgtacaccaagactggttaaacggaaaagaatacaaatgcaaagtaagtaataaaggattaccagcaccaattgaaaaaacaatatctaaaaccaaaggacaacctagagaaccacaagtatacacactaccaccatcacgagaagaaatgacaaaaaaccaagtatcattaacatgtcttgtaaaaggattttacccatccgacatagcagtcgaatgggaatctaacggacaaccagaaaataattacaaaactactccaccaatgttagactcagacggatcattttttctatactcaaaattaacagtagacaaaagcagatggcaacaaggaaatgtattctcatgctcagtaatgcacgaagcactacacaatcactatacccaaaaatcattatcactcagtcccggaaaa

SEQ ID NO: 46898 - RNA, 642 nt, synthetic construct
  misc_feature 1..642: note = derived and/or modified sequence opt6 from Prezalumab_LightChain
  source 1..642: mol_type = other RNA
gacatacaaatgacacaaagcccatcaagcctaagcgcatcagtaggagacagagtaacaataacctgcagagcatcacaaggaatatcaaactggctagcatggtaccaacaaaaaccagaaaaagcaccaaaatcattaatatacgcagcatcatcactacaaagcggagtcccaagcagattctcaggatcaggatcaggaacagacttcacactaacaatatcatcattacaaccagaagactttgctacatattactgccaacaatacgactcataccctcgcacattcggacaaggaacaaaagtagaaataaaaagaacagtagcagcaccaagtgtattcatattcccaccctcagacgaacaactaaaatcaggaacagcatcagtagtatgcttactaaacaacttctacccaagagaagccaaagtacaatggaaagtcgacaacgcattacaatcaggcaactcacaagaatcagtaacagaacaagacagcaaagactcaacatactcactaagctcaacactaacactaagcaaagcagactacgaaaaacacaaagtatacgcatgcgaagtaacacaccaaggactaagctcaccagtaacaaaatcattcaatcgaggagaatgc

SEQ ID NO: 46899 - RNA, 342 nt, synthetic construct
  misc_feature 1..342: note = derived and/or modified sequence opt6 from Radretumab_HeavyChain
  source 1..342: mol_type = other RNA
gaagtacaactactagaaagcggaggaggattagtgcaaccaggaggatcattaagattaagctgtgccgcaagcggattcacattcagcagctttagtatgagctgggtaagacaagcaccaggaaaaggactagaatgggtaagctcaatatcaggatcaagcggaacaacatactatgcagatagcgtaaaaggaagatttacaataagcagagacaatagcaaaaacacactatatctacaaatgaatagcttaagagcagaagatacagcagtatattactgtgcaaaaccatttccatatttcgattactggggacaaggaacattagtaacagta

SEQ ID NO: 46900 - RNA, 1071 nt, synthetic construct
  misc_feature 1..1071: note = derived and/or modified sequence opt6 from Radretumab_HeavyChain_LightChain
  source 1..1071: mol_type = other RNA
gaagttcaactattagaatcaggtggaggattagtacaaccaggaggaagtttaagattatcatgtgcagcttcaggatttacattctcaagtttttcaatgagttgggtaagacaagcaccaggaaaaggattagaatgggtaagctcaatatcaggaagctcaggaacaacatactatgctgattcagtaaaaggaagatttactatatcaagagataatagtaaaaatacactttatttacaaatgaactcattaagagcagaagatacagcagtatattattgtgcaaaaccattcccctactttgactactggggtcaaggaacattagtaacagtatcatcaggagatggaagttcaggaggtagtggaggagcaagtgaaatagtactaacacaatcaccaggaacattatcactaagtccaggagaaagagcaacactatcatgtagagctagtcaatctgtatcatcaagtttcctagcatggtatcaacaaaaaccaggccaagcaccaagattattaatatattacgcatcatcaagagccacaggaataccagatagatttagcggaagtggaagtggaacagattttacactaacaatctcaagactagaaccagaagattttgcagtatattattgtcaacaaacaggaagaataccaccaacatttggacaaggcacaaaagtagaaattaaatcaggaggatcaggaggaccaagagctgcaccagaagtatatgcattcgcaacaccagaatggcctggatcaagagataaaagaacattagcatgtttaatacaaaatttcatgccagaggatataagtgtacaatggttacacaatgaagtacaattaccagatgcgagacattcaacaactcaacctagaaaaacaaaaggtagcggattctttgtttttagtcgactagaagtaacaagagcagaatgggaacaaaaagatgaatttatatgtagagcagtacatgaagcagcatcaccatcacaaactgttcagagagcagtttcagtaaatccagaaagcagtcgaagaggtggctgt

SEQ ID NO: 46901 - RNA, 693 nt, synthetic construct
  misc_feature 1..693: note = derived and/or modified sequence opt6 from Radretumab_LightChain
  source 1..693: mol_type = other RNA
gcatcagaaatagtattaacacaatcaccaggaacattatcactatcaccaggagaaagagcaacactatcttgtcgagcatcacaatcagtaagttcatcatttttagcatggtatcaacaaaaaccaggacaagcccctagattactaatatactatgcatcatcaagagcaacaggcataccagatagattctcaggaagcggatcaggaacagatttcacattaacaatatctagattagaaccagaagatttcgcagtatactactgtcaacaaacaggaagaataccaccaacatttggacaaggaacaaaagtagaaattaaatcaggaggatcaggaggaccaagagcagcaccagaagtatacgcgttcgcaacaccagaatggccaggatcaagagataaaagaactctagcatgcctaatacaaaactttatgccagaagatatatcagtacaatggttacacaatgaagtacaactaccagacgcaagacactccacaacacaaccaagaaaaacaaaaggctctggattctttgtattctcacgattagaagtaacaagagcagaatgggaacaaaaagacgaatttatatgcagagctgtacacgaagcagcatcaccatcccaaacagtacaaagagcagtaagtgtaaacccagaatcatcaagaagaggcggatgt

SEQ ID NO: 46902 - RNA, 1359 nt, synthetic construct
  misc_feature 1..1359: note = derived and/or modified sequence opt6 from Ranevetmab_HeavyChain1
  source 1..1359: mol_type = other RNA
gaagttcaattagtagaatcaggaggaggattagttcaaccaggaggatcattaagattaagctgcgtcgcaagcggtttctcattaacaaataataatgtaaactgggtaagacaagcaccaggaaaaggactcgaatgggtaggaggtgtttgggccggaggagcaactgactacaatagtgcactaaaaagtagattcaccatatctagagataacgctaaaaatacagttttcctacaaatgcactcattaagaagcgaagatacagcagtgtactactgcgcaagagatggaggatactcaagctccacactatatgcaatggatgcatggggacaaggaacttcagtaacagtaagttctgcttcaactactgccccatcagtatttccattagctccatcttgcggatcaacatcaggaagtactgttgcattagcttgcttagtatccggatatttcccagaaccagtaaccgtatcatggaactcaggatcacttacatcaggagtacacacatttccaagcgttctacaatcatcaggacttcattcattaagtagtatggtaacagtacctagctcacgatggccatcagaaacattcacatgcaatgtagtacatcctgcatcaaatacaaaagtagataaaccagtattcaatgaatgtagatgcaccgatacaccaccatgtccagtacccgaacccttaggtggaccatccgtcttaatttttcctcccaaacccaaagatatactacgcatcaccagaacacccgaagtaacttgtgtcgttttagatctaggtagagaagacccagaagtacaaataagctggttcgtagacggtaaagaagtcataacagcaaaaactcaatcaagagaacaacaattcaacggaacatatcaagtagtatccgtattaccaattgaacaccaagactggctaacaggtaaagaatttaaatgcagagtaaaccatatagatttaccatcaccaatagaaagaacaattagcaaagcaagaggcagagcacacaaaccatcggtctatgtacttcccccatccccaaaagaactctcatcatcagacacggtaagtatcacatgtctaatcaaagacttctacccaccagatatagacgtagaatggcaatcagtaggacaacaagaacctgaacgcaaacatagaatgacaccaccacaattagacgaagatggaagctacttcttgtactctaaattatcagttgacaaaagtagatggcaacaaggcgatcctttcacatgtgcagtcatgcatgaaacactacaaaatcattatactgacttatcattatcacactcaccaggaaaa

SEQ ID NO: 46903 - RNA, 1359 nt, synthetic construct
  misc_feature 1..1359: note = derived and/or modified sequence opt6 from Ranevetmab_HeavyChain2
  source 1..1359: mol_type = other RNA
gaagtacaacttgttgaatcaggaggaggattagtacaaccaggaggaagtttaagactatcatgcgttgcttccggattctcactaactaacaataatgtaaactgggttagacaagcaccaggaaaaggattagaatgggttggaggagtatgggctggaggcgcaaccgattataattcagcattaaaaagtagattcacaatttcaagagacaacgctaaaaataccgtttttctacaaatgcattctctaagatctgaagacacagcagtatactattgcgcaagagatggaggatactcaagctcaacattgtacgcaatggacgcatggggacaaggaacatcagtaacagtaagttcagcatcaaccaccgcaccctctgtattccccctagcaccttcttgcggatcaacttcaggtagtactgttgctttagcatgcctagtatccggctatttcccagaacccgtcaccgtatcatggaactcaggatcattaacatcaggagtccatacattcccatcagtgctacaatcatcaggtttacactcactatcatcaatggtaacagtgccatcatcaagatggccatctgaaacattcacatgcaatgtagtacacccagcatcaaatacaaaagtagacaaacctgtattcaatgaatgtcgatgtacagacactcctccttgtcccgtaccagaacccttaggaggaccatcagttttaatatttccaccaaaaccaaaagacatattaagaataacaagaactcctgaagtaacatgtgtcgtattagatttaggacgagaagatccagaagtacaaatatcatggttcgtagatggcaaagaagtattaacagcaaaaacacaatcaagagaacaacaattcaatggaacataccaagtagtaagcgtactaccaatagaacaccaagactggcttacaggaaaagaatttaaatgcagagttaatcatatagacttaccatcaccaatagaaagaacaatatcaaaagcgagaggcagagcacataaaccatcagtctatgtattaccaccaagcccgaaagaactatcaagttctgatacagtatctatcacttgtttaattaaagacttctatccaccagatatagatgtcgaatggcagtcagttggacaacaagaaccagaaagaaaacacaggatgactcctcctcaacttgacgaagacggatcatatttcttatactcaaaattatccgtagacaaaagcagatggcaacaaggagacccttttacatgtgcagttatgcacgaaactttacaaaaccattataccgacctatctctttcacattcacctggcaaa

SEQ ID NO: 46904 - RNA, 651 nt, synthetic construct
  misc_feature 1..651: note = derived and/or modified sequence opt6 from Ranevetmab_LightChain
  source 1..651: mol_type = other RNA
gacatagtaatgacacaatcaccagcatcactatcactatcccaaggagaaaccgtaacaataacatgtagagcctcagaagacatatacaacgcattagcctggtatcaacaaaaaccaggacaagcccccaaactactaatatacaacacagacacactacacacaggagtaccctcaagattctcaggatccggctcaggaacagacttctcactaaccatatcatcacttgaaccagaagacgtcgcagtatactactgccaacattatttccattatccacgaacatttggacaaggaaccaaagtagaactaaaaagaaacgacgcacaaccagcagtatacctattccaaccatcaccagaccaactacacacaggatcagcatcagtagtttgtctattaaactcattctacccaaaagacataaacgtaaaatggaaagtagacggcgtaatacaagacacaggaatacaagaatccgtaacagaacaagataaagactcaacatactcattatcatcaaccctaacaatgtcatcaacagaatatttatcacacgaactatactcatgcgaaataacacacaaatcattaccatcaacattaataaaatcattccaacgatcagaatgtcaaagagtagat

SEQ ID NO: 46905 - RNA, 1761 nt, synthetic construct
  misc_feature 1..1761: note = derived and/or modified sequence opt6 from Remtolumab_HeavyChain
  source 1..1761: mol_type = other RNA
gaagtacaattagtagaaagtggaggaggtctagtccaaccaggaagatcactacgattatcatgcgcagcatccggatttacatttgatgactatgcaatgcattgggtacgacaagcaccaggaaaaggattagaatgggtttcagctataacctggaacagtggacatatagactatgcagattcagtagaaggtagatttactataagcagagataatgctaaaaatagtctatatttacaaatgaacagtttacgagcagaagacactgcagtatattactgtgccaaggtatcatatttaagtacagcttcaagcctcgattattggggacaaggaaccttagttacagtttcatcagggggaggaggaagcggaggaggagggtcagaagtccaattagtccaaagcggagcagaagtaaagaaaccaggatcatcagtaaaagtatcttgtaaagcaagtggcggctcatttggaggatacggaataggatgggtaagacaagcaccaggacaaggactcgaatggatgggaggaataacaccattcttcggatttgcagactacgcacaaaaattccaaggaagagtaacaataacagcagatgaatcaaccacaacagcttatatggaattatcaggactgacaagtgatgatacagcagtgtactattgtgcaagagatccaaatgaattttggaatggatactattcgactcatgattttgacagctggggtcaaggaacaacagtaactgtatctagtgcatcaacaaaaggcccaagtgtattcccattggcaccctcatcaaaaagtacaagtggaggaacagcagccttaggatgtctagtgaaagattattttccagaaccagtaacagtatcatggaactcaggagccctaacatcaggagtacatacattccctgctgtactacaatccagtggactatattctctttccagtgtagtaacggttccaagtagttcgctaggaacacaaacctatatatgtaatgtgaaccataaaccgtcaaacacaaaagtagataagaaagttgagccaaaatcatgtgataaaacacatacttgcccaccatgtcctgcaccagaattattaggtggaccaagtgttttcctttttcccccaaaaccgaaagatactttaatgataagtcgaacaccagaagttacctgtgtcgtcgttgacgtcagccatgaagatcccgaagtaaaattcaactggtatgtcgacggagtagaagttcacaatgcaaagaccaaaccacgggaagaacaatacaacagcacatatagagtagtatcagtcttaacagtattacaccaagattggttaaacggaaaagaatataaatgtaaagtatcaaataaagcattaccagcgcctatcgagaaaactatatcaaaagcaaaaggacaaccaagagaaccacaagtatacacactacccccatcaagagatgaactaaccaaaaaccaggtttcattaacatgtttagtaaaaggtttttatccaagcgacatagcggtagaatgggaatcaaacggacaaccagaaaacaattataaaactacccctccagtactagattcagacggcagtttctttttatatagcaaattaacagtagacaaaagtagatggcaacaaggaaatgtattttcatgttcagtaatgcatgaagcattacacaatcattatacacaaaagtcactaagtctaagtccaggtaaa

SEQ ID NO: 46906 - RNA, 993 nt, synthetic construct
  misc_feature 1..993: note = derived and/or modified sequence opt6 from Remtolumab_LightChain
  source 1..993: mol_type = other RNA
gacatacaaatgacacaatctccatcatcattatcagcctccgtaggcgacagagtaacaataacctgcagagcttcacaaggaataagaaactacctagcatggtaccaacaaaaacccggtaaagcccccaaattactaatatacgcagcatcaaccctacaatcaggcgtaccatcaagattttccggatcaggatcaggaacagactttacattaacaatatcatcactacaacccgaagacgtcgccacatactactgtcaaagatacaaccgcgcaccatacacattcggacaaggcacaaaagtagaaataaaaagaggaggatcaggaggcggaggatcaggagaaatcgtactaacacaatcccccgacttccaatcagtaacaccaaaagaaaaagtaacaataacatgccgagcaagccaagacattggctcagaactacactggtaccaacaaaaaccagaccaaccaccaaaactactaataaaatacgcatcacactcaacaagcggagtaccatcaagattctcaggatcaggatcaggaacagacttcaccttaaccataaacggactagaagcagaagacgcaggaacatattactgccaccaaacagactcattaccttatacctttggacctggaacaaaagtcgatataaaaagaacagtagctgcaccaagcgtattcatattccctccatcagacgaacaactaaaatcaggaacagcatcagtagtatgcctactcaacaacttctacccaagagaagccaaagtacaatggaaagttgacaacgcactacaatcaggaaactcacaagaatccgtaaccgaacaagactcaaaagactcaacatactcactatcatcaaccttaaccctatcaaaagcagactacgaaaaacataaagtatacgcatgcgaagtaacacatcaaggcctctcctcaccagtcacaaaatcatttaacagaggcgaatgt

SEQ ID NO: 46907 - RNA, 1341 nt, synthetic construct
  misc_feature 1..1341: note = derived and/or modified sequence opt6 from Rosmantuzumab_HeavyChain
  source 1..1341: mol_type = other RNA
caagtacaactagtacaatctggcgcagaagtcaaaaaaccaggtgcatctgtaaaagtatcatgcaaagcttccggttatacatttactgattattccattcactgggtacgacaagcaccaggacaaggcttagaatggataggatacatctacccttcaaacggcgactccggatataatcaaaaattcaaaaacagagtcactatgacacgcgatacctcaacatccacagcatatatggaattatcaagactacgatcagaagacacagcagtatattattgcgcaacatacttcgcaaataatttcgactactggggacaaggcacaacactaaccgtatcatcagcttcaaccaaaggaccttcagtattcccactagcaccatcatcaaaatcaacgtcaggaggaacagcagccctaggatgtttagtaaaagactatttcccagaacctgtaacagtctcatggaattcaggcgcactaacatcaggagttcacacatttcctgctgtattacaatcctccggattatatagtctatcatctgttgtcaccgtaccatcatcatcactaggtacccaaacctatatatgtaatgttaaccacaaaccatccaatacaaaagtagacaaaagagtagaacccaaatcatgcgacaaaactcacacatgtccaccatgccctgcaccagaattattaggaggaccctccgtattcctatttccaccaaaaccaaaagacactctaatgatctcaagaacaccagaagtcacatgtgtagtcgttgatgtatcacacgaagacccagaagtcaaattcaattggtacgttgacggagtagaagttcacaatgccaaaactaaaccaagagaagaacaatacaactcaacatacagagtagtatcagtattaaccgtactacatcaagactggttaaatggaaaagaatacaaatgcaaagtttccaataaagccttaccagcaccaatcgaaaaaaccatatcaaaagcaaaaggccaaccccgagaaccacaagtatacacattaccaccatcacgcgaagaaatgacaaaaaaccaagtatctctaacatgcttagtaaaaggattctatccctcagacatagcagtagaatgggaatccaacggacaaccagaaaacaactacaaaacaacacctcctgtcttagactcagacggatcattcttcttatactcaaaactaacagtagacaaatcaagatggcaacaaggaaacgttttttcatgttcagtaatgcacgaagcactacacaaccactacacacaaaaatcattatcactttcaccaggtaaa

SEQ ID NO: 46908 - RNA, 654 nt, synthetic construct
  misc_feature 1..654: note = derived and/or modified sequence opt6 from Rosmantuzumab_LightChain
  source 1..654: mol_type = other RNA
gacatacaaatgacacaatcaccatcatcactatcagcatcagtaggagacagagtaacaataacatgcaaagcatcacaatcagtagactacgacggcgactcatacatgaactggtaccaacaaaaaccaggaaaagcaccaaaactactaatatacgcagcatccaacttagaatcaggagtaccatcaagattctcaggttcaggatcaggaacagacttcacattaacaatatcaccagtacaagcagaagacttcgcaacatactactgccaacaatcaaacgaagacccactaacattcggagcaggaacaaaactagaactcaaaagaacagtagcagcaccatcagtattcatattcccaccatcagacgaacaattaaaatcaggcacagcatcagtcgtatgcctattaaacaacttctacccaagagaagcaaaagtacaatggaaagtcgacaacgcactacaatcaggaaactcacaagaatccgtaacagaacaagactcaaaagactccacctactcactatcatcaacattaaccttatcaaaagccgactacgaaaaacacaaagtatacgcatgcgaagtaacacaccaaggactatcatcaccagtaacaaaatcatttaacagaggagaatgt

SEQ ID NO: 46909 - RNA, 1332 nt, synthetic construct
  misc_feature 1..1332: note = derived and/or modified sequence opt6 from Rozanolixizumab_HeavyChain
  source 1..1332: mol_type = other RNA
gaagttccattagtcgaatcaggaggaggactagtacaaccaggaggttcactaagattatcatgtgcagtatcaggatttacttttagtaactatggaatggtttgggtcagacaagcacctggaaaaggtctagaatgggtagcctatatagactccgatggagacaacacctactacagagatagtgtaaaaggcagattcacaatatctagagataatgcaaaatcctcactatatttacaaatgaattcactaagagccgaagacacagcagtatactactgtacaacaggaatagtacgaccattcctatactggggacaaggaacactagtaacagtctcatctgcatcaactaaaggaccatcagtatttccattagctccatgttcccgatcaacatcagaatcaacagcagcattaggttgcttagtcaaagattacttcccagaaccagtaacggtatcatggaactcaggagcactaacatccggagtacatacattccctgcagtattacaatcatcaggcctatattcactttcaagtgtcgtaacagtaccctcatcatcattaggaaccaaaacatacacatgtaacgttgaccataaaccatcaaacacaaaagtagataaaagagtagaatcaaaatacggacctccttgtccaccgtgcccagctcccgaattcctagggggaccatcagtatttctatttccacctaaaccaaaagacacactaatgatatctagaacaccagaagtaacctgtgtagtagttgatgtatctcaagaagacccagaagtacaatttaactggtacgtcgatggagtagaagttcataatgcaaaaacaaaaccaagagaagaacaattcaattcaacatacagagttgtatcagtattaaccgtattacaccaagactggttaaacgggaaagaatacaaatgtaaagtctcaaataaaggactaccaagctctatagaaaaaacaatatctaaagcaaaaggccaaccacgagaaccacaagtatatactctaccaccctcacaagaagaaatgacaaaaaaccaagtatcattaacatgtctcgtaaaaggcttttacccatcagatatagcagtagaatgggaatccaatggacaaccagaaaataattataaaacaacaccacctgtcctagattcagatggatcatttttcttatactcaagattaacagtagataaatccagatggcaagaaggaaacgttttttcttgttctgtaatgcatgaagcactgcataatcactacacacaaaaatcactttcactatcactcggaaaa

SEQ ID NO: 46910 - RNA, 657 nt, synthetic construct
  misc_feature 1..657: note = derived and/or modified sequence opt6 from Rozanolixizumab_LightChain
  source 1..657: mol_type = other RNA
gacatacaaatgacacaatcaccatcatcactatcagcctcagtaggagacagagtaacaataacatgcaaatcatcacaaagcctagtaggcgcatcaggaaaaacatacctatactggttattccaaaaaccaggaaaagcaccaaaacgattaatatatctagtaagcacattagactcaggaataccatcaagattctctggatcaggatcaggaacagaatttacactaacaataagttcactacaaccagaagacttcgcaacatactactgcctacaaggaacacatttcccacacacattcggacaaggaacaaaactagaaataaaaagaaccgtcgcagcaccatcagtattcatattcccaccatcagacgaacaactcaaatcaggaacagcatcagtagtctgcctactaaacaacttctacccacgagaagcaaaagtacaatggaaagtcgacaacgccctacaaagcggaaactcacaagaatcagtaacagaacaagactcaaaagattcaacatacagcctatcatcaacattaacactaagcaaagcagactacgaaaaacacaaagtatacgcatgcgaagtaacacaccaaggactctcatcaccagtaacaaaatcattcaacagaggagaatgc

SEQ ID NO: 46911 - RNA, 1329 nt, synthetic construct
  misc_feature 1..1329: note = derived and/or modified sequence opt6 from Sapelizumab_HeavyChain
  source 1..1329: mol_type = other RNA
caagtacaactacaagaatcaggaccaggcctagtcaaaccaagcgaaacattaagcctaacatgtgcagtatcaggtcattccatttcacacgatcacgcatggtcatgggtaagacaaccaccaggagaaggactcgaatggatcggatttatctcatactcaggaataacaaactataacccaagccttcaaggaagagtaaccatatcaagagacaattccaaaaacaccctttacctacaaatgaactcattaagagcagaagacacagcagtttactactgcgcaagatcattagcacgaactacagcaatggattattggggtgaaggcaccctagtaacagtatcatcagcatcaacaaaaggaccatctgtattcccattagcccctagctctaaatcaacctcaggaggaacagcagcactcggctgtctagtaaaagactactttccagaaccagtaacagtatcatggaactcaggagccctaacatccggtgtacacacattcccagccgtactacaatcatcaggtctatattcattaagctctgtagtcacagtaccttcaagcaatttcggaacacaaacatacacatgtaacgttgaccataaaccatccaatacaaaagtagacaaaacagtagaaagaaaatcctgtgtcgaatgcccaccatgcccagcacccccagtagcaggccccagcgtattcctttttccacccaaacctaaagacaccctaatgatatcaagaacacccgaagtaacatgcgtagttgtagatgtctcccaagaagatccagaagtacaattcaattggtatgtagatggagtagaagttcataatgcaaaaactaaacctagagaagaacaatttaactcaacatttcgcgtagtatcagtattaaccgtagtgcatcaagactggcttaatggaaaagaatacaaatgcaaagtatcaaacaaaggattaccagcaccaatagaaaagaccatatcaaaaacaaaaggacaaccaagagaaccccaagtatataccctaccaccatctcaagaagaaatgaccaaaaatcaagtatccttaacatgcttagtcaaaggattttatccaagtgacatagctgtcgaatgggaatcaaatggacaaccagaaaacaactataaaacaacacctccaatgctagattctgacggatcattcttcttatactcaaaattaaccgtagataaaagcagatggcaagaaggtaacgtattttcctgctcagtaatgcatgaagccctacacgcacactatacacaaaaatctctatcattatcacca

SEQ ID NO: 46912 - RNA, 642 nt, synthetic construct
  misc_feature 1..642: note = derived and/or modified sequence opt6 from Sapelizumab_LightChain
  source 1..642: mol_type = other RNA
gacatacaaatgacccaatcaccatcatcactatcagcatcagtaggagattccgtaacaataacctgccaagcatccaccgacatatcatcacacttaaactggtaccaacaaaaaccaggaaaagcacccgaattactaatatactacggatcacacctcctatcaggagtaccatcaagattctcaggatcaggctcaggaacagacttcacattcacaatatcatcactagaagcagaagacgcagccacatactattgcggacaaggaaacagactcccatacacattcggacaaggaacaaaagtagaaatagaaagaacagtagcagcaccatccgtattcatattcccaccatcagacgaacaactaaaatcaggcacagcctcagtagtttgcctactcaacaacttctacccaagagaagcaaaagtacaatggaaagtagacaacgcactacaatcaggaaactcacaagaatcagtaaccgaacaagattcaaaagactcaacatactcactatcatcaacattaacactatctaaagcagactacgaaaaacacaaagtatacgcatgcgaagtaacacatcaaggactatcatcacccgtaacaaaatcattcaaccgaggtgaatgc

SEQ ID NO: 46913 - RNA, 1356 nt, synthetic construct
  misc_feature 1..1356: note = derived and/or modified sequence opt6 from Selicrelumab_HeavyChain
  source 1..1356: mol_type = other RNA
caagtacaattagtacaatctggtgcagaagtaaagaaaccaggagcatccgtaaaagtatcatgcaaagcatcaggatatacatttacaggatactacatgcactgggtaagacaagcaccaggtcaaggattagaatggatgggttggattaatccagatagtggaggaacaaattatgcacaaaaattccaaggcagagtaacaatgactagagacaccagtatatcaacagcatacatggaattaaacagactaagatcagatgatactgcagtatattattgcgcaagagaccaaccactaggatactgtacaaatggagtatgctcatatttcgattactggggacaaggaactctagtaactgtatcatcagcatcaacaaaaggtccttctgtatttccacttgcaccatgtagtagatcaacatccgaatcaacagcagccctaggatgcttagtaaaagactactttcccgaacctgtaaccgtaagctggaactcaggcgcactaacatcaggagtacacacatttccagcagttttacaatcaagtggtttatacagcttatcatcagtcgtaacagttccatccagcaatttcggaacccaaacctatacatgtaatgttgatcataaaccatctaatacaaaagtagacaaaacggttgaaagaaaatgctgtgtagaatgcccaccctgtcccgctcctcctgtagcaggaccttcagtatttctattccctccaaaaccaaaagacaccctaatgataagcagaacaccagaagtaacatgcgtagtagtagacgtctcgcatgaagaccccgaagtacaatttaactggtatgtagacggagtagaagtacacaatgcaaaaacaaaaccaagagaagaacaatttaactctacttttagagttgtatcagtcttaactgtagttcaccaagattggttaaatggaaaagaatacaaatgcaaagtatctaacaaaggcttaccagcacccatagaaaagacaatttcaaaaacaaaaggacaaccaagagaaccacaagtatacacattaccaccatcaagagaagaaatgaccaaaaaccaagtatcactaacatgccttgtaaaaggcttctatccaagcgatatagcagtagaatgggaaagcaacggtcaaccagaaaataattataaaacaacacccccaatgttagactcagatggcagcttcttcttatactcaaaattaacagtagacaaatcaagatggcaacaaggaaatgtattctcatgttctgtaatgcacgaagcactacacaatcactatacacaaaaatcactatctctatctccaggaaaa

SEQ ID NO: 46914 - RNA, 642 nt, synthetic construct
  misc_feature 1..642: note = derived and/or modified sequence opt6 from Selicrelumab_LightChain
  source 1..642: mol_type = other RNA
gacatacaaatgacacaatcaccatcttcagtatcagcaagcgtaggagacagagtaaccataacctgtagagcatcacaaggaatatactcatggttagcatggtaccaacaaaaaccaggcaaagcaccaaacctactaatatacaccgcatcaacactacaatcaggagtcccaagcagattctcaggatcaggatcaggaacagacttcacactaacaatatcttcattacaaccagaagacttcgcaacatactactgccaacaagcaaacatattcccactaacattcggaggaggaacaaaagtagaaataaaaagaaccgtcgcagcaccatcagtattcatattcccaccatcagacgaacaattaaaatccggaacagcatccgtcgtatgcttactaaacaacttctacccaagagaagcaaaagtacaatggaaagtagacaacgcattacaatcaggaaactcacaagaaagcgtaacagaacaagattcaaaagactcaacatactcattatcatcaacactaacattaagcaaagcagactacgaaaaacacaaagtatacgcatgcgaagtaacacaccaaggattatcatcaccagtaaccaaatcattcaacagaggagaatgc

SEQ ID NO: 46915 - RNA, 354 nt, synthetic construct
  misc_feature 1..354: note = derived and/or modified sequence opt6 from Solitomab_HeavyChain1
  source 1..354: mol_type = other RNA
gaagtacaattactagaacaatcaggagcagaattagtaagaccaggaacatcagtaaaaatatcatgcaaagcatcaggatatgcatttacaaattactggctaggatgggtaaaacaaagaccaggacatggattagaatggataggagacatattcccaggatcaggaaatatacattacaatgaaaaattcaaaggaaaagcaacactaacagcagataaatcaagctcaacagcatacatgcaattaagctcactaacattcgaagactcagcagtatacttttgcgcaagattaagaaattgggatgaaccaatggattactggggacaaggaacaacagtaacagta

SEQ ID NO: 46916 - RNA, 375 nt, synthetic construct
  misc_feature 1..375: note = derived and/or modified sequence opt6 from Solitomab_HeavyChain2
  source 1..375: mol_type = other RNA
gacgtacaattagtacaaagcggagcagaagtaaaaaaaccaggagcaagtgtaaaagtaagctgtaaagcaagcggatacacattcacaagatatacaatgcactgggtaagacaagcaccaggacaaggattagaatggataggatatataaatccatcaagaggatacacaaactatgcagatagcgtaaaaggaagatttacaataacaacagacaaaagcacaagcacagcatatatggaattatcatcattaagatcagaagatacagcaacatattactgtgcaagatactatgacgatcactattgcttagactattggggacaaggaacaacagtaacagtatcaagcggagaaggaacatcaaca

SEQ ID NO: 46917 - RNA, 1488 nt, synthetic construct
  misc_feature 1..1488: note = derived and/or modified sequence opt6 from Solitomab_LightChain_HeavyChain_HeavyChain_LightChain
  source 1..1488: mol_type = other RNA
gaattagtaatgacacaatccccatcgagtttaacagtaacagcaggagaaaaagtaactatgtcatgcaaatcatcacaaagtttactaaatagcggtaaccagaaaaattacttaacatggtatcaacaaaaaccaggacaaccaccaaaattattaatatattgggcaagcacaagagaaagtggtgtacctgacaggtttacaggatcgggaagtggaacggattttactcttactataagctccgtacaagcagaagatttggcagtatactattgtcaaaacgactactcttacccactaacatttggagcaggaactaaactagaaattaaaggaggaggaggaagtggaggaggaggatcaggaggaggaggtagcgaagtacaactattagaacaaagtggagccgaattagtaagacctggcacatcagtaaaaataagctgtaaagctagcggatatgcttttactaactattggttagggtgggtaaaacaaaggccaggtcatggattggaatggataggcgatatttttccaggaagtggaaatatacactacaatgaaaaattcaaaggtaaagcaacacttacagctgacaaatcaagtagcacagcatatatgcaattatcaagtttgacatttgaagatagcgcggtatatttctgtgcaagactacgaaattgggatgaaccaatggattattggggacaaggaactacagtaacagtatcaagtggaggaggaggaagtgacgtgcaattagtacagagtggagccgaagtaaagaaaccaggagcaagcgtaaaagtaagctgtaaagcatcaggatacacatttacaagatatacaatgcattgggtaagacaagcaccaggtcaaggactagaatggataggatatataaatccctcacgaggatatacaaattatgctgatagtgtaaaaggacgatttactataacaacggataaatcaacatcaacagcatatatggaactaagtagtctaagaagtgaggatacagcaacttattattgtgcaagatattacgatgatcattattgcttagattattggggacaaggtaccacagtaacagtaagtagcggagaaggtacatcaacaggaagtggaggttcaggcggatcaggcggtgcagacgacattgtgttaactcaatcaccagcaacattaagcctaagcccaggcgaaagagcaacattgagctgccgtgctagtcaaagcgtgagctacatgaattggtatcaacaaaaaccaggaaaagcacccaaaagatggatatatgatacatctaaagtagcatctggagtaccagcaagatttagcggaagtggaagtggaactgattacagtttaacaattaatagcctagaagcagaagatgcagcaacatattattgtcaacaatggagttcaaatccattaacatttggaggaggaactaaagttgaaataaaa

SEQ ID NO: 46918 - RNA, 339 nt, synthetic construct
  misc_feature 1..339: note = derived and/or modified sequence opt6 from Solitomab_LightChain1
  source 1..339: mol_type = other RNA
gaactagtaatgacacaatcaccatcatcactaacagtaacagcaggagaaaaagtaacaatgtcatgcaaatcatcacaatcactactaaactcaggaaaccaaaaaaactacctaacatggtaccaacaaaaaccaggacaaccaccaaaactactaatatactgggcaagcacaagagaatcaggagtaccagacagattcacaggatcaggatcaggaacagacttcacattaacaatatcatcagtacaagcagaagacctagcagtatactactgccaaaacgactactcatacccactaacattcggagcaggaacaaaactagaaataaaa

SEQ ID NO: 46919 - RNA, 324 nt, synthetic construct
  misc_feature 1..324: note = derived and/or modified sequence opt6 from Solitomab_LightChain2
  source 1..324: mol_type = other RNA
gcagacgatatagtactaacacaatcaccagcaacattatcattaagcccaggagaaagagcaacattaagctgtagagcaagccaaagcgtaagctatatgaattggtatcaacaaaaaccaggaaaagcaccaaaaagatggatatacgatacaagcaaagtagcatcaggagtaccagcaagatttagtggaagcggaagcggaacagattactcactaacaataaatagcttagaagcagaagatgcagcaacatattactgtcaacaatggtcaagcaatccactaacatttggaggaggaacaaaagtagaaataaaa

SEQ ID NO: 46920 - RNA, 1359 nt, synthetic construct
  misc_feature 1..1359: note = derived and/or modified sequence opt6 from Suptavumab_HeavyChain2
  source 1..1359: mol_type = other RNA
gaagtacaattagttgaatccggaggagacttagtacaaccaggaagatccctaagattatcctgcgtcgcatcaggcttcacattcgacgattacgctatgcactgggtacgacaagctcccggaaaaggactagaatgggtctctggcgtaagttggtcaggatctactgtcggctatgccgatagtgtcaaaggaagatttaccgtatcaagagacaatgcacaaaaatcactatacctacaaatgaattcactaagagcagaagatacagcactatattactgtgtaaaagatgcttacaaatttaattactactattatggactagatgtatggggacaaggcaccactgtaaccgtctcatctgcctctacaaaaggcccctcagtatttccactagcaccctcctcaaaatcaacctctggaggcactgctgcattaggatgcctagtaaaagactattttccagaaccagttactgtatcttggaacagcggagcactcacatcaggagtacatacatttccagcagtcttacaatcaagtggattatattcactatcatcagttgtaacagtaccaagctcatcactaggaacacaaacctacatttgcaatgtaaatcacaaaccatcaaacacaaaagtagataaaaaagttgaaccaaaaagttgcgataaaacacacacatgtccaccatgtccagccccagaactactaggaggaccatcagtattcttatttcccccaaaaccaaaagacacattaatgatatctagaacaccagaagtaacatgcgtcgtagtcgatgtatcacatgaagatcccgaagtaaaatttaattggtacgtcgatggtgtagaagtacataatgcaaaaactaaaccacgagaagaacaatataattccacatacagagtagtctcagtattaactgtattacaccaagactggttaaacggcaaagaatataaatgtaaagtatcaaacaaagccttaccagcaccaattgaaaaaacaatatcaaaagccaaaggacaaccaagagaaccacaagtatatacacttccaccatctagagatgaattaacaaaaaatcaagtatcattaacatgtctagtcaaaggattctatcctagtgacatagctgtagaatgggaatcaaatggccaaccagaaaacaattataaaacaacaccacccgtattagactcagatggaagtttcttcctatactctaaattaaccgttgacaaatcacgctggcaacaaggaaatgttttcagttgctccgttatgcacgaagcactacacaaccattacacccaaaaatcattatctttatcacctggaaaa

SEQ ID NO: 46921 - RNA, 1356 nt, synthetic construct
  misc_feature 1..1356: note = derived and/or modified sequence opt6 from Suvratoxumab_HeavyChain
  source 1..1356: mol_type = other RNA
gaagtccaattagtagaaagtggaggaggcctagtacaaccaggaggaagtctaagattaagctgcgcagcaagtggatttacattttctagccacgacatgcactgggtacgccaagcaaccggaaaaggactagaatgggtaagtggcataggcacagcaggcgacacatactacccagattcagttaaaggaagatttactatttccagagaaaatgcaaagaacagtttatatttacaaatgaatagtttaagagctggtgacacagcagtatattactgcgcaagagatagatattcaccaacaggacactattacggtatggacgtatggggacaaggaacaactgttacagtatcatcagcatctaccaaaggaccatcagtattcccacttgctccaagtagcaaatcaacatcaggaggtaccgccgcattaggatgtttagtcaaagactattttccagaaccagtcacagtatcatggaactctggagcactaacatcaggagtacacacatttccagcagtactccaatccagcggtctatattcattaagttcagtagtaacagtcccatctagttcattaggaacacaaacatacatatgcaatgtaaatcataaaccatcaaacaccaaagtagacaaaagggtagaacctaaatcatgcgataaaacacacacatgccctccatgcccagcacctgaattactaggaggaccttcggtatttctatttccaccaaaaccaaaagatacattatatataacaagagaacctgaagttacatgtgtagtagtagacgtatcacatgaagacccagaagtaaaattcaattggtacgtagacggagtagaagtacataacgcaaaaacaaaaccaagagaagaacaatataatagcacatatcgagtagtatcagtactaactgtattacatcaagactggttaaatggtaaagaatataaatgtaaagtatcaaataaagcactaccagcacccatagagaaaacaatatcaaaagccaaaggccaaccacgagaacctcaagtatatacattaccaccatcaagagaagaaatgaccaaaaatcaagtatcattaacttgcctagtaaaaggattttatccatctgacatagctgtagaatgggaaagtaacggtcaacctgaaaataattataaaaccacaccacccgtattagatagtgacggctcattctttctatatagtaaattaacagtagataaaagtagatggcaacaaggtaatgtatttagctgttcagtaatgcatgaagctctacacaatcactatactcaaaaatcattaagcctttctccaggaaaa

SEQ ID NO: 46922 - RNA, 639 nt, synthetic construct
  misc_feature 1..639: note = derived and/or modified sequence opt6 from Suvratoxumab_LightChain
  source 1..639: mol_type = other RNA
gacatacaaatgacacaatccccaagcacactatcagcatcagtaggagacagagtaacaataacctgcagagcatcacaatcaatatcatcatggctcgcatggtaccaacaaaaaccaggaaaagcaccaaaactactaatatacaaagcatcatcactagaatcaggagtaccttctagattctccggatcaggatccggaacagaatttacattaacaatatcatcactacaaccagacgacttcgctacatactactgcaaacaatacgcagactactggacattcggacaaggaacaaaagtcgaaataaaaagaacagtagcagcaccatcagtattcatattcccaccatcagacgaacaattaaaatcaggaacagcatcagtcgtatgcctactaaacaacttctacccaagagaagcaaaagtacaatggaaagtagacaacgcactccaatcaggaaactcacaagaatcagtaacagaacaagactcaaaagactcaacatactcactatcctcaacactaacactaagcaaagccgactacgaaaaacacaaagtatacgcctgcgaagtaacacatcaaggactatcatcacccgtaacaaaatcattcaacagaggagaatgc

SEQ ID NO: 46923 - RNA, 642 nt, synthetic construct
  misc_feature 1..642: note = derived and/or modified sequence opt6 from Tadocizumab_LightChain
  source 1..642: mol_type = other RNA
gacatccaaatgacacaaaccccatcaactctatcagcatcagtaggagacagagtaacaatatcatgcagagcaagccaagacataaacaactacctaaactggtaccaacaaaaaccaggaaaagcaccaaaactactaatatattacacatcaacattacactcaggagtaccctcaagattctcaggatcaggctcaggaacagactacactctaacaatatcatctctacaaccagacgacttcgcaacatacttctgccaacaaggaaacacactaccatggacattcggacaaggaacaaaagtagaagtcaaaagaacagtagcagcaccatcagtattcatattcccaccatcagacgaacaactaaaatcaggcacagcatcagtcgtatgcttattaaacaacttctacccaagagaagcaaaagtacaatggaaagtagacaacgcactacaatcaggaaactcacaagaaagcgtaaccgaacaagattccaaagactcaacatactcactaagctctacactaacactatcaaaagcagactacgaaaaacacaaagtatacgcatgcgaagtaacacaccaaggattatcatcaccagtaacaaaatcattcaacagaggagaatgc

SEQ ID NO: 46924 - RNA, 1341 nt, synthetic construct
  misc_feature 1..1341: note = derived and/or modified sequence opt6 from Tanezumab_HeavyChain
  source 1..1341: mol_type = other RNA
caagtacaattacaagaaagcggacctggattagttaaaccttcagaaacattatccctaacatgcacagtctccggcttctcactaataggatacgacttaaactggataagacaaccacccggcaaaggactagaatggataggaataatatggggagatggaacaacagactacaactcagcagtcaaaagccgagtcactatatctaaagacacttccaaaaatcaattctcactaaaactttcatcagtcacagcagccgacacagcagtttactactgcgcccgaggaggatattggtatgcaacatcatattactttgactactggggacaaggcaccctagtaacagtatcatccgcatcaacaaaaggcccctctgtatttccattagcaccatgttcacgatcaacatccgaatcaacagcagcactaggatgcctagtaaaagactacttcccagaaccagtcaccgtatcatggaactcaggagcactaacctccggagtacatacattcccagcagtattacaatcatcaggactctactcattaagctcagtcgtaaccgtaccatcatctaatttcggaacacaaacctatacctgtaatgtcgaccacaaaccatcaaacacaaaagtagacaaaactgtagaaagaaaatgctgtgtagaatgcccaccatgtccagcaccaccagtcgcaggaccaagtgtattcttatttccaccaaaacccaaagacaccctaatgatatcacgtacaccagaagtaacatgtgtagtcgtagacgtatcccacgaagatcccgaagtacaattcaattggtacgtcgacggtgttgaagtacacaacgctaaaacaaaaccaagagaagaacaatttaactcaacattccgagttgtatcagtattaacagtagtccatcaagactggctaaacggaaaagaatataaatgcaaggtatcaaacaaaggattaccatcaagtatagaaaagactatatcaaaaactaaaggacaacccagagaaccacaagtctacacactaccaccatcacgagaagaaatgactaaaaaccaagtatcactaacatgcctagtcaaaggattctatccatcagatatcgcagtcgaatgggaatcaaacggacaacccgaaaataattacaaaacaacaccaccaatgttagattcggacggatcatttttcttatactccaaactaacagtagacaaatcacgttggcaacaaggaaacgtcttctcctgctcagtaatgcatgaagcattacacaatcactatacacaaaaatcattatcactaagccctggaaaa

SEQ ID NO: 46925 - RNA, 642 nt, synthetic construct
  misc_feature 1..642: note = derived and/or modified sequence opt6 from Tanezumab_LightChain
  source 1..642: mol_type = other RNA
gacatccaaatgacacaatcaccctcatcactatcagcatcagtaggagaccgagtaacaataacatgcagagcatctcaatccatatcaaacaacctaaactggtaccaacaaaaacctggaaaagcaccaaaactcttaatatactacacatctagattccactcaggagtcccatcaagattctcaggctcaggatcaggaacagacttcaccttcacaatatcatcattacaaccagaagacatagcaacatactactgccaacaagaacacacactcccatacacattcggacaaggaacaaaactagaaatcaaacgaacagtagcagccccatcagtattcatattcccaccatcagacgaacaactaaaatccggaacagcatcagtagtatgcctactaaacaacttctacccacgcgaagcaaaagtccaatggaaagtagacaatgcactacaatcaggaaactcacaagaatcagtaaccgaacaagactcaaaagactcaacatactccctatcatcaacactaacactatcaaaagcagactacgaaaaacacaaagtatacgcatgcgaagtaacacaccaaggactatcctcaccagtaaccaaatcattcaacagaggagaatgc

SEQ ID NO: 46926 - RNA, 1353 nt, synthetic construct
  misc_feature 1..1353: note = derived and/or modified sequence opt6 from Tavolixizumab_HeavyChain
  source 1..1353: mol_type = other RNA
caagtacaattacaagaatcaggacctggactagtaaaaccctcccaaacactctcactaacatgcgcagtatacggcggatccttctcctcaggatattggaattggataagaaaacacccaggaaaaggactagaatacataggttacatatcctacaacggcataacatatcataacccatccctaaaatcaagaataacaataaaccgagacacatcaaaaaaccaatactcattacaactaaacagcgttactcccgaagataccgcagtctactactgcgcacgatataaatacgactatgatggagggcatgcaatggattactggggacaaggaacattagtcacagtaagctcagcaagtacaaaaggcccatcagtattcccactagcaccatcatctaaatctacatcaggcggaacagccgccttaggatgcctcgtaaaagattacttcccagaacctgttaccgtatcatggaactcaggagccctaacatctggagtacatacatttccagcagtcttacaatcatcaggactatactccctatcatcagtagtaacagtaccttcatcatcactaggcacccaaacatatatctgcaacgtcaaccacaaaccaagtaacaccaaagtagacaaaagagtcgaacctaaatcttgcgataaaactcacacatgcccaccatgcccagccccagaactactaggcggaccatcagttttcctattcccacccaaaccaaaagatacattaatgatatcaagaacccctgaagtaacatgtgtagtagttgacgtatcacacgaagatccagaagtaaaattcaattggtatgtagacggcgtagaagtccacaacgcaaaaaccaaacctcaagaagaacaatataactctacataccgagtagtatcagttttaacagtattacaccaagactggctaaacggtaaagaatacaaatgcaaagtctcaaataaagcattaccagcaccaatagaaaaaaccatatctaaagccaaaggtcaaccacgcgaaccccaagtttacaccctaccaccatcaagagaagaaatgaccaaaaaccaagtctcactaacatgtttagtcaaaggattctacccctcagacattgcagtagaatgggaatcaaacggccaaccagaaaataactataaaacaaccccacctgttctagattcagatggaagttttttcttatactccaaactcacagtagacaaatcaagatggcaacaaggaaatgtattctcctgctctgtaatgcatgaagcactacataaccattatacccaaaaatcactttctctatctccaggaaaa

SEQ ID NO: 46927 - RNA, 642 nt, synthetic construct
  misc_feature 1..642: note = derived and/or modified sequence opt6 from Tavolixizumab_LightChain
  source 1..642: mol_type = other RNA
gacatacaaatgacccaatcaccatcatccctctccgcatcagtaggcgacagagtaacaataacctgcagagcatcacaagatatatcaaactacctaaactggtaccaacaaaaaccaggaaaagcacccaaactactaatatactacacatcaaaactacactcaggagtcccatcaagattctcaggctcaggatcaggaacagactacacactaacaatatcatcactccaaccagaagacttcgcaacatactactgccaacaaggatcagcactaccatggacattcggacaaggaacaaaagtagaaataaaaagaacagtagcagcaccatcagtattcatattcccaccctcagacgaacaactaaaatcaggcacagcatcagtagtatgcctactaaataacttctacccaagagaagcaaaagtacaatggaaagtagacaacgcattacaatcaggtaactcacaagaatcagtaaccgaacaagactcaaaagactcaacatactccctatcatcaacactaacactatcaaaagcagactacgaaaaacacaaagtatacgcatgcgaagtaacacaccaaggcctatcatcaccagtaacaaaatcattcaacagaggagaatgt

SEQ ID NO: 46928 - RNA, 1335 nt, synthetic construct
  misc_feature 1..1335: note = derived and/or modified sequence opt6 from Telisotuzumab_HeavyChain
  source 1..1335: mol_type = other RNA
caagtccaactagtacaatctggcgcagaagtaaaaaaaccaggcgcatcagttaaagtatcatgcaaagcatcagggtacatattcactgcatacaccatgcattgggtaagacaagcacccggacaaggactagaatggatggggtggataaaaccaaacaacggactcgctaactatgcacaaaaatttcaaggcagagtcacaatgactcgcgacacatcaatttcaactgcttatatggaactatcaagactaagatcagacgacaccgcagtttactattgcgcaagatctgaaataaccaccgaattcgattactggggccaaggaactctagttactgtatcatcagcatccacaaaaggtccttcagtcttcccactagcaccatcatcaaaatcaacctcaggaggtacagccgcactaggatgcctcgtaaaagactacttccctgaacctgtaaccgtatcttggaattctggcgcacttacatcaggcgtacatacatttccagcagtattacaatctagcggtttatactcactctcatccgttgtaacagtaccaagctcatctctaggaacacaaacgtacatatgcaacgtaaaccataaaccatcaaatactaaagtagacaaaagagtagaaccaaaaagctgcgactgccactgtccaccatgcccagcaccagaattattaggaggaccctcagttttcttatttccaccaaaaccaaaagataccctaatgatatctagaacacccgaagtaacatgcgtagtagtagacgtttcacatgaagatcctgaagtaaaattcaattggtacgttgacggagtagaagtccataacgcaaaaacaaaaccacgagaagaacaatataattcaacatacagagtcgtatcagtattaacagtactacatcaagactggctaaacggcaaagaatacaaatgtaaagtctctaataaagccttaccagcacccatagaaaaaacaatatcaaaagctaaaggacaaccaagagaaccacaagtttataccttaccaccatcacgagaagaaatgaccaaaaaccaagttagcttaacatgtctagtaaaaggattttatccatcagacattgcagtcgaatgggaatcaaatggacaacctgaaaataattataaaaccacaccccccgtactagactcagacggatcatttttcctctatagcaaattaaccgtagacaaatccagatggcaacaaggcaatgtcttctcatgctcagttatgcatgaagctctacacaaccactatacacaaaaatccttatcattatctccaggt

SEQ ID NO: 46929 - RNA, 654 nt, synthetic construct
  misc_feature 1..654: note = derived and/or modified sequence opt6 from Telisotuzumab_LightChain
  source 1..654: mol_type = other RNA
gacatagtaatgacacaaagcccagacagcctagcagtaagcctaggagaaagagcaacaataaactgtaaatcaagcgaatcagttgactcatacgcaaactcattcctacactggtaccaacaaaaaccaggacaaccacccaaactattaatatatagagcaagcacaagagaaagcggagtcccagacagattctcaggatcaggatcaggaacagactttacattaacaataagttcattacaagcagaagacgtagctgtatactactgtcaacaatcaaaagaagatccactaacattcggaggaggaacaaaagtagaaataaaaagaacagtagcagcaccaagcgtattcatattcccaccatcagacgaacaattaaaatcgggaacagcatcagtagtatgcttactaaataacttttacccgagagaggcaaaagtacaatggaaagtagataacgccctacaaagcggaaactcacaagaaagtgtaaccgaacaagacagcaaagattcaacatatagcctatcatcaacattaacattaagcaaagcagattacgaaaaacataaagtatacgcatgcgaagtaacacaccaaggattaagctcaccagtaacaaaatcatttaacagaggagaatgc

SEQ ID NO: 46930 - RNA, 1335 nt, synthetic construct
  misc_feature 1..1335: note = derived and/or modified sequence opt6 from Telisotuzumab_vedotin_HeavyChain
  source 1..1335: mol_type = other RNA
caagtccaattagtacaatcaggagcagaagtcaagaaacctggagcctcagtaaaagtctcatgcaaagcatctgggtatatatttacagcatacacaatgcactgggtaagacaagccccaggacaaggactagaatggatgggttggataaaaccaaacaatggactagcaaactacgctcaaaaattccaaggacgagtaacaatgactagagacacatcaatttccaccgcatacatggaattatcaagactcagatcagatgacacagccgtatactactgtgcacgatcagaaattactacagaatttgattactggggccaaggcacgttagtaacagtatcctccgcttcaacaaaaggaccttccgtattccctttagcaccatcttctaaatcaacaagcggaggaacagcggccctaggatgtttagtaaaagactacttcccagaaccagtaaccgtcagctggaactcaggagcattaacttcaggagtccataccttcccagcagtcctacaaagctccggattatactcattatcatcagtagtaacagtaccatcaagttcattaggaactcaaacctacatctgtaacgtaaaccacaaaccaagtaacacaaaagtagacaaacgagtagaaccaaaatcatgcgactgccattgcccaccatgtccagcaccagaactactaggaggaccatcagtattcctatttccaccaaaaccaaaagacacactaatgatatcaagaacaccagaagtaacttgcgttgtagtagatgtttcacatgaagacccagaagttaaattcaattggtacgtagacggagtagaagtccacaacgcaaaaacaaaaccacgagaagaacaatataactcaacttacagggtagtttcagtactcacagtacttcatcaagactggctaaatggaaaagaatataaatgcaaagtctcaaacaaagcactacctgcaccaatcgagaaaacaatctcaaaagcgaaaggacaaccacgagaacctcaagtctatacactaccaccatcaagagaagaaatgaccaaaaaccaagtatccttaacatgtttagtaaaaggattctatccaagtgatatagcagtagaatgggaatccaatggacaaccagaaaataattacaaaacaacaccaccagtactagactcagatggatcattctttttatactcaaaattaacagtcgacaaatcaagatggcaacaaggaaacgtattttcatgctcagtaatgcacgaagctctacataatcattatacacaaaaatcactaagcctatcaccaggt

SEQ ID NO: 46931 - RNA, 654 nt, synthetic construct
  misc_feature 1..654: note = derived and/or modified sequence opt6 from Telisotuzumab_vedotin_LightChain
  source 1..654: mol_type = other RNA
gacatagtaatgacacaatcaccagacagcttagcagtaagcctaggagaacgagcaacaataaactgtaaatcaagtgaaagcgtagactcatacgcaaactcattcttacactggtaccaacaaaaaccaggacaaccaccaaaattattaatctaccgagcatccacaagagaaagcggagtaccagacagattctcaggatcaggatcaggcacagactttacattaacaataagctcactacaagcagaagacgtagcagtatactattgccaacaatcaaaagaagacccacttacattcggaggaggaacaaaagtagaaataaaaagaacagttgcagcaccaagtgtattcatattcccaccatcagacgaacaattaaaatcgggaacagcatcagtagtatgcttactcaacaacttttacccaagagaagcaaaagtacaatggaaagtagataacgcactacaaagtggaaactcacaagaaagcgtaacagaacaagacagtaaagactcaacatacagcttaagctcaacattaacattaagcaaagccgattatgaaaaacataaagtatacgcatgcgaagtaacacaccaaggactaagctcaccagtaacaaaatcatttaacagaggagaatgc

SEQ ID NO: 46932 - RNA, 1350 nt, synthetic construct
  misc_feature 1..1350: note = derived and/or modified sequence opt6 from Timigutuzumab_HeavyChain
  source 1..1350: mol_type = other RNA
gaagtccagttagtagaatcaggaggaggcttagtacaaccaggtggctctctaagactatcctgtgcagcatcaggatttaacataaaagatacctatatacattgggtacgccaagcaccaggaaaaggattagaatgggttgccagaatataccctacaaatggttacacaagatacgcagactctgtaaaaggaaggttcacaatatcagcagacacctcgaaaaatacagcatacttacaaatgaatagtttacgcgcagaagatactgcagtatactattgctcaagatggggaggagacggtttctacgcaatggactattggggacaaggaacattagtaacagtctcttccgcaagtacaaaaggaccatccgtatttccactagcaccatcatcaaaaagcacgtctggaggaacagcagcattaggatgccttgtaaaagactactttcccgaaccagtaacagtatcatggaattcaggagctttaacaagtggagtacatacatttcctgctgtattacaatcaagcggattatattcattatcatcagtagtcacagtaccatcctcctcattaggaacacaaacctatatatgtaatgttaaccataaacctagcaacacaaaagtagataaaaaagttgaaccaaaaagctgtgacaaaacccatacatgccctccttgtccagcaccagaattactaggaggaccctccgtattcttattcccacctaaaccaaaagacaccttaatgatatcaagaacaccagaagtcacatgcgtagtagtagacgtctcacatgaagaccctgaagtaaaattcaattggtatgtagatggagtcgaagtacataacgcaaaaacaaaaccaagagaagaacaatataattcaacatatagagtagtatcagtattaaccgtattgcatcaagactggttaaatggaaaagaatataaatgtaaagtatcaaataaagctttaccagcaccaatcgaaaaaacaatatctaaagctaaaggtcaaccacgagaaccacaagtatacacattaccaccaagtagagacgaactaacaaaaaaccaagtttcattaacatgcctagttaagggattctatccatccgatatagcagtagaatgggaaagtaatggacaacccgaaaacaattacaaaacaacaccaccagtactagactccgacggtagttttttcttatactcaaaattaacagtcgacaaatcaagatggcaacaaggtaatgtattctcatgctctgtaatgcatgaaggactacacaatcattacacacaaaaaagcctttcactatccccaggaaaa

SEQ ID NO: 46933 - RNA, 642 nt, synthetic construct
  misc_feature 1..642: note = derived and/or modified sequence opt6 from Timigutuzumab_LightChain
  source 1..642: mol_type = other RNA
gacatccaaatgacacaatcaccatcatcactatcagcatccgtaggcgaccgagtaacaataacatgcagagcatcacaagacgtaaacacagccgtagcatggtaccaacaaaaaccaggaaaagcacccaaactacttatatactcagcatcattcctatactcaggagtaccatcaagattctcaggatcaagatcaggaacagacttcacattaacaatatcatccttacaaccagaagacttcgcaacatactactgccaacaacattacacaacaccaccaacattcggacaaggaaccaaagtagaaataaaacgaacagtagcagccccatcagtattcatattcccaccatccgacgaacaactaaaatcaggcacagcctcagtagtatgcctactaaacaacttctacccacgagaagcaaaagtacaatggaaagtagacaacgcactacaatcaggaaactcacaagaatctgtaacagaacaagactccaaagactcaacatactccctatcatcaacactaacattatcaaaagcagactacgaaaaacacaaagtatacgcatgcgaagtaacacaccaaggactatcatcaccagtaacaaaatccttcaacagaggagaatgc

SEQ ID NO: 46934 - RNA, 1332 nt, synthetic construct
  misc_feature 1..1332: note = derived and/or modified sequence opt6 from Timolumab_HeavyChain
  source 1..1332: mol_type = other RNA
caagtacaactagtagaatcaggaggaggagtagtacaaccaggaagatcactcagattaagctgtgcagcctcaggattcaccttcttttcgtatgcaatgcactgggtacgccaaactccaggaaaaggactagaatgggtagcagtcatatggttcgacggttctaatgaaaactatgtcgactccgtaaaaggacgctttaccatttcccgagataattcaaaaaacactctatatttacaaatgaacacacttagagcagaagatacagcagtatactattgcgcacgtgacgcatggtcttactttgactattggggacaaggaaccttagtaacagtaagctcagcctctacaaaaggcccatcagtatttcctttagccccttgttctcgatccacatcagaatcaacagctgcacttggatgtctagtaaaagactacttccccgaaccagttaccgtatcatggaactctggcgcactaacatcaggagtccatacattccccgccgtactacaatcatcaggattatactcactatcatcagtagtaactgtcccatcttcatcactaggaacaaaaacttacacatgtaacgttgatcataaaccatcaaatacaaaagtagacaaaagagtagaatcaaaatatggaccaccttgcccaccatgtcccgcaccagaattcgcaggaggaccatcagtatttttattcccaccaaaacctaaagatacattaatgatatctaggacaccagaagttacatgtgtcgttgtagacgtatcacaagaagaccctgaagttcaattcaattggtacgttgacggagtcgaagtacacaatgctaaaacaaaacccagagaagaacaattcaattccacataccgagtagtatccgtattaacagtactacaccaagattggttaaacggaaaagaatataaatgcaaagtaagcaataaaggactaccttcctcaatagaaaaaacaatatctaaagcaaaaggacaaccaagagaaccccaagtatatacattaccaccatcacaagaagaaatgacaaaaaaccaagtatcattaacatgtttagtaaaaggattttatccctcagatatagcagtagaatgggaatcaaacggacaacctgaaaataattataaaacaacacctccagtcctagattcagatggatcattctttttatattccagactaactgtagataaatcaagatggcaagaaggcaatgtcttttcatgttccgtaatgcacgaagcacttcacaaccattacacacaaaaatctttatccctttcactcggaaaa

SEQ ID NO: 46935 - RNA, 642 nt, synthetic construct
  misc_feature 1..642: note = derived and/or modified sequence opt6 from Timolumab_LightChain
  source 1..642: mol_type = other RNA
gtaatacaactaacacaatcaccatcttcactatccgcatcagtaggagacagagtaacaataacatgcagagcatcccaaggaatatcaagagcactcgcatggtaccaacaaaaaccaggaaaaggaccaaaactactaatatacgacgcatcatcactagaatcaggagtaccatcccgattctcaggatcaggctcaggaacagacttcacactaacaatatcatcattacaaccagaagacttcgcaacatactactgccaacaattcaactcataccctctaacattcggaggaggcacaaaagtcgaaataaaaagaacagtagcagcaccatcagtattcatattcccaccatcagacgaacaactaaaatcaggaacagcttcagtagtatgcctactcaacaacttctacccaagagaagcaaaagtacaatggaaagtagacaacgcactacaatcaggaaactcacaagaatccgtaacagaacaagactcaaaagactcaacatactcactatcatcaacactaacactatcaaaagcagactacgaaaaacacaaagtatacgcatgcgaagtaacacaccaaggcctatcatcaccagtaactaaatcctttaacagaggagaatgc

SEQ ID NO: 46936 - RNA, 1347 nt, synthetic construct
  misc_feature 1..1347: note = derived and/or modified sequence opt6 from Tomuzotuximab_HeavyChain
  source 1..1347: mol_type = other RNA
caagtacaactaaaacaatcaggaccaggcttagtacaaccttcccaatcactttcaataacatgtaccgtatcaggattctcattaacaaattacggtgtacattgggttcgacaatcaccaggaaaaggactagaatggctaggagtcatctggtccggcggcaacacagactataacaccccatttacttcaagattatcaattaacaaagataactcaaaatcacaagttttcttcaaaatgaatagtctccaatcaaatgatacagcaatatattactgcgcacgagcacttacctactacgattacgaattcgcatactggggacaaggtacactagttaccgtatcaacagcttcaaccaaaggaccatcagtattcccactcgcaccatcatccaaatcaacatcaggaggcactgcagccctaggttgcttagtcaaagactatttccccgaaccagtaacggtctcttggaattcaggcgctttaacatccggagtacacacattccccgcagtattacaatcatcaggcctctactcactatccagtgtagttacagtcccatcatcctcactaggaacacaaacatatatatgcaacgtaaaccataaaccaagcaacacaaaagtagacaaaaaagtagaacctaaatcatgcgacaaaacacatacatgcccaccatgccccgcaccagaactactaggaggtccatccgtatttttattcccccctaaacctaaagacacattaatgataagcagaacgccagaagtaacatgtgtagtagtagacgtatcacatgaagacccagaagtaaaatttaactggtacgtcgatggtgtagaagtacacaatgcaaaaaccaaaccaagagaagaacaatacaactccacttacagagtagtatcagtactaactgtattacaccaagactggctaaacggaaaagaatacaaatgcaaagtttcaaataaggcactcccagcccctatcgaaaaaacaatctctaaagcaaaaggccaacctcgagaaccacaagtatacacattaccaccatcccgtgacgaattaacaaaaaatcaagtatcacttacatgtttagtcaaaggcttttatccatctgacatagcagtagaatgggaatcaaacggacaacccgaaaacaattacaaaacaacaccacctgtactagattcagacggttcattctttctatactcaaaactaaccgtagacaaatctagatggcaacaaggtaacgtattctcatgctccgtcatgcatgaaggactacacaaccactacacccaaaaatcactatcattatcaccaggaaaa

SEQ ID NO: 46937 - RNA, 642 nt, synthetic construct
  misc_feature 1..642: note = derived and/or modified sequence opt6 from Tomuzotuximab_LightChain
  source 1..642: mol_type = other RNA
gatatattattaacacaaagcccagtaatactaagcgtaagcccaggagaacgagtatcatttagctgtagagcaagccaaagcataggaacaaacatacactggtaccaacaaagaacaaatggaagcccaaggctcttaattaaatacgcaagcgaaagcataagtggaataccaagcagattttcaggatcaggatcaggaacagactttaccttaagcataaactcagtagaaagcgaagacatagcagattactactgccaacaaaataacaattggccaaccacattcggagcaggaacaaaactagaattaaaaagaacagtagcagcaccaagcgtattcatattcccaccatcagacgaacaattaaaatcaggaacagcatcagtagtatgcttactaaataacttttatccaagagaagcaaaagtacaatggaaagtagataacgcactacaaagcggaaactcacaagaaagcgtaacagaacaagatagcaaagactcaacatattcattaagctcaacattaacactatcaaaagcagattacgaaaaacataaagtatacgcatgcgaagtaacacaccaaggattaagctcacccgtaacaaaatcatttaacagaggagaatgc

SEQ ID NO: 46938 - RNA, 1347 nt, synthetic construct
  misc_feature 1..1347: note = derived and/or modified sequence opt6 from Trastuzumab_duocarmazine_HeavyChain
  source 1..1347: mol_type = other RNA
gaagtacaattagttgaatcaggcggaggcctagtacaacctggaggatcactaagactaagctgcgcagcctcaggattcaatatcaaagacacatacatacattgggtaagacaagcaccaggaaaaggactcgaatgggtagctcgaatatatccaacaaatggatatactcgatatgcagactcagtaaaaggaagatttacaatatcagccgacacaagtaaaaacacagcataccttcaaatgaactcactaagagctgaagatacagcagtctattactgttcaagatggggcggagatggattctacgcaatggactactgggggcaaggtaccttagtaactgtatcatcagcatcaacaaaaggaccatccgtattcccattagcacccagctcaaaatcaacctcaggaggaacagcagcattaggatgcctagtaaaagattatttcccagaaccagtaacagtatcctggaactccggagccctaacctcaggagtccatacattcccagctgttctacaaagttccggattatattcattatcatcagtcgtaacagtaccatcatcatctctaggtacacaaacatacatatgcaatgtaaatcacaaaccatccaataccaaagtagataagaaagtcgaacccaaatcatgtgataaaacccacacatgtccaccctgcccagcaccggaactactaggaggaccatcagtattcctatttccaccaaaacctaaagacacactaatgatttcacgcacacccgaagtaacatgtgtcgtagtagacgtaagtcacgaagacccagaagtaaaattcaactggtatgtcgacggagtagaagtacacaacgcaaaaacaaaaccaagagaagaacaatacaattctacatacagagtcgtatcagtattaactgtactacaccaagattggttgaatggaaaagaatacaaatgcaaagtatccaacaaggcattaccagcaccaatagaaaagacaataagcaaagctaaaggtcaaccaagagaaccacaagtatacacactaccaccctcccgagaagaaatgactaaaaatcaagtctcattaacatgtctagttaaaggtttttacccttcggacatagctgtagaatgggaaagtaatggtcaacccgaaaacaactacaaaacaacaccaccagttctagactcagatggatcattctttctatactcaaaattaacagtagataaatccagatggcaacaaggtaacgtattttcttgctcagtaatgcatgaagctctacacaaccattacacacaaaaatcattatcattatcaccagga

SEQ ID NO: 46939 - RNA, 642 nt, synthetic construct
  misc_feature 1..642: note = derived and/or modified sequence opt6 from Trastuzumab_duocarmazine_LightChain
  source 1..642: mol_type = other RNA
gacatacaaatgacacaatcaccatcatctctatcagcatcagtaggagatcgagtaacaataacatgcagagcatcacaagacgtaaacacagcagtagcatggtaccaacaaaaacccggaaaagcaccaaaactactaatatactcagcatcattcctatactcaggcgtcccatcaagattctcaggatcaagatcaggaacagacttcacactaacaatatcatcactacaaccagaagacttcgcaacatactactgccaacaacactacaccacaccaccaacattcggacaaggaaccaaagtcgaaataaaacgcacagtagcagcaccaagcgtattcatattcccaccatcagacgaacaactaaaatcaggaaccgcctcagtcgtatgcctactaaacaacttctacccaagagaagctaaagtacaatggaaagtcgacaacgcactacaatcaggaaactcacaagaatccgtaacagaacaagactccaaagactcaacatactcattatcatcaaccctaaccctctcaaaagccgactacgaaaaacacaaagtatacgcatgcgaagtaacacatcaaggactatcatcaccagtaacaaaatcttttaacagaggagaatgc

SEQ ID NO: 46940 - RNA, 1368 nt, synthetic construct
  misc_feature 1..1368: note = derived and/or modified sequence opt6 from Varisacumab_HeavyChain
  source 1..1368: mol_type = other RNA
caagtacaattagtccaatccggcgcagaagtaaaaaaacctggagcctcagtaaaagtatcatgcaaagcatcaggaggaacattctcatcatatgcaatatcctgggtaagacaagcacctggacaaggactcgaatggatgggaggatttgaccctgaagacggagaaaccatatacgcacaaaaatttcaaggtcgagtaacaatgacagaagatacatcaacagacacagcatacatggaactatcctccttaagatcagaagacactgcagtttactactgcgctaccggaagatcaatggtaagaggagtaatcataccattcaatggaatggacgtatggggacaaggaacaactgtaactgtatcatcagcatcaaccaaaggaccaagcgtattccccctagcaccatcatcaaaatcaacatcaggaggaacagccgcactaggatgtttagtcaaagattatttccccgaacccgttacagtatcatggaatagtggcgcactaacaagtggagtacacacttttccagctgtacttcaatcatccggtttatattccttatcatcagtcgtcacagtaccatcttcttccttaggtacacaaacttatatatgcaacgtaaaccataaaccctccaatacaaaagtagataaaaaagtcgaacccaaatcatgtgacaaaacacatacatgtccaccttgccctgcaccagaattactaggaggcccctcagtatttctatttcctccaaaacctaaagacacattaatgatatcacgcacaccagaagtaacatgcgttgtagtagacgtatcacatgaagacccagaagttaaattcaattggtacgtcgacggagtagaagtacacaatgcaaaaacaaaaccaagagaagaacaatataactcaacatatagagtagtatccgtgcttactgtcttacatcaagactggttaaacggaaaagagtacaaatgtaaagtatcaaacaaagctcttccagcaccaatagaaaaaaccatatcaaaagcaaaaggacaacccagagaaccacaagtttacactctcccaccatcccgagatgaattgaccaaaaaccaagtatctcttacatgcctagtaaaaggattctacccttccgatatcgcagtagaatgggaaagcaacggccaacccgaaaacaattacaaaacaactcctccagtactcgattctgatggatcattctttctttactcaaaattaacagtagacaaaagtagatggcaacaaggtaacgtattttcttgttccgtaatgcacgaagcattacacaaccactatacccaaaaatcattatcactctcacccggaaaa

SEQ ID NO: 46941 - RNA, 642 nt, synthetic construct
  misc_feature 1..642: note = derived and/or modified sequence opt6 from Varisacumab_LightChain
  source 1..642: mol_type = other RNA
gacataagaatgacacaatcaccatcttcactatcagcatcagtaggagaccgagtaacaataacatgcagagcatcacaatcaatatcatcttacctaaactggtaccaacaaaaaccaggaaaagcacctaaactacttatatatgcagcatcatctctacaatcaggagtaccatccagattcagtggatccggatcaggaacagacttcacactaacaatatcatcactacaaccagaagacttcgcaacatactattgccaacaatcatactcaaccccattaacattcggaggaggaacaaaagtagaaataaaaagaacagtagcagcaccatccgtattcatattcccaccatcagacgaacaactaaaatcaggaacagcatcagtagtatgcctattaaataacttttacccacgagaagcaaaagtacaatggaaagtcgacaacgcactacaatcaggaaactcacaagaatcagtaacagaacaagactcaaaagactcaacatacagcctatcctcaacactaaccctatcaaaagccgactacgaaaaacacaaagtatacgcatgcgaagtaacccaccaaggactaagttcacccgtaactaaatcattcaacagaggagaatgc

SEQ ID NO: 46942 - RNA, 1359 nt, synthetic construct
  misc_feature 1..1359: note = derived and/or modified sequence opt6 from Vunakizumab_HeavyChain
  source 1..1359: mol_type = other RNA
gaagtacaattagttcaatcaggagctgaagtcaaaaaaccaggagcatctgtaaaagtatcatgtaaagcatctggatacacattcacagactacgaagtccattgggtaagacaagcaccaggacagggcctagaatggatgggagtaatagatccaggcacaggtggagtagcatacaaccaaaaattcgaaggaagggtcacaatgacagctgatacatcaacctcaacagcatatatggaactacgttcactcagatcagacgacactgcagtctattactgcacaagatattcactcttctacggatccagtccatacgcaatggactactggggacaaggaacacttgtaaccgtttcatcagcatcaacaaaaggaccatcagtattcccactagcaccctcatcaaaatcaacatcaggaggaaccgccgccttaggatgcttagtaaaagactatttcccagaacctgtcactgtatcatggaattccggtgcacttacaagcggagtacacacatttccagcagtactacaatcatccggactatactccctttcatcagtagtaacagtaccaagctcaagcctaggaacacaaacttatatatgcaacgtaaatcacaaaccatcaaacacaaaagtagacaaaaaagtagaacccaaatcatgcgataaaacccacacttgcccaccatgtccagcacctgaactattaggaggaccttcagtattcctattcccacctaaaccaaaagatacactaatgataagtagaaccccagaagtaacatgcgtcgtagtagatgtatcacacgaagacccagaagtaaaatttaactggtatgtggatggagtagaagtacataatgctaaaacaaaaccacgagaagaacaatataattcaacatatagagtagtatccgtacttacagtcctgcaccaagactggctaaacggtaaagaatataaatgtaaagtaagtaataaagccttaccagcaccaatagaaaaaacaatatccaaagcaaaaggacaaccaagagaaccacaagtatatacactcccaccttcgagagaagaaatgaccaaaaatcaagtatcactaacatgtctagttaaaggattctatccatcagatattgcagtagaatgggaatcaaatggacaaccagaaaataattataaaacgacaccaccagtattagactcagatggatcattcttcttatattcaaaacttacagttgataaatcaagatggcaacaaggaaacgtattcagttgttccgtaatgcatgaagccttacataaccactatacacaaaaaagtttaagcctaagtccaggaaaa

SEQ ID NO: 46943 - RNA, 639 nt, synthetic construct
  misc_feature 1..639: note = derived and/or modified sequence opt6 from Vunakizumab_LightChain
  source 1..639: mol_type = other RNA
gaaatagttctaacacaatcaccagacttccaatcagtaacaccaaaagaaaaagtaacaataacatgctcagcatcatcatcagtaaactacatgcattggttccaacaaaaaccagaccaatccccaaaattatggatatacagaacatcaaacctagcatcaggagtaccatcaagattttcaggatcaggatccggaacagactacacactaacaataaactcactagaagctgaagacgcagccacatactactgtcaacaaagatcctcctacccatggacattcggacaaggaacaaaactagaaatcaaaagaacagtagcagcaccatcagtattcatattcccaccatcagacgaacaactaaaatcaggcacagcatcagtcgtatgcctactaaacaacttctacccacgcgaagcaaaagtacaatggaaagtagataacgcactacaatcaggaaactcacaagaatcagtaacagaacaagactcaaaagactcaacatactcactatcatcaacactaaccctatcaaaagcagactacgaaaaacacaaagtatatgcatgcgaagtaacacaccaaggattatcatcaccagtaacaaaatcattcaacagaggagaatgc

SEQ ID NO: 46944 - RNA, 1341 nt, synthetic construct
  misc_feature 1..1341: note = derived and/or modified sequence opt6 from Xentuzumab_HeavyChain
  source 1..1341: mol_type = other RNA
caagtagaattagtagaatcaggaggaggattagttcaacccggaggatcactaagattatcatgcgcagcatcaggatttacattcacatcatattggatgtcatgggtaagacaagcaccaggcaaaggtctagaattagtctcatcaatcacttcatacggatcattcacctactacgcagacagtgtaaaaggacgtttcacaatttcaagagacaactccaaaaacaccctttatttacaaatgaattctttaagagctgaagataccgctgtctactactgcgcaagaaacatgtatacacattttgattcttggggacaaggaacactagtaacagtttcatctgcctcaacaaaaggaccatctgtatttccattagcaccttcatcaaaatcaacctcaggaggaacagccgcattaggatgtttagtaaaagattacttcccagaaccagtaacagtatcatggaactctggagccctaacatcaggtgtacacacttttccagctgtactacaatccagtggactatattcactatcatctgtagtaacagtaccatcaagctcactaggaacacaaacttacatatgtaacgtaaatcacaaaccttcaaacacaaaagttgataaaaaagtagaaccaaaaagttgcgataaaacccatacttgccccccatgtccagcccctgaattattaggaggcccatcagtattcctcttccctccaaaacccaaagacaccctaatgatatcaagaacaccagaagtaacctgtgtagtagtagacgtatcacacgaagatccagaagtaaaatttaattggtacgtcgacggagtggaagtacacaatgcaaaaacaaaacctagagaagaacaatacaattccacctatagagtcgtctctgttctaaccgtattacaccaagactggctaaacggcaaagaatacaaatgcaaagtatcaaacaaagcactaccagcacctatcgaaaaaacaatatccaaagccaaaggccaacccagagaaccacaagtatatacacttccaccctcaagagacgaacttacaaaaaaccaagtttctctaacatgtttagtcaaaggattctacccctccgacatagcagtagagtgggaatcaaacggacaaccagaaaacaactacaaaacaacacctccagtactagactctgacggctcattcttcttatactcaaaactcactgtagacaaatcaagatggcaacaaggcaatgtcttctcatgctctgtaatgcatgaagcactacacaatcactacacacaaaaatcactatctctctcaccaggaaaa

SEQ ID NO: 46945 - RNA, 648 nt, synthetic construct
  misc_feature 1..648: note = derived and/or modified sequence opt6 from Xentuzumab_LightChain
  source 1..648: mol_type = other RNA
gacatagtactaacacaaccaccatcagtatcaggagcaccaggacaaagagtaacaatatcatgctcaggctcaagctcaaacataggatcaaactctgtatcctggtaccaacaactcccaggaacagcacccaaattactaatatacgacaactcaaaaagaccatcaggagtaccagacagattcagtggatcaaaatcaggaacatcagcatcactagcaataacaggactacaatcagaagacgaagcagactactactgtcaatcaagagacacatacggatactactgggtattcggaggaggaacaaaattaacagtcctcggacaaccaaaagcagcaccatcagtaacactattcccaccatcaagcgaagaactacaagcaaacaaagcaacactcgtatgcctaatatcagacttttacccaggagcagtaacagtagcatggaaaggagactcatcaccagtaaaagcaggagtagaaacaaccacaccatcaaaacaatcaaacaacaaatacgcagcatcatcatacctatcattaacaccagaacaatggaaatcacacagaagttatagctgccaagtaacacacgaaggaagcacagtagaaaaaacagtagcaccaaccgaatgctca

SEQ ID NO: 46946 - RNA, 726 nt, synthetic construct
  misc_feature 1..726: note = derived and/or modified sequence opt6 from anti-rabies_SO57_LightChain
  source 1..726: mol_type = other RNA
atgtcagtaccaacaatggcatgggcattactactattatcactactaacacaaggaacaggcagttgggcacaatcagcactaacacaaccaagatcagtatccggatcaccaggacaatccgtaacaatatcatgcacaggaacatcatcagatataggaggatacaattttgtatcatggtaccaacaacacccaggaaaagcaccaaaactaatgatatacgacgccacaaaaagaccaagcggagtaccagatagattttcaggatcaaaatcaggcaacacagcatcactaacaatatcaggattacaagcagaagacgaagcagactactactgctgctcatatgcaggagactacacaccaggagtcgtattcggaggaggaacaaaactaacagtactaggacaaccaaaagcagcaccatcagtaacactattcccaccatcatcagaagaattacaagcaaacaaagcaacactagtatgcctaatatcagacttctacccaggagcagtaacagtagcatggaaagcagatagctcaccagtaaaagcaggagtagaaacaacaacaccatcaaaacaaagcaacaataaatacgcagcatcatcatacttatctttaacaccagaacaatggaaatcacacagatcatacagctgtcaagtaacacacgaaggatcaacagtcgaaaaaacagtagcaccaacagaatgctca

SEQ ID NO: 46947 - RNA, 1428 nt, synthetic construct
  misc_feature 1..1428: note = derived and/or modified sequence opt6 from anti-rabies_SO57_HeavyChain
  source 1..1428: mol_type = other RNA
atggactggacatggcgatttttatttgttgtagctgcagccacaggagtccaatcacaagtacaattagtgcaatcaggagctgaagtaaaaaaaccaggttcatcagtaaaagtaagttgcaaagcctcaggaggaaccttcaatagatacacagtaaactgggtaagacaagcaccaggacaaggactagaatggatgggcggaataatcccaatctttggtacagcaaactatgcacaaagatttcaaggacgattaactataacagcagatgaaagcacctcaacagcatacatggaattatcatcactacgatcagacgacacagcagtatatttctgcgcacgagaaaatctagataattcaggtacatattattacttcagtggatggtttgatccatggggccaaggaacattagtaacagtgtcatcagcatcaacaaaaggaccttcagtcttccccttagcaccatcaagcaaatccacatcaggaggaactgcagcactaggatgcttagtcaaagattatttcccagaacccgtaacagtatcatggaactcaggagcactaacaagtggggtacatacattcccagcagtactacaatcatcaggactatactcattatcatcagtagtaaccgtcccaagtagcagtctaggaactcaaacctatatatgcaacgtaaaccacaaaccgtcaaataccaaagtcgacaaaagagtagaaccaaaaagttgcgacaaaactcacacatgtccaccttgcccagcaccagaattacttggaggaccatcagtatttttatttccaccaaaaccaaaagataccttaatgatatcacgcacacctgaagtaacatgcgtagtagtagacgtaagccatgaagaccctgaagtaaaatttaattggtacgttgatggagtagaagttcacaacgcaaaaacaaaaccaagagaagaacaatacaactcaacatatagagtagtctcagtattaacagtcttacaccaagactggttaaacggaaaagaatataaatgcaaagtatccaataaagcattaccagcacccatagaaaagacaataagcaaagcaaaaggacaacctagagaaccacaagtatacacattaccacccagcagagaagaaatgacaaaaaaccaagtaagcctaacatgtctcgtcaaaggattctacccatcagacatcgcagtagaatgggaatcaaacggacaacccgaaaacaactataaaacaacacctccagtactagactcagacggatcattcttcttatactcaaaactaacagtcgataaatcaagatggcaacaaggaaatgtattttcatgcagtgtaatgcacgaagcactacataatcactatacccaaaaatcattatcattaagtcccggaaaa

SEQ ID NO: 46948 - RNA, 696 nt, synthetic construct
  misc_feature 1..696: note = derived and/or modified sequence opt6 from anti-rabies_SOJB_LightChain
  source 1..696: mol_type = other RNA
atggcatggaccgtattactattaggactactaagccactgcacaggatcagtaacaagctacgtcctaacacaaccaccatcagtatcagttgccccaggtaaaacagcaagaataaactgcggaggaaataacatagaatacagatcagtacattggtatcaacaaaaaagcggacaagcacccgtagcagtaatatacgacaacagcgacagaccaagcggaataccagaaagattctcaggctcaaaatcaggaaatacagcaacactaacaatatcaagagtcgaagcaggagatgaagccgactattattgccaagtatgggacatatcatcagacgtagtattcggtggaggaacaaaattaacagtactaggacaaccaaaagcagcaccaagtgtaacattattcccaccatcatcagaagaattacaagcaaacaaagcaacactagtatgcctaatatcagacttttacccaggagcagttacagtagcatggaaagcagactcatcaccagtaaaagcaggagtagaaacaaccacaccctcaaaacaaagcaacaacaaatacgcagcatcatcatacctatcattaacaccagaacaatggaaatcacacagatcatacagttgccaagtaacacacgaaggatcaacagttgaaaaaacagtagcaccaacagaatgcagt

SEQ ID NO: 46949 - RNA, 1554 nt, synthetic construct
  misc_feature 1..1554: note = derived and/or modified sequence opt6 from anti-rabies_SOJB_HeavyChain
  source 1..1554: mol_type = other RNA
atggacacattatgctcgacattactcctcttaaccataccatcttgggtactatcacaaattacacttaaagaaacaggaccaacattagtaaaaccaactcaaacattaacactaacctgcacattctccggattttcactatcaacatcaggagttggagttggatggatcagacaacccccaggtaaagccctagaatgggtaacattaatatactgggacgatgataaaagatactcaccatctttagaaaacagagtaacaatacgaaaagacacatcaaaaaatcaagtagcattaacaatgactaatatggatccactcgatactggaacatactactgtgcccatcgacaacatatatcctcctttccttggttcgacagctggggacaaggtacactagtaacagtctcatctgcatcaaccaaaggaccatctgtattcccactagcaccttgctcccgatccacatccggaggcacagcagcacttggttgtttagtaaaagattatttcccagaaccagtaacagtatcatggaattcaggagccctaacatcaggtgtccacacctttcccgctgtattacaaagttccggattatattcactttcaagtgttgtaacagttccttcatcatctctaggaactcaaacttacacatgcaacgtcaaccataaaccctcaaatacaaaagtagataaaagagtagaattaaaaacaccactaggcgatacaacacacacctgtcctcgctgtccagaaccaaaatcatgtgacacaccaccaccatgcccaagatgtccagaaccaaaatcatgcgacacaccaccaccatgtcctagatgcccagaacccaaatcctgcgacactccaccaccatgcccaagatgccccgccccagaactactaggaggcccaagcgtttttctattcccccctaaacctaaagacacattaatgatatcaagaaccccagaagtaacctgcgtagtagttgacgtttcacacgaagacccagaagtccaattcaaatggtacgttgacggcgtagaagtacataacgcaaaaacaaaaccaagagaagaacaatttaactctactttcagagtagtctcagtactcacagttttacaccaagactggctaaacggaaaagaatacaaatgtaaagtatctaacaaagcacttccagccccaatagaaaaaaccatatctaaaacaaaaggacaacctagagaaccacaagtttatacactacccccatcacgagaagaaatgacaaaaaaccaggtttcattaacctgcctagtaaaaggtttctatccatcagacatagcagtagaatgggaatcatcaggccaacccgaaaacaattacaacactacacctccaatgctcgactcagacggatcctttttcctatattcaaaactcacagtagataaatcacgatggcaacaaggaaatatcttctcctgctcagtaatgcatgaagccctacacaaccgattcacccaaaaatccttatctctatcgccaggaaaa

SEQ ID NO: 46950 - RNA, 702 nt, synthetic construct
  misc_feature 1..702: note = derived and/or modified sequence opt6 from anti-rabies_SOJA_LightChain
  source 1..702: mol_type = other RNA
atggaagcacccgcacaactactattcctactactcctatggctaccagacacaacaggagaaatagtactaactcaatcaccagcaacattatccttatcaccaggagaaagagcaacattagcatgcagagcatcacaaacagcatcaagatacttagcatggtaccaacaaaaaccaggacaagcaccaagactattaatatacgacacatcaaacagagcaacaggaataccagccagattctccggatcaggatcaggaacagacttcacattatcaatatcatcactagaacccgaagacttcgcagtatattactgccaacaaagattcaactggccatggaccttcggacaaggaacaaaagtagaatttaaaagaacagtagcagcaccatcagtattcatattcccaccatcagacgaacaactaaaatctggcacagcatctgtagtctgcttactaaacaacttctaccccagagaagccaaagtccaatggaaagtagacaacgcactacaatcaggaaactcacaagaatcagtaactgaacaagactcaaaagactcaacatacagcctatcatcaaccctaacactatcaaaagctgactacgaaaaacacaaagtctatgcatgtgaagtaacacaccaaggactatcatccccagtaacaaaatcttttaacagaggagaatgc

SEQ ID NO: 46951 - RNA, 1422 nt, synthetic construct
  misc_feature 1..1422: note = derived and/or modified sequence opt6 from anti-rabies_SOJA_HeavyChain
  source 1..1422: mol_type = other RNA
atggaatttggtctctcatggttattcctagtcgcaatattaaaaggagtacaatgcgaagtacaactactagaatccggcggaggattagttcaacctggaggaagtctaagactatcatgtgcagcatcaggatttacattcagtaactatgcaatgtcttgggtacgacaagcaccaggaaaaggtctagaatgggtaagtgcaatcagtgcctcaggacatagcacatatctagctgactcagtaaaaggacgtttcactatatccagagacaatagtaaaaacactctatacctacaaatgaatagtttacgagccgaagacacagcagtatactattgtgcaaaagacagagaagtaacaatgatagtagtcttaaacggaggattcgactattggggacaaggaacaagagtaacagtatcatcagcttcaacaaaaggaccaagcgtattcccattagctccatcatccaaatctacctcaggaggaacagccgctttaggttgcttagttaaagactatttcccagaacctgtaaccgtatcatggaatagcggagcactgacctcaggcgtacatacttttccagctgtactacaatcaagtggattatatagtctatctagcgtagtaaccgttccaagctcatcattaggaacacaaacctatatatgtaatgttaatcataaaccatctaatacaaaagtcgataaacgagtcgaaccaaaatcatgtgacaaaacacatacatgcccaccctgtcccgctccagaattactaggtggtccctcagtattcttattcccaccaaaaccaaaagatactttaatgatatcaagaacaccagaagtcacttgcgtagtagttgatgtctcacacgaagacccagaagtaaaatttaactggtacgtagacggagtagaagtacataatgcaaaaacaaaaccaagagaagaacaatacaacagcacatacagagtagtatccgtattaacagtacttcaccaagactggctaaacggaaaagaatataaatgtaaagtatcaaacaaagcattacctgcaccaatagagaaaacaatctcaaaagccaaaggtcaaccacgagaaccacaagtatatactctacccccatcacgtgaagaaatgactaaaaatcaagtaagtcttacatgcttagtcaaaggtttctatccttctgatatagccgtagaatgggaatcaaacggacaaccagaaaacaattacaaaacaacaccaccagtattagatagcgatggttccttctttttatacagcaaattaactgtcgacaaatcaagatggcaacaaggaaatgtattctcatgttcagtaatgcatgaagcactacacaatcactatactcaaaaatcattatcactaagcccaggcaaa

SEQ ID NO: 46952 - RNA, 321 nt, synthetic construct
  misc_feature 1..321: note = derived and/or modified sequence opt6 from anti-rabies_LightChain
  source 1..321: mol_type = other RNA
gtaatgacacaatcaccagcaacattatcattaagcccaggagaaagagcaacattaagctgtagagcaagccaaagcgtaagaaattacttagcatggtaccaacaaaaaccaggacaagcaccaagactattaatatatggagcaagcaatagagcaacaggaataccagcaagattcagcggatcaggatcaggaacagactttacattaacaataagctcactagaaccagaagactttgcagtatactattgccaacaaagatcagattggccactatcattcggacaaggaacaaaactagaaataaaaagaaca

SEQ ID NO: 46953 - RNA, 333 nt, synthetic construct
  misc_feature 1..333: note = derived and/or modified sequence opt6 from anti-rabies_HeavyChain
  source 1..333: mol_type = other RNA
ggaccagcatgggaagtaccagaaacactaccagtacaaccattagactcaccatcagtagcaatggcatgcacaggagtaagacaagcaccaggaaaaggattagaatgggtagcagtaataagttatgacggaagtaataaatattacgcagactcagtaaaaggaagatttacaatatcaagagataatagtaaaaatacattatatttacaaatgaactcactaagagcagaagacacagcagtatactattgtgcaaaagattcaaatagtggaagttattatgcacatgatttaggatactggggacaaggaacattagtaacagta

SEQ ID NO: 46954 - RNA, 342 nt, synthetic construct
  misc_feature 1..342: note = derived and/or modified sequence opt6 from anti-rabies_LightChain
  source 1..342: mol_type = other RNA
gaattagtaatgacacaatcaccactatcactaccagtaacactaggacaaccagcatcaatatcatgcagatcatcacaatcactaatacactcaaacggaaacacatacctaaactggttccaacaaagaccaggacaatcaccaagaagactaatatacaaagtatcagacagagactcaggagtaccagacagattctcaggatcaggatcaggaacagacttcacactaaaaatatcaagagtagaagcagaagacgtaggagtatactactgcctacaaggaacacactggccaagaacattcggacaaggaacaaaactagaaataaaaagaaca

SEQ ID NO: 46955 - RNA, 351 nt, synthetic construct
  misc_feature 1..351: note = derived and/or modified sequence opt6 from anti-rabies_HeavyChain
  source 1..351: mol_type = other RNA
gtagtacaaccaggaagatcactaagactatcatgcgcagcatcaggatttacatttagctcatacgcaatgcattgggtaagacaagcaccaggaaaaggactagaatgggtagcagtaataagctatgacggaagcaataaatattacgcagactcagtaaaaggaagattcacaatatcaagagataacagcaaaaatacattatacttacaaatgaactcactaagagcagaagacacagcagtatactattgcgcaagagataaagcactagcagcaagaagaggatactattactattacggaacagatgtatggggacaaggaacattagtaacagtatcatca

SEQ ID NO: 46956 - RNA, 648 nt, synthetic construct
  misc_feature 1..648: note = derived and/or modified sequence opt6 from anti-RSV_5ITB_LightChain
  source 1..648: mol_type = other RNA
tcagacatacaaatgacacaatccccatcaacattatcagcatcagtaggagacagagtaacaataacatgcagagcatcacaatcaatatcatcatggctagcatggtaccaacaaaaaccaggaaaagcaccaaaattactcatatacgacgcatcatcactagaatcaggagtaccatctagattctccggatcaggatcaggaacagaattcacactaacaatatcatcattacaaccagacgacttcgcaacatactactgccaacaatacaacacatactcatggtggacattcggacaaggaacaaaagtagacataaaaagaacagttgcagcaccatcagtattcatattcccaccatcagacgaacaactaaaatcaggaacagcatcagtagtatgcttattaaacaacttctacccaagagaagcaaaagtacaatggaaagtagacaacgcactacaatcaggaaactcacaagaatccgtaacagaacaagactcaaaagactcaacttacagcctaagctcaaccctaacactatccaaagcagactacgaaaaacacaaagtatacgcatgcgaagtaacacaccaaggcctatcatcaccagtaacaaaatcattcaacagaggagaatgc

SEQ ID NO: 46957 - RNA, 660 nt, synthetic construct
  misc_feature 1..660: note = derived and/or modified sequence opt6 from anti-RSV_5ITB_HeavyChain
  source 1..660: mol_type = other RNA
gtagaaagtggaggaggattaatacaacccggaggatcattaagattatcatgcgcagtatcaggattcacagtatcatcaaaatatatgacatgggtaagacaagcaccaggaaaaggactagaatgggtatcagttatttacggaggaggatcaacatattatgcagattcagtagtaggaagattcacaatatcaagagataacagtaaaaatacattatacttacaaatgaactcattaagagcagaagatactgcagtatactactgcgcaagcagattaggagtaagagcaacaacaggagatttagactattggggacaaggtacattagtaactgtatcaagcgcatcaactaaaggaccatcagtatttccattagcaccatcatcaaaatcaacatcaggaggaacagcagcattaggatgtttagtaaaagattactttcctgaaccagttacagtaagttggaatagtggtgcactaacatcaggagtacatacattcccagcagtattacaatcatccggtttatattcattaagttcagtagtaacagtaccaagtagctcactaggaacacaaacatatatatgtaatgtaaatcataaaccatcaaatacaaaagtagataaaagagtagaaccaaaatcatgt

SEQ ID NO: 46958 - RNA, 639 nt, synthetic construct
  misc_feature 1..639: note = derived and/or modified sequence opt6 from anti-alpha-toxin_4U6V_LightChain
  source 1..639: mol_type = other RNA
gacatacaaatgacacaatcaccatcaacactatcagcctcagtaggagacagagtaacaataacatgcagagcatcacaatcaatatcatcctggctagcatggtaccaacaaaaaccaggaaaagcaccaaaactactcatatacaaagcaagttcactagaatcaggagtaccatcaagattctcaggatcaggctcaggaacagaatttacattaacaatatcatcactacaaccagatgacttcgcaacatactactgtaaacaatatgcagactactggacattcggacaaggaacaaaagtagaaataaaaagaacagtagcagcaccatcagtcttcatattcccaccctcagacgaacaactaaaatcaggaacagcatcagtagtatgtctattaaacaacttttacccaagagaagcaaaagtccaatggaaagtagacaacgcactacaatcaggaaactcacaagaatcagtaaccgaacaagactcaaaagactcaacatactcattatcatcaacactaacactatcaaaagcagactacgaaaaacacaaagtatacgcatgcgaagtaacacaccaaggactatcatcaccagtaacaaaatcattcaacagaggagaatgc

SEQ ID NO: 46959 - RNA, 675 nt, synthetic construct
  misc_feature 1..675: note = derived and/or modified sequence opt6 from anti-alpha-toxin_4U6V_HeavyChain
  source 1..675: mol_type = other RNA
gaagtacaattagtagaaagcggaggaggattagtacaaccaggaggaagtttaagattaagttgtgcagcaagtggatttacatttagtagtcatgatatgcattgggttagacaagcaacaggaaaaggactagaatgggtatcaggaataggaacagcaggagatacatattatccagactcagtaaaaggaaggtttacaatatcaagagaaaatgcgaaaaatagtttatatctacaaatgaatagtttaagagcaggagatacagcagtatattattgtgcaagagatagatattcaccaacaggacattattatggaatggatgtatggggacaaggaacaacagtaacagtaagcagtgcatcaacaaaaggaccaagtgtatttccgctagcaccatcaagtaaaagtacatcaggaggaacagcagcattaggatgcttagttaaagattattttccagaaccagttacagtttcatggaatagtggggcattaacaagtggagtacatacattcccagcagtactacaaagctcaggactatattcattaagtagtgtagtaacagtaccaagttcaagtttaggtacacaaacatatatatgtaatgtaaatcacaaaccatcaaatacaaaagtagataaaagagtagaaccaaaatcatgt

SEQ ID NO: 46960 - RNA, 879 nt, synthetic construct
  misc_feature 1..879: note = derived and/or modified sequence opt6 from anti-alpha-toxin_4U6V_Chain-A
  source 1..879: mol_type = other RNA
gcagacagtgacataaacataaaaacaggaacaacagacataggatcaaacacaacagtaaaaacaggagacttagtaacatacgacaaagaaaacggaatgcacaaaaaagtattctacagcttcatagatgacaaaaaccacaacaaaaaactactagtaataagaacaaaaggaacaatagcaggacaatatagagtatactcagaagaaggtgcaaacaaatcaggactagcatggccaagcgcattcaaagtccaactacaactaccagataacgaagtagcacaaataagtgactactacccacgaaactcaatagatacaaaagaatacatgtcaacactaacctacggatttaacggaaacgtaaccggagacgacaccggaaaaataggaggactaataggagcaaatgtcagtatcggacacacactaaaatacgtacagccagacttcaaaacaatattagaaagcccaacagacaaaaaagtaggatggaaagtaatattcaacaacatggtaaatcaaaactggggaccatacgatagagattcatggaatccagtatacggaaatcaactcttcatgaaaacaagaaacggctcaatgaaagcagcagataacttcttagaccccaacaaagcctcatcactcttatcatcaggattctcaccagactttgcaacagtaataacaatggacagaaaagcaagcaaacaacaaacaaacatcgacgtaatatacgaaagagtcagagacgactaccaattacactggacatcaacaaactggaaaggaacaaacactaaagacaaatggatagatagatcatcagaaagatacaaaatagactgggaaaaagaagaaatgacaaat

SEQ ID NO: 46961 - RNA, 879 nt, synthetic construct
  misc_feature 1..879: note = derived and/or modified sequence opt6 from anti-alpha-toxin_4U6V_Chain-B
  source 1..879: mol_type = other RNA
gcagactcagacataaacatcaaaacaggaacaacagacataggatcaaacaccacagtaaaaacaggagatctagtaacatatgacaaagaaaatggaatgcacaaaaaagtattctactcatttatagacgacaaaaatcacaacaaaaaattactagtaattagaacaaaaggaacaatagcaggacaatacagagtatactcagaagaaggagcaaacaaatcaggactagcatggccatcagcattcaaagtacaactacaactaccagacaacgaagtagcacaaataagcgactactacccaagaaactcaatagacacaaaagaatacatgagtacattaacatacggattcaacggaaacgtaacaggagacgacacaggaaaaataggaggactaataggagccaacgtatcaataggacacaccctaaaatacgtacaaccagacttcaaaacaatactagaaagtcccacagacaaaaaagtaggatggaaagtaatattcaacaacatggtaaaccaaaactggggaccatacgacagagacagctggaacccagtatacggaaaccaactattcatgaaaacaagaaacggatcaatgaaagcagcagataacttcttagatccaaacaaagccagctcactactaagttcaggattcagtccagacttcgccacagtaataacaatggacagaaaagcatcaaaacaacaaacaaacatagatgtaatatacgaaagggtaagagacgactaccaacttcactggacatcaacaaactggaaaggaacaaatacaaaagacaaatggatagaccgatccagcgaaagatacaaaatagattgggaaaaagaagaaatgacaaac

SEQ ID NO: 46962 - RNA, 642 nt, synthetic construct
  misc_feature 1..642: note = derived and/or modified sequence opt6 from anti-IsdB_5D1Q_Chain-A
  source 1..642: mol_type = other RNA
gacatacaactaacacaatcaccatcatcagtatccgcatcagtcggcgacagaataacaataacatgcagagcatcacaagacatatccaactgggtagcctggtaccaacaaaaaccaggaaaagcaccaaaactcttaatatactcagcatcatcactacaatcaggagtaccatcaagattctcaggatcaggatcaggaacagacttcaccctaaccatatcatcactacaaccagaagacttcgcaacatactactgccaacaagcaaacacattcccatggacatttggacaaggaacaaaagtcgaaataaaaagaacagtagcagcaccatcagtattcatattcccaccctcagacgaacaactaaaatcaggaacagcatcagtagtatgtctactcaacaacttctacccaagagaagcaaaagtacaatggaaagtcgacaacgcactacaatcaggaaactcacaagaatcagtaacagaacaagattcaaaagactcaacatactccctatcctcaacattaacactatcaaaagcagactacgaaaaacacaaagtatacgcatgcgaagtaacacatcaaggactatcatcaccagtaacaaaatcattcaacagaggagaatgc

SEQ ID NO: 46963 - RNA, 783 nt, synthetic construct
  misc_feature 1..783: note = derived and/or modified sequence opt6 from anti-IsdB_5D1Q_Chain-B
  source 1..783: mol_type = other RNA
caagtacaattagtacaatcaggtgcagaagtaaaaaaaccagcatcaagtgtaaaagtatcatgtcaagcatcaggaggatcattctcaacaagaacaatatcatggctaagacaagcccccggacaaggcctagaatggatgggaggaatatcaccaatatttggagcagcaaactacgcacaaagatttcaaggaagagtaacaataacagcagataaatcaacatcaacagcatatatggaactaacatcattaacatcagaagatacagcagtatattactgcgcaagagacagaccaccaggagcacaatttgacacatggggacaaggtacattagtaacagtatcatcagcatcaactaaaggcccaagcgtattcccattagcaccatcatcaaaaagcacctcaggaggaacagcagcattaggatgcctagtaaaagattactttccagaaccagttacagtttcatggaacagcggagcactaacatcaggagtacacacatttcctgcagtattacaatcatcaggcctatactcattatcatcagtagtaacagtaccaagttcaagtctaggaacacaaacatacatatgtaacgtaaaccataaaccatccaatacaaaagtagacaaaaaagtagaaccaaaatcatgtggaggaggatccggacaccaccatcaccatcaccatcaccatcacggcggagactataaagaccatgacggagactataaagatcatgacatagattacaaagatgatgacgataaa

SEQ ID NO: 46964 - RNA, 822 nt, synthetic construct
  misc_feature 1..822: note = derived and/or modified sequence opt6 from anti-IsdB_5D1Q_Chain-C
  source 1..822: mol_type = other RNA
gaagtacaattagttgaatcaggaggaggactcgtacaaccaggaggatcattaacactaagttgcgcagcaagtggattaattttttcagattcaacaatgcattgggtaagacaagcatcaggaagaggattagaatgggtcgcaagaattagaagtaaagcaaacaattacgcaacatcatcagacaaatcagcaacagcatacctagcatcagtaaaaggaagatttacaatttcaagagacgattcaaaagacactacatttttagaaatgagttcattaaaaatagaagatacagcagtatattactgtatagcaagttcaacaacaggatggtacgtaagagaagatttcgactattggggacatggaacattagtaacagtaagtagcgcatcaacaaaaggaccatcagtatttccactagcacctagcagcaaaagcacaagtggaggcacagcagccttaggatgtctagtaaaagattactttccagaaccagtcacagtatcatggaattcaggagcattaacatcaggtgtacatacatttccagcagtactacaaagttcaggattatattcactatcatcagtagtaacagttccatcaagcagtctaggaacacaaacatatatatgtaacgtaaaccataaaccatcaaacacaaaagtagataaaaaagtagaaccaaaatcatgtggaggaggatcaggacatcaccatcaccatcaccatcaccatcacggaggagattataaagaccatgacggagactataaagatcatgatatagattataaagacgatgatgacaaa

SEQ ID NO: 46965 - RNA, 648 nt, synthetic construct
  misc_feature 1..648: note = derived and/or modified sequence opt6 from anti-IsdB_5D1Q_Chain-D
  source 1..648: mol_type = other RNA
gaaatagtactcacacaaagcccaggaacattaagcctaagcccaggcgaacgagcaacactatcatgtcgagcatcacaaagcgtaagctcaagctatttagcatggtaccaacaaaaaccaggacaagcaccaagattactaatatacggagcttcaagcagagcaacaggaataccagatagattttcaggaagcggaagcggaacagatttcacactatcaatatcaagactcgaaccagaagatttcgcagtatattattgtctacattatggaacctcaccaatgtacacattcggacaaggaacaaaactagaaataaaacgaacagtagcagcaccatcagtattcatattcccaccatcagacgaacaattaaaatctggaacagcatcagtagtatgcctcctaaacaacttttacccaagagaagccaaagtacaatggaaagtagataacgcactccaatcaggaaactcacaagaatcagtaacagaacaagattcaaaagactcaacatattcattaagctcaacactaacattaagcaaagcagattacgaaaaacataaagtatacgcatgcgaagtaacacaccaaggactatcatcaccagtaaccaaatcatttaacagaggagaatgc

SEQ ID NO: 46966 - RNA, 360 nt, synthetic construct
  misc_feature 1..360: note = derived and/or modified sequence opt6 from anti-IsdB_5D1Q_Chain-E
  source 1..360: mol_type = other RNA
ccaggaaaaatgacagacctacaagacacaaaatacgtagtatacgaatcagtagaaaacaacgaatcaatgatggacacattcgtaaaacacccaataaaaacaggaatgctaaacggaaaaaaatacatggtaatggaaacaacaaacgacgactactggaaagacttcatggtagaaggacaaagagtaagaacaataagcaaagacgcaaaaaacaacacaagaacaataatattcccatacgtagaaggaaaaacactatacgacgcaatagtaaaagtacacgtaaaaacaatagactacgacggacaataccacgtaagaatagtagacaaagaagcattcacaaaagcaaac

SEQ ID NO: 46967 - RNA, 657 nt, synthetic construct
  misc_feature 1..657: note = derived and/or modified sequence opt6 from anti-IsdB_5D1X_Chain-A
  source 1..657: mol_type = other RNA
gacatagtcatgacacaatcaccattatcactaccagtaacattaggacaacccgcctcaatatcatgctcatcagcacaatccctagtacactcagacggagactcatacttaacatggttccaccaaagaccaggacaatcaccaagaagattaatctataaagtatcaataagagacgctggagtaccagacagattctcaggatcaggatcaggaacagacttcacattaaaaatatcaagagtagaagcagaagacgtaggagtatactactgcatgcaagcaacacactggccatacacattcggacaaggaaccaaattagaaataaaaagaacagtagcagcaccatcagtattcatattcccaccatcagacgaacaactaaaatcaggaacagcatcagtagtatgcttattaaacaacttctacccaagagaagcaaaagtacaatggaaagtagacaacgcactacaatcaggaaactcacaagaatcagtaacagaacaagattcaaaagactcaacatactcactaagctcaacactaacactctcaaaagcagactacgaaaaacataaagtatacgcatgcgaagtcacacaccaaggactatcatcaccagtaaccaaatcatttaacagaggagaatgc

SEQ ID NO: 46968 - RNA, 777 nt, synthetic construct
  misc_feature 1..777: note = derived and/or modified sequence opt6 from anti-IsdB_5D1X_Chain-B
  source 1..777: mol_type = other RNA
caagtacaactagtacaatcaggatcagaagtaaaaaaaccaggatcatcagtcacactctcatgtaaagcatcaggcgacacattcaatacacacacatactcttgggtaagacaagcaccaggacaaagactagaatggattggaggaataatgccaatattcgcagcatcaaaatcagcaccacatttacaagacagacttacaataacagcaaataaagccacaagaactgcatacatggaattaacttcactcacatcagacgactcaggtgtatactactgtgcaagagacggaagaggagcactacaatactggggacaaggaacattagtaacagtatcaagcgcatcaacaaaaggaccatcagtattcccattagcaccatcaagtaaatcaacatcaggaggaacagcagcactaggctgcctagtcaaagattactttccagaaccagtaacagtatcatggaactcaggagcactaacatcaggagtacatacatttcctgcagtactacaaagttcaggcctatattcattatcatcagtagtaacagtaccatcatccagtctaggaacacaaacatatatatgtaacgtaaaccacaaaccctcaaacacaaaagtagataaaaaagtagaaccaaaatcatgcggaggaggatcaggacaccaccatcaccaccaccaccaccatcacggcggagactacaaagaccatgacggagactataaagaccacgacatagattacaaagatgacgatgacaaa

SEQ ID NO: 46969 - RNA, 822 nt, synthetic construct
  misc_feature 1..822: note = derived and/or modified sequence opt6 from anti-IsdB_5D1X_Chain-C
  source 1..822: mol_type = other RNA
gaagtacaactagtagaatctggaggtggactagtacaacccggaggatcactaacattaagttgtgcagcatcaggcttaatatttagcgattcaacaatgcattgggtaagacaagcaagtggaagaggactagaatgggtagcaagaataagatctaaagcaaacaattacgctacatcatcagacaaatcagcaacagcatatctagcatcagtaaaaggaagatttacaatatcaagagacgattcaaaagacacaacatttttagaaatgtcatcattaaaaatagaagatacagcagtatattactgtatagcatcatcaacaactggatggtacgtaagagaagactttgactattggggacatggaacactagtaacagtatcatcagcttcaaccaaaggaccatcagtattcccattagcaccatcatccaaatcaacatcaggaggaacagcagcattaggatgtctagtaaaagattactttcccgaaccagtaacagtatcatggaactcaggagcactaacatcaggagtacacacatttccagctgtattacaatcatcaggtctatatagtttaagttcagtagtaacagtcccatctagttcattaggcacacaaacatatatatgtaacgtcaaccataaaccatcaaatacaaaagtagataaaaaagtagaaccaaaatcatgtggaggaggatcaggccaccatcatcaccatcaccatcaccatcacggaggagattataaagaccatgacggagactataaagatcacgacatagattacaaagacgatgacgataaa

SEQ ID NO: 46970 - RNA, 648 nt, synthetic construct
  misc_feature 1..648: note = derived and/or modified sequence opt6 from anti-IsdB_5D1X_Chain-D
  source 1..648: mol_type = other RNA
gaaatagttttaacacaaacaccagcaacattaagtttaacaccaggagaaagagcaacattaacctgtagagcaagccaatcagtatcatcatcatatctagcatggtatcaacaaaaaccaggacaagcaccaagactactaatctacggagcatcatcaagagcaacaggaataccagatagattctcaggcagcggatcaggaacagatttcacattatcaatatcaagactagaaccagaagatttcgcagtatattactgcctacattacggaacatcaccaatgtactttttcggaagaggaacagtactcgatataaaaagaacagtagcagcaccaagcgtattcatattcccaccatcagacgaacaattaaaatcaggaacagcatcagtagtatgcctacttaataatttttacccaagagaagcaaaagtacaatggaaagtagataacgcactacaatcaggaaactcacaagaatcagtaacagaacaagattcaaaagactcaacatactcattaagctcaacattaacattaagcaaagccgattacgaaaaacataaagtatacgcatgcgaagtaacacaccaaggattatcatcaccagtaaccaaatcctttaacagaggagaatgc

SEQ ID NO: 46971 - RNA, 354 nt, synthetic construct
  misc_feature 1..354: note = derived and/or modified sequence opt6 from anti-IsdB_5D1X_Chain-E
  source 1..354: mol_type = other RNA
aaaatgacagacctacaagacacaaaatacgtagtatacgaatcagtagaaaacaacgaatcaatgatggacacattcgtaaaacacccaataaaaacaggaatgctaaacggaaaaaaatacatggtaatggaaacaacaaacgacgactactggaaagacttcatggtagaaggacaaagagtaagaacaataagcaaagacgcaaaaaacaacacaagaacaataatattcccatacgtagaaggaaaaacactatacgacgcaatagtaaaagtacacgtaaaaacaatagactacgacggacaataccacgtaagaatagtagacaaagaagcattcacaaaagcaaac

SEQ ID NO: 46972 - RNA, 792 nt, synthetic construct
  misc_feature 1..792: note = derived and/or modified sequence opt6 from anti-IsdB_5D1Z_Chain-B
  source 1..792: mol_type = other RNA
gcagaagtacaattagtagaatcaggaggaggtgtagtacaaccaggaggaagtctaagattatcatgtgcagcatcaggtttcacatttaataaattttggatgaactgggtaagacaagcaccaggaaaaggattagaatgggtagcagatatacaagtagatggatcagaaaaaaattacgtagattcagtaaaaggaagatttaccatatcaagagataatggaaaaaattcactatatctacaaatgaattcattaagagcagaagatacaggagtatattattgtgccagaggaagatacgattactggtcaggatacctatcaccttggggacaaggaacattagtaacagtatcaagcgcatcaacaaaaggtccatcagtatttccacttgcccctagtagtaaatcaacaagtggaggaaccgcagcattaggatgtctagtaaaagattattttccagaaccagtaacagtaagctggaactcaggagctctaacttcaggagtacatacatttccagccgtattacaatcaagtggactatattcattaagctcagtagtaaccgttccatcatcatcattaggtacacaaacatatatatgcaacgtaaatcataaaccaagtaatacaaaagtagataaaaaagtagaaccaaaaagctgtggaggaggaagtggacatcaccatcatcatcaccatcatcatcatggaggagattacaaagatcatgacggagactataaagatcacgatatagattacaaagacgatgacgataaa

SEQ ID NO: 46973 - RNA, 642 nt, synthetic construct
  misc_feature 1..642: note = derived and/or modified sequence opt6 from anti-IsdB_5D1Z_Chain-C
  source 1..642: mol_type = other RNA
gatatacaactcacacaatcaccatcattcttatccgcatccgtagcagacagagtaacaataacatgcagagcaagccaagcagtaagatcatcactagcatggtaccaacaaaaaccaggaaaagcaccacaactactaatatactcagcatcaacactagaaaacggagtctcatcaagattctcaggatcaggaccaggaacagaatttacactaacaatatcatcactccaaccagaagacgtaggaacatactactgccaacaactaaacacataccccttcacattcggtccaggaacaaaagttgaaataaaacgaaccgtagcagcaccatctgtattcatattcccaccatcagacgaacaattaaaatcaggaacagcatcagtagtatgcttactcaacaacttctacccacgagaagcaaaagtacaatggaaagtcgacaacgcactacaatcaggaaactcacaagaatcagtaacagaacaagattcaaaagactcaacatacagcctatcatcaacactaacattatccaaagcagactacgaaaaacacaaagtatacgcatgcgaagtaacacaccaaggactatcctcacccgtaacaaaatcatttaacagaggcgaatgc

SEQ ID NO: 46974 - RNA, 810 nt, synthetic construct
  misc_feature 1..810: note = derived and/or modified sequence opt6 from anti-IsdB_5D1Z_Chain-D
  source 1..810: mol_type = other RNA
caagtacaactacaagaatcaggtccaggattagtaaaaccatcagaaacactatcattaatatgtacagtctcaggaggatcaatatcatcatcatcatactattggggttggataagacaaacacccgaaagaaacctagaatggataggaataatatacttctcaggaacaacatattacaacccatcactacaatccagagtatcaatgtcattagacagatccaccaacagattcagcctaagattatcatcagtaactgccgcagacacagcaatatactactgcgccaaaccaaaatcaagagacagaggaggaccaggagacgactacttcggaatggacgtctggggacaaggaataatggtcacagtaagctcagcatcaacaaaaggcccaagcgtattcccactagcaccatcatcaaaatcaacttcaggaggaacagcagcactaggatgcctagtaaaagattatttcccagaacccgtaacagtctcatggaactcaggagcattaacctcaggagtacacacatttccagcagtactacaatcatcaggattatactcactatcatcagtagtaactgtaccaagttcatcattaggaacacaaacttacatatgcaacgtaaatcacaaaccatcaaacactaaagtagacaaaaaagtcgaaccaaaatcatgtggaggaggatcaggtcaccaccaccaccaccaccaccatcaccacggaggagactacaaagaccacgacggagattacaaagatcacgatatagactacaaagacgacgacgacaaa

SEQ ID NO: 46975 - RNA, 810 nt, synthetic construct
  misc_feature 1..810: note = derived and/or modified sequence opt6 from anti-IsdB_5D1Z_Chain-F
  source 1..810: mol_type = other RNA
caagtacaactacaagaatcaggaccaggactagtaaaaccatcagaaacactatcactaatatgcacagtatcaggaggatcaatctcaagttcaagttactattggggatggataagacaaacaccagaaagaaacctagaatggataggaattatatatttttcaggaacaacatactacaatccatcactacaaagtagagtatcaatgtcattagaccgaagtacaaaccgattctcactaagattatcatcagtcacagcagcagacacagcaatatactactgtgcaaaaccaaaatcaagagacagaggaggaccaggagacgactatttcggaatggatgtatggggacaaggcataatggtaacagtaagttcagcatcaacaaaaggaccaagcgtattcccactagcaccatcatcaaaatcaacatcaggaggaacagcagccctaggatgtttagtaaaagactacttcccagaaccagttacagtatcatggaactcaggagcattaacatctggagtacacacattcccagccgtcctacaaagctcaggattatactctttatcatcagtagtcacagtaccatcatcatcattaggaacacaaacttacatatgcaatgtaaaccacaaaccatcaaacacaaaagtagacaaaaaagtagaaccaaaatcctgcggaggaggatcaggacaccatcaccaccaccaccaccaccaccatggaggagactacaaagaccacgacggagactacaaagaccatgacatagactacaaagacgacgatgacaaa

SEQ ID NO: 46976 - RNA, 792 nt, synthetic construct
  misc_feature 1..792: note = derived and/or modified sequence opt6 from anti-IsdB_5D1Z_Chain-G
  source 1..792: mol_type = other RNA
gcagaagtacaactagtggaaagcggaggaggagtagttcaaccaggaggatcacttagattatcatgtgcagcatcaggatttacatttaataaattttggatgaattgggtaagacaagcaccaggaaaaggactagaatgggtagcagacatacaagtagatggaagtgaaaaaaattatgtagattcagttaaaggaagatttacaatatcaagagataatggaaaaaatagcttatatttacaaatgaacagcttaagagcagaagatacaggtgtatattattgtgcaagaggaaggtatgattattggtcaggatatttaagtccatggggacaaggaacattagtaacagtaagctctgcttcaacaaaaggaccaagtgtattcccattagcgccatcaagcaaaagtacgtcaggaggaacagccgcattaggatgtttagtaaaagactatttcccagaaccagtaacagtttcatggaatagtggagcattaacatcaggagtacatacatttccagcggtattacaaagctcaggattatactcattatcaagtgtagtaacggtaccatcatcaagcttaggaacacaaacatatatatgtaatgtaaatcacaaaccatcgaatacaaaagtagataaaaaagtagaaccaaaatcatgtggaggaggaagtggacaccatcatcaccatcatcatcaccatcatggtggagattataaagatcatgatggagactataaagatcatgatatagattacaaagatgatgatgataaa

SEQ ID NO: 46977 - RNA, 642 nt, synthetic construct
  misc_feature 1..642: note = derived and/or modified sequence opt6 from anti-IsdB_5D1Z_HeavyChain
  source 1..642: mol_type = other RNA
gacatacaaatgacacaatcaccatcattcttaagcgcatccgtaggagaccgagtaacaataacatgccgagcatcacaaggaataacaacatacctaggctggtaccaacaaagaccaggaaaagcaccccaactattaatatacgcagcatcatcactacaatcaggagtacccccaagattctcaggatcaggatccggaacagaatttacactaacaatctcctcactccaaccagaagacttcgccacatactactgccaacaactaaacacatacccatacacattcggaccaggaacaagactcgaaataaaacgaacagtagcagcaccatccgtattcatattcccaccatcagacgaacaactaaaatcaggaacagcatcagtagtatgcctactaaacaacttctacccaagagaagccaaagtacaatggaaagtagacaatgcactacaatcaggaaactcacaagaatcagtaacagaacaagactcaaaagactcaacatactcactatcatctacattaaccttatcaaaagcagattacgaaaaacacaaagtatacgcatgcgaagtcacacaccaaggattatcatcacccgtaacaaaatccttcaatagaggcgaatgc

SEQ ID NO: 46978 - RNA, 471 nt, synthetic construct
  misc_feature 1..471: note = derived and/or modified sequence opt6 from anti-IsdB_5D1Z_Chain-I
  source 1..471: mol_type = other RNA
ggacccgcaaaagcaacaaacaacacatacccaatactaaaccaagaactaagagaagcaataaaaaacccagccataaaagacaaagaccactcagcaccaaactcaagaccaatagacttcgaaatgaaaaaaaaagacggaacacaacaattctaccactacgcatcatcagtaaaaccagcaagagtaatattcacagactcaaaaccagaaatagaactaggactacaatcaggacaattctggagaaaattcgaagtatacgaaggagacaaaaaactaccaataaaactagtatcatacgacacagtaaaagactacgcctacataagattctcagtatccaacggaacaaaagcagtaaaaatagtatcatcaacacacttcaacaacaaagaagaaaaatacgactacacactaatggaattcgcacaaccaatatacaactcagcagacaaattcaaaaca

SEQ ID NO: 46979 - RNA, 324 nt, synthetic construct
  misc_feature 1..324: note = derived and/or modified sequence opt6 from anti-HIV_b12_LightChain
  source 1..324: mol_type = other RNA
gaaatagtactaacacaatcaccaggaacactatcactatcaccaggagaaagagcaacattctcatgcagatcatcacactcaataagatcaagaagagtagcatggtaccaacacaaaccaggacaagcaccaagattagtaatacacggagtatcaaacagagcatcaggaatatcagacagattctcaggatcaggatcaggaacagacttcacactaacaataacaagagtagaaccagaagacttcgcactatactactgccaagtatacggagcatcatcatacacattcggacaaggaacaaaactagaaagaaaa

SEQ ID NO: 46980 - RNA, 381 nt, synthetic construct
  misc_feature 1..381: note = derived and/or modified sequence opt6 from anti-HIV_b12_HeavyChain
  source 1..381: mol_type = other RNA
caagtacaattagaacaaagtggagcagaagtaaaaaaaccaggagcgagtgtaaaagtaagttgtcaagcaagtggatatagatttagtcattttacagtacattgggtaagacaagcaccaggacaaagatttgaatggatgggatggataaatccatataatggaaataaagaatttagtgcaaaatttcaagatagagtaacatttacagcagatacaagtgcaaatacagcatatatggaattaagaagtttaagatcagcagatacagcagtatattattgtgcaagagtaggagaatggggatgggatgatagtccatatgataattattatatggatgtatggggaaaaggaacaacagtaatagtaagtagt

SEQ ID NO: 46981 - RNA, 633 nt, synthetic construct
  misc_feature 1..633: note = derived and/or modified sequence opt6 from anti-HIV_2G12_LightChain
  source 1..633: mol_type = other RNA
gtagtaatgacacaatcaccatcaacattatcagcatcagtaggagacacaataacaataacctgcagagcatcacaatcaatagaaacatggctagcatggtaccaacaaaaaccaggaaaagccccaaaattactaatatacaaagcatcaacattaaaaacaggagtaccatctagattctcaggatcaggatcaggaacagaatttacattaaccatatcaggactacaattcgacgacttcgcaacataccactgccaacactatgcaggctactcagcaactttcggacaaggaaccagagtagaaataaaaagaacagttgcagcaccatccgtattcatattcccaccctcagacgaacaactaaaatcaggaacagcatcagtagtatgcttattaaataatttctacccaagagaagccaaagtacaatggaaagtagataacgcactacaatcaggaaactcacaagaatcagtaacagaacaagactcaaaagactcaacatactccttatcctcaacactaacactatcaaaagcagactacgaaaaacacaaagtatacgcatgcgaagtaacacaccaaggactaagctccccagtaacaaaatcattcaacagagga

SEQ ID NO: 46982 - RNA, 672 nt, synthetic construct
  misc_feature 1..672: note = derived and/or modified sequence opt6 from anti-HIV_2G12_HeavyChain
  source 1..672: mol_type = other RNA
gaagtacaactagtagaatcaggaggaggtctagtaaaagctggaggctcattaatactaagttgtggagtatcaaatttcagaatatcagcacatacaatgaactgggtaagaagagtaccaggaggaggactagaatgggtagcatcaataagtacatcatcaacatacagagactatgcagatgcagtaaaaggaagatttacagtatcaagagatgacctagaagactttgtatatctacaaatgcataaaatgagagtagaagatacagcaatatattactgcgcaagaaaaggatcagaccgattatcagataatgatccattcgacgcatggggaccaggaacagtagtaacagtatcaccagcaagcacaaaaggaccaagtgtatttccactagcaccatcatcaaaaagtacatcaggaggaacagcagcattaggatgtttagtaaaagattactttcccgaaccagtaacagttagctggaattcaggagctctaacaagcggagtacatacatttccagcagtactacaaagtagtggactatattcattatcaagtgtagtaacagtaccaagttcatcactaggaacacaaacctatatatgtaacgtaaaccacaaaccctcaaatacaaaagtagataaaaaagtcgaaccaaaa

SEQ ID NO: 46983 - RNA, 642 nt, synthetic construct
  misc_feature 1..642: note = derived and/or modified sequence opt6 from anti-HIV_4E10_LightChain
  source 1..642: mol_type = other RNA
gaaatagtactaacacaatcaccaggcacacaatcattatccccaggagaaagagcaacactaagctgcagagcatcacaatcagtaggaaacaacaaattagcttggtaccaacaaagaccaggacaagcaccaagactactaatctacggagcatcttcaagaccctccggagtagcagacagattctcaggctcaggatcaggaacagacttcacactaacaatatcaagactagaaccagaagacttcgcagtatattactgccaacaatacggacaatcactatccacattcggacaaggaacaaaagtagaagtaaaaagaacagtagcagcaccatcagtatttatattcccaccatcagacgaacaactaaaatccggaaccgcatcagttgtatgcttactaaacaacttctacccaagagaagcaaaagtacaatggaaagttgacaacgcactacaatcaggaaattcacaagaatctgtaacagaacaagattcaaaagactcaacatactccctatcatcaacactaacactatcaaaagcagactatgaaaaacacaaagtatacgcatgcgaagtaacacaccaaggactatcatccccagtaaccaaatcattcaacagaggagaa

SEQ ID NO: 46984 - RNA, 684 nt, synthetic construct
  misc_feature 1..684: note = derived and/or modified sequence opt6 from anti-HIV_4E10_HeavyChain
  source 1..684: mol_type = other RNA
caagtacaattagtacaatcaggagcagaagtcaaaagaccaggatcatcagtaacagtatcatgtaaagcatcaggaggaagtttctcaacatatgcattatcatgggtaagacaagcaccaggaagaggattagaatggatgggaggagtaataccactattaacaataacaaactatgccccaagatttcaaggaagaataacaataacagcagatagatcaacatcaacagcatatctagaactaaattcactacgaccagaagacacagcagtatattactgtgcaagagaaggaacaacaggatggggatggttaggaaaaccaataggagcctttgcccattggggacaaggaacattagtaacagttagttcagcatcaacaaaaggaccaagtgtatttccattagcaccaagctcaaaatcaacaagtggaggaacagcagcattaggatgtctagtaaaagattatttcccagaaccagtaacagtatcatggaactcaggagctctaacttcaggagtacatacatttccagcagttttacaaagtagtggattatattcattatcatcagtagtaacagtaccatcaagctcactaggaacccaaacatatatatgtaacgtaaaccataaaccatcaaatacaaaagtagataaaaaagtagaaccaaaa

SEQ ID NO: 46985 - RNA, 312 nt, synthetic construct
  misc_feature 1..312: note = derived and/or modified sequence opt6 from anti-HIV_VRC01_LightChain
  source 1..312: mol_type = other RNA
gaaatagtactaacacaatcaccaggaacattaagcctaagcccaggagaaacagcaataataagctgtagaacaagccaatacggatcattagcatggtaccaacaaagaccaggacaagcaccaagattagtaatatatagcggaagcacaagagcagcaggaataccagacagattcagcggatcgagatggggaccagactataacttaacaataagcaatctagaaagcggagactttggagtatactattgccaacaatatgaatttttcggacaaggaacaaaagtacaagtagatataaaaaga

SEQ ID NO: 46986 - RNA, 363 nt, synthetic construct
  misc_feature 1..363: note = derived and/or modified sequence opt6 from anti-HIV_VRC01_HeavyChain
  source 1..363: mol_type = other RNA
caagtacaattagtacaaagtggaggacaaatgaaaaaaccaggagaaagtatgagaataagttgtagagcaagtggatatgaatttatagattgtacattaaattggataagattagcaccaggaaaaagaccagaatggatgggatggttaaaaccaagaggaggagcagtaaattatgcaagaccattacaaggaagagtaacaatgacaagagatgtatatagtgatacagcatttttagaattaagaagtttaacagtagatgatacagcagtatatttttgtacaagaggaaaaaattgtgattataattgggattttgaacattggggaagaggaacaccagtaatagtaagtagt

SEQ ID NO: 46987 - RNA, 330 nt, synthetic construct
  misc_feature 1..330: note = derived and/or modified sequence opt6 from anti-HIV_PG9_LightChain
  source 1..330: mol_type = other RNA
caaagcgcactaacacaaccagcaagcgtatcaggatcaccaggacaatcaataacaatatcatgcaatggaacaagcaatgacgtaggaggatacgaaagtgtaagctggtaccaacaacatccaggaaaagcaccaaaagtcgtaatatatgacgtaagtaaaagaccaagcggagtatcaaacagattctcaggatcaaaatcaggaaatacagcatcattaacaataagcggactacaagcagaagacgaaggagattactattgcaaatcattaacaagcacaagaagaagagtatttggaacaggaacaaaattaacagtacta

SEQ ID NO: 46988 - RNA, 408 nt, synthetic construct
  misc_feature 1..408: note = derived and/or modified sequence opt6 from anti-HIV_PG9_HeavyChain
  source 1..408: mol_type = other RNA
caaagattagtagaaagtggaggaggagtagtacaaccaggaagtagtttaagattaagttgtgcagcaagtggatttgattttagcagacaaggaatgcattgggtaagacaagcaccgggacaaggattagaatgggtagcatttataaaatatgatggaagtgaaaaatatcatgcagatagcgtatggggaagattaagtataagtagagataatagtaaagatacattatatttacaaatgaatagtttaagagtagaagatacagcaacatatttttgtgtgagagaagcagggggaccagattatagaaatggatataattattatgatttttatgatggatattataattatcattatatggatgtatggggaaaaggaacaacagtaacagtaagcagt

SEQ ID NO: 46989 - RNA, 630 nt, synthetic construct
  misc_feature 1..630: note = derived and/or modified sequence opt6 from anti-HIV_VRC07_LightChain
  source 1..630: mol_type = other RNA
gaaatcgtactaacacaatcaccaggaaccctatcattaagcccaggagaaacagcaataatatcatgcagaacatcacaatacggaagcctagcatggtaccaacaaagaccaggacaagcaccaagattagtaatatactcaggatcaacacgagcagcaggaataccagatagattctcaggatcaagatggggaccagactacacactaaccatatcaaacctagaatcaggagacttcggagtatactattgccaacaatacgaatttttcggacaaggaaccaaagtacaagtagacataaaaagaacagtcgcagcaccaagcgtattcatattcccaccatcagacgaacaactaaaatcaggaacagcctcagtagtatgcctactaaacaacttctacccaagagaagcaaaagtccaatggaaagtagacaacgcactacaaagcggaaactcacaagaatcagtaacagaacaagactcaaaagactcaacatacagtctatcatcaacactaacattatcaaaagcagactacgaaaaacacaaagtatacgcatgcgaagtaacacaccaaggactaagatcacccgtaacaaaatcattcaacagaggagaatgc

SEQ ID NO: 46990 - RNA, 375 nt, synthetic construct
  misc_feature 1..375: note = derived and/or modified sequence opt6 from anti-HIV_VRC07_HeavyChain
  source 1..375: mol_type = other RNA
caagtacaattagtacaatcaggaggacaaatgaaaaaaccaggagaatcaatgagaatatcatgtagagcatcaggatatgaatttatagattgcacattaaattggataagattagcaccaggaaaaagaccagaatggatgggatggttaaaaccaagaggaggagcagtaaattatgcaagaccactacaaggaagagtaacaatgacaagagatgtatatagtgatacagcatttttagaattaagatcattaacaagtgatgacacagcagtatatttttgtacaagaggaaaatattgtacagcaagagactattataattgggattttgaacactggggacaaggaacaccagtaatagtaagtagt

SEQ ID NO: 46991 - RNA, 315 nt, synthetic construct
  misc_feature 1..315: note = derived and/or modified sequence opt6 from anti-HIV_3BNC117_LightChain
  source 1..315: mol_type = other RNA
gacatacaaatgacacaatcaccatcatcactatcagcatcagtaggagacacagtaacaataacatgccaagcaaacggatacctaaactggtaccaacaaagaagaggaaaagcaccaaaactactaatatacgacggatcaaaactagaaagaggagtaccatcaagattctcaggaagaagatggggacaagaatacaacctaacaataaacaacctacaaccagaagacatagcaacatacttctgccaagtatacgaattcgtagtaccaggaacaagactagacctaaaaagaacagtagcagcacca

SEQ ID NO: 46992 - RNA, 387 nt, synthetic construct
  misc_feature 1..387: note = derived and/or modified sequence opt6 from anti-HIV_3BNC117_HeavyChain
  source 1..387: mol_type = other RNA
caagtacaattattacaaagcggagcagcagtaacaaaaccaggagcaagtgtaagagtaagttgtgaagcaagtggatataatataagagattattttatacattggtggagacaagcaccaggacaaggattacaatgggtaggatggataaatccaaaaacaggacaaccaaataatccaagacaatttcaaggaagagtaagtttaacaagacatgcaagctgggattttgatacattttcattttatatggatttaaaagcactaagatcagatgatacagcagtatatttttgtgcaagacaaagaagtgattattgggattttgatgtatggggaagtggaacacaagtaacagtatcaagtgcaagtacaaaaggacca

SEQ ID NO: 46993 - RNA, 324 nt, synthetic construct
  misc_feature 1..324: note = derived and/or modified sequence opt6 from anti-HIV_10-1074_LightChain
  source 1..324: mol_type = other RNA
agttatgtaagaccattaagtgtagcattaggagaaacagcaagaataagttgtggaagacaagcattaggaagtagagcagtacaatggtatcaacatagaccaggacaagcaccaatattattaatatataataatcaagatagaccaagtggaataccagaaagattttcaggaacaccagatataaattttggaacaagagcaacattaacaatatcaggagtagaagcaggagatgaagcagattattattgtcatatgtgggatagtagaagtggattttcatggagttttggaggagcaacaagattaacagtatta

SEQ ID NO: 46994 - RNA, 396 nt, synthetic construct
  misc_feature 1..396: note = derived and/or modified sequence opt6 from anti-HIV_10-1074_HeavyChain
  source 1..396: mol_type = other RNA
caagtacaattacaagaaagcggaccaggattagtaaaaccaagcgaaacattaagcgtaacatgtagcgtaagcggagactcaatgaataactattactggacatggataagacaatcaccaggaaaaggactagaatggataggatatatatcagacagagaatcagcaacatacaatccatcactaaatagcagagtagtaatatcaagagatacaagcaaaaatcaattaagcctaaaattaaactcagtcacaccagcagacacagcagtatactattgcgcaacagcaagaagaggacaaagaatatacggagtagtatcatttggagaatttttctactattactcaatggatgtatggggaaaaggaacaacagtaacagtaagctca

SEQ ID NO: 46995 - RNA, 633 nt, synthetic construct
  misc_feature 1..633: note = derived and/or modified sequence opt6 from anti-HIV_PGT121_LightChain
  source 1..633: mol_type = other RNA
agtgacatatcagtagcaccaggagaaacagcaagaatatcatgtggagaaaaaagcctaggctcaagagcagtacaatggtaccaacacagagcaggacaagcaccaagcctaataatatacaataaccaagacagaccatcaggaataccagaaagattctcaggatcaccagactcaccattcggaactacagcaacactaaccataacatccgtagaagcaggagacgaagcagactactactgccatatatgggattcaagagtaccaacaaaatgggtattcggaggcggaacaacactaacagtactaggacaacccaaagcagctccaagcgtaaccttattcccaccatcatcagaagaactacaagcaaacaaagcaacactagtatgcttaatatcagacttctacccaggagcagtaacagtagcatggaaagcagactcatcaccagtaaaagcaggagtagaaacaacaacaccatcaaaacaatcaaacaacaaatacgcagcatcatcatacctatcactaacaccagaacaatggaaatcacacaaatcatactcatgccaagtaacacatgaaggatcaacagtagaaaaaacagtagcaccaacagaatgttca

SEQ ID NO: 46996 - RNA, 705 nt, synthetic construct
  misc_feature 1..705: note = derived and/or modified sequence opt6 from anti-HIV_PGT121_HeavyChain
  source 1..705: mol_type = other RNA
caaatgcaactacaagaatcaggacccggattagtaaaaccatcagaaacactatcactaacatgctcagtatcaggagcatccatatcagactcatactggtcatggataagaagatcaccaggaaaaggattagaatggataggttacgtacacaaatcaggagacacaaactactcaccctcattaaaatcaagagtaaatctatcactagacacctccaaaaaccaagtatcactatctctagtagcagccacagcagcagactcaggaaaatactattgcgcaagaacactccacggcagaagaatatacggaatagtagcattcaatgaatggttcacatacttctacatggacgtatggggtaacggaacacaagtaacagtatcatcagcatcaacaaaaggaccatcagtattcccactagccccatcttcaaaatcaacatccggcggaacagcagccctaggatgcctagtaaaagactacttcccagaaccagtaacagtatcatggaactcaggagcattaacatcaggagtacacacatttccagcagtactacaatcatcaggattatactcactatcatccgtagtaacagtaccttcatcatcattaggaacacaaacatacatatgcaacgtaaaccacaaaccaagcaatacaaaagtagacaaaagagtagaaccaaaatcatgc

SEQ ID NO: 46997 - RNA, 657 nt, synthetic construct
  misc_feature 1..657: note = derived and/or modified sequence opt6 from anti-HIV_PGDM1400_LightChain
  source 1..657: mol_type = other RNA
gacttcgtactcacacaatcaccacactcattatcagtaacaccaggagaatcagcatcaatatcatgcaaatcctcccactcccttatacacggagacagaaataactacctagcatggtacgtacaaaaaccaggcagatcaccacaattattaatatacctagcatcatcaagagcatcaggagtacccgacagattctcaggatcaggatcagacaaagacttcacattaaaaatatcaagagtagaaaccgaagacgtaggaacatactactgcatgcaaggcagagaatcaccatggacattcggacaaggaacaaaagtagacataaaaagaacagtagcagcaccatccgtattcatattcccaccatcagacgaacaattaaaatcaggcaccgcatcagtcgtatgcctattaaacaacttctacccaagagaagcaaaagtacaatggaaagtagacaacgcattacaatcaggaaactcacaagaatccgtaaccgaacaagactcaaaagactcaacatactcactatcatcaaccttaacactatcaaaagcagactacgaaaaacacaaagtatacgcatgcgaagtaacacaccaaggactctcatcaccagtaacaaaatcattcaacagaggcgaatgc

SEQ ID NO: 46998 - RNA, 735 nt, synthetic construct
  misc_feature 1..735: note = derived and/or modified sequence opt6 from anti-HIV_PGDM1400_HeavyChain
  source 1..735: mol_type = other RNA
caagcacaactcgtacaatcaggaccagaagtaagaaaaccaggaacatcagtaaaagtatcatgtaaagcaccaggaaacacactaaaaacatatgatttacattgggtaagatcagtaccgggccaaggactacaatggatgggatggatatcacacgaaggagataaaaaagtaatagtagaaagatttaaagcaaaagtaacaatagactgggacagatcaacaaacacagcatatttacaactatcaggattaacatcaggagacacagctgtatattactgtgcaaaaggaagtaaacatagattaagagactacgcactatatgacgatgacggagcattaaactgggcagtagacgtagactacttatcaaacttagaattttggggacaaggaacagcagtaacagtatcatcagcatcaacaaaaggaccatcagtatttccattagcaccatcaagcaaatcaacatcaggaggtacagctgcattaggatgtttagtaaaagattactttcccgaaccagtaacagtttcatggaactcaggagcattaacatccggagtacatacatttccagcagtattacaatcaagcggcttatattcattatcatcagtagttacagtaccaagctcatcactaggaacacaaacatatatatgtaacgtaaaccataaaccatcaaatacaaaagtcgacaaaaaagtagaaccaaaaagctgtgat

SEQ ID NO: 46999 - RNA, 630 nt, synthetic construct
  misc_feature 1..630: note = derived and/or modified sequence opt6 from anti-HIV_N6_LightChain
  source 1..630: mol_type = other RNA
tacatacacgtcacacaatcaccatcatcactttccgtatcaataggagatagagtaacaattaactgccaaacatcacaaggagtaggctcagatctacattggtaccaacataaaccaggcagagcaccaaaactactaatacaccacacatcatcagtagaagatggagtaccatcaagattctcaggatcaggattccacacatcattcaacctaacaatatcagacttacaagcagacgacatagcaacatactattgccaagtattacaattcttcggaagaggatccagactacacataaaaagaacagtagcagcaccatcagtatttatattcccaccttcagacgaacaactaaaatcaggaacagcatcagtagtatgcttattaaacaacttctacccaagagaagcaaaagtacaatggaaagtagacaacgcactacaatcaggaaactcacaagaatcagtaacagaacaagactcaaaagactcaacatattccctatcctcaacattaacactatcaaaagcagactacgaaaaacacaaagtatacgcatgcgaagtcacacatcaaggactatcatcaccagtaacaaaatcattcaaccgaggagaatgc

SEQ ID NO: 47000 - RNA, 675 nt, synthetic construct
  misc_feature 1..675: note = derived and/or modified sequence opt6 from anti-HIV_N6_HeavyChain
  source 1..675: mol_type = other RNA
agagcacatctagtacaaagcggaacagcaatgaaaaaaccaggagcaagtgtaagagtatcatgtcaaacgagcggatatacatttacagcacatatattattttggtttagacaagcaccaggaagaggattagaatgggtaggatggataaaaccacaatatggagcagtaaattttggaggaggatttagagatagagtaacattaacaagagatgtgtatagagaaatagcatatatggatataagaggattaaaaccagatgatacagcagtatattattgtgcaagagatcgaagttatggagatagttcatgggcattagacgcatggggtcaaggaacaacagtggtagttagtgcagcatcaacaaaaggaccaagcgtatttccactagcaccaagtagtaaaagtacaagtggaggaacagctgcattaggatgtttagtaaaagattattttccagaaccagtaacagtatcatggaatagtggagcattaacatcaggagtacacacatttccagcagtactacaaagtagcggattatattcattatcaagcgtagtaacagtaccatcatcaagcttaggaacacaaacatacatatgtaatgtaaaccataaaccatcaaacacaaaagtagataaaaaagtagaaccgaaaagttgt

SEQ ID NO: 47001 - RNA, 1080 nt, synthetic construct
  misc_feature 1..1080: note = derived and/or modified sequence opt6 from anti-HIV_N6_GChain
  source 1..1080: mol_type = other RNA
gcttgggaagatgcagacacaacactattctgcgcaagcgacgcaaaagcatactcaacagaaaaacacaacgtatgggcaacccacgcatgcgtacccacagaccccgacccacaagaaatacctttagaaaacgtaaccgaaaacttcaacatgtggaaaaataacatggtagaacaaatgcacgaagacataatttcattatgggacgaatcattaaaaccctgcgtaatgctaacgggaggatcaaccataaaacaagcatgcccaaaagtgacattcgaaccaataccaatacactactgcgccccagcaggattcgcaatattaaaatgccgagacgaagacttcaacggaacaggaccatgtaaaaacgtcagcacagtacaatgtacacacggaataaaaccagtagtatcaacacaattactactaaacggatcattagcaaaaggagacatagtaataagatcagaaaacttaacaaacaacgcaaaagtaataatcgtccaattaaacgaaccagtacaaattgtatgcataagaccaaataatggaggatcaggatcaggaggagacataagacaagcacattgcaacgtaacgagaggaaaatgggtaaacataaccaaaaacgtaaaagaacaactctggaaaatattcaacaaaacaacaaacataacattcaataacaccatattcaactcaccagccggtggagacttagaaataacaacacactcattcaattgcggaggagaatttttctactgcaacacaagtgacttattcaacgaaacaaacctatcagcaaatcacacagacacaaacgaaaacataacattacaatgcagaataaaacaaatagtaagaatgtggcaaagagtaggacaagcaatgtacgcaccaccaatcgccggaaacataacatgcatatcaaacataaccggtttattattaacaagagacggagtaaatgatacccacgataaagaaaatgaaacattccgacccacaggaggagacatgagagacaactggaggtcagaattatataaatacaaagtaatcaaactaaaa

SEQ ID NO: 47002 - RNA, 645 nt, synthetic construct
  misc_feature 1..645: note = derived and/or modified sequence opt6 from anti-HIV_10E8_LightChain
  source 1..645: mol_type = other RNA
tcatacgaactaacccaagaaacaggagtaagcgtagcactaggacgaacagtaacaataacatgcagaggagattcattaagatcccactacgcatcatggtatcaaaaaaaaccaggacaagcaccaatactactattctatggaaaaaacaatagaccatcaggtgtaccagacagattctcaggatcagcatcaggaaacagagcatcattaacaatatcaggagcacaagcagaagatgacgcagaatactactgctcatcaagagacaaatcaggatcaagactatcagtattcggaggaggaacaaaattaacagtactatcacaaccaaaagcagcaccatcagtaacactattcccaccatcatcagaagaactacaagcaaataaagcaacattagtatgcctaatatcagacttctatccaggagctgtaacagtagcatggaaagcagactcatcaccagtaaaagcaggagtagaaacaacaacaccatcaaaacaatcaaacaacaaatacgcagcatcatcatatctaagcctaacaccagaacaatggaaatcacacagatcatacagttgccaagtaacccacgaaggatcaacagtagaaaaaacagtagcaccaacagaatgcagc

SEQ ID NO: 47003 - RNA, 708 nt, synthetic construct
  misc_feature 1..708: note = derived and/or modified sequence opt6 from anti-HIV_10E8_HeavyChain
  source 1..708: mol_type = other RNA
gaagtacaattagtagaatcaggaggaggtctagtaaaaccaggaggatcattaagattaagttgttcagcatcaggatttgattttgataacgcatggatgacatgggtaagacaaccaccaggaaaaggattagaatgggtaggaagaataacaggaccaggagaaggatggtcagtagattatgcagcaccagtagaaggaagatttacaatatcaagattaaattcaataaactttttatatttagaaatgaataatttaagaatggaagacagtggattatatttttgtgcaagaacaggaaaatattacgatttctggagcggatatccaccaggagaagaatactttcaagattggggtagaggaacattagtgacagtaagttcagcaagcacaaaaggaccatcagtatttccattagcaccttcatcaaaaagtacaagtggaggaacagcagcattagggtgtttagtaaaagattactttccagaaccagttacagtatcatggaatagcggagcactaacttcaggagtacatacatttccagctgtattacaaagtagcggattatatagtcttagcagtgttgtaacagtaccaagttcatcattaggaacacaaacatatatatgtaatgtaaatcataaaccatcaaacacaaaagtagataaaagagtagaaccaaaaagctgtgataaa

SEQ ID NO: 47004 - RNA, 333 nt, synthetic construct
  misc_feature 1..333: note = derived and/or modified sequence opt6 from anti-HIV_12A12_LightChain
  source 1..333: mol_type = other RNA
gacatacaaatgacacaatcaccatcatcattatcagcatcagtaggagacagagtaacaataacatgtcaagcaggacaaggaataggatcatcattacaatggtaccaacaaaaaccaggaaaagcaccaaaactattagtacacggagcatcaaatctacacagaggagtaccatcaagattctcaggatcaggatttcacacaacattttcattaacaatatcaggactacaaagagacgacttcgcaacatacttttgcgcagtattagaatttttcggaccaggaacaaaagtagaaataaaaagaacagtagcagcaccatcagta

SEQ ID NO: 47005 - RNA, 381 nt, synthetic construct
  misc_feature 1..381: note = derived and/or modified sequence opt6 from anti-HIV_12A12_HeavyChain
  source 1..381: mol_type = other RNA
agtcaacatttagtacaaagtggaacacaagtaaaaaaaccaggagcaagtgtaagaataagttgtcaagcaagcggatatagttttacagattatgtattacattggtggagacaagcaccaggacaaggattagaatggatgggatggataaaaccagtatatggagcaagaaattatgcaagaagatttcaaggaagaataaattttgatagagatatatatagagaaatagcatttatggatttaagtggattaagaagtgatgatacagcattatatttttgtgcaagagatggaagtggagatgatacaagttggcatttagatccatggggacaaggaacattagtaatagtaagtgcagcaagtacaaaagga

SEQ ID NO: 47006 - RNA, 315 nt, synthetic construct
  misc_feature 1..315: note = derived and/or modified sequence opt6 from anti-HIV_12A21_LightChain
  source 1..315: mol_type = other RNA
gatatacaaatgacacaatcaccatcaagcttaagcgcaagtgtaggagatagagtaacaataaactgtcaagcaggacaaggaataggatcaagcttaaactggtaccaaaaaaaaccaggaagagcaccaaaactattagtacatggagcaagcaatctacaaagaggagtaccaagcagattctcaggatcaggatttcacacaacatttacattaacaataagctcactacaaccagatgacgtagcaacatacttttgcgcagtatttcaatggttcggaccaggaacaaaagtagatataaaaagaaca

SEQ ID NO: 47007 - RNA, 384 nt, synthetic construct
  misc_feature 1..384: note = derived and/or modified sequence opt6 from anti-HIV_12A21_HeavyChain
  source 1..384: mol_type = other RNA
agtcaacatttagtacaaagtggaacacaagtaaaaaaaccaggagcaagtgtaagagtaagttgtcaagcaagtggatatacatttacaaattatatattacattggtggagacaagcaccaggacaaggattagaatggatgggattaataaaaccagtattcggagcagtaaattatgcaagacaatttcaaggaagaatacaattaacaagagatatatatagagaaatagcatttttagatttatcaggattaagatcagatgatacagcagtatattattgtgcaagagacgaaagcggagatgatttaaaatggcatttacatccatggggacaaggaacacaagtaatagtaagtccagcatcaacaaaaggacca

SEQ ID NO: 47008 - RNA, 648 nt, synthetic construct
  misc_feature 1..648: note = derived and/or modified sequence opt6 from anti-HIV_35022_LightChain
  source 1..648: mol_type = other RNA
caatcagtattaacacaatcagcatcagtatcaggatcactaggacaatcagtaacaatatcatgcacaggaccaaactcagtatgttgctcacacaaaagcatatcatggtaccaatggccaccaggaagagcaccaacattaataatatacgaagacaacgaaagagcaccaggaatatcaccaagattctccggatataaatcatactggtcagcatacttaacaatatccgacctacgaccagaagatgaaacaacatactattgttgctcatacacccacaactcaggatgcgtattcggaacaggaaccaaagtaagcgtactaggacaatcaaaagcaaacccatcagtaacactattccccccatcatcagaagaactacaagcaaacaaagcaacattagtatgcctaatatcagacttctacccaggagcagttacagtcgcatggaaagcagactcatcaccagtaaaagccggagtagaaacaacaacaccatcaaaacaatcaaacaacaaatacgccgcatcatcatacttatcactaacaccagaacaatggaaatcacatagaagctactcctgccaagtaacacacgaaggatcaacagtagaaaaaacagtagcaccaacagaatgctca

SEQ ID NO: 47009 - RNA, 729 nt, synthetic construct
  misc_feature 1..729: note = derived and/or modified sequence opt6 from anti-HIV_35022_HeavyChain
  source 1..729: mol_type = other RNA
gaaggacaactagtacaatcaggagcagaactaaaaaaaccaggagcatcagtaaaaatatcatgcaaaacaagcggatacagattcaacttctaccacataaactggataagacaaacagcaggaagaggaccagaatggatgggatggatatcaccatatagtggagacaaaaaccttgcaccagcatttcaagatagagtcataatgacaacagacactgaagtaccagtaacatcattcacatcaacaggagccgcatacatggaaataagaaacctaaaattcgacgacacaggaacatatttctgtgcaaaaggcttattaagagatggatcatcaacctggctaccctacctatggggacaaggaacactactaacagtaagctcagcatcaacaaaaggaccatcagtattcccactagcaccatcatcaaaatcaacctcaggaggaacagcagcattaggatgcctagtaaaagactacttccccgaaccagtaacagtaagctggaactcaggagcactaacctcaggagtacacacattcccagcagtactacaatcatcaggtctatactcactatcatcagttgtaacagtaccatcaagctcattaggaacacaaacatatatatgcaacgtaaatcataaaccatcaaacactaaagtagacaaaagagtagaaccaaaatcatgcgacaaaggattagaagtactattccaa

SEQ ID NO: 47010 - RNA, 648 nt, synthetic construct
  misc_feature 1..648: note = derived and/or modified sequence opt6 from anti-HIV_3BC176_LightChain
  source 1..648: mol_type = other RNA
caatcagtattaacacaaccagcatctgtctcagcatcacctggccaatcaataacagtctcatgcacaggatcaagaaacgacgtaggcggatacgacttcgtaagctggtaccaaagacatcccggaggagtaccaaaattaataatctatgaaataagcaaaagaccaagcggaataccacaaagattctcaggatcaagatcaggcaataccgcatcattaacaataagcggattacaagatgatgacgaagccgactactattgctgctcatacgcatcttacgacagactaatatttggaggaggcacaagagtatcagtcctaagacaaccaaaagcagcaccaagcgtaacattattcccaccctcatcagaagaactacaagcaaacaaagcaactctagtatgcctaatatcagacttctacccaggagcagtaacagtagcatggaaagcagacggatcaccagtaaaagcaggcgtagaaacaacaaaaccatcaaaacaatcaaataacaaatacgcagcatcaagctatctttcattaacaccagaacaatggaaatcacacagatcatactcatgtcaagtaacacacgaaggaagcacagtagaaaaaacagtagcaccaacagaatgctca

SEQ ID NO: 47011 - RNA, 699 nt, synthetic construct
  misc_feature 1..699: note = derived and/or modified sequence opt6 from anti-HIV_3BC176_HeavyChain
  source 1..699: mol_type = other RNA
gaacaagtacaattaatgcaatcaggagcacaattaagagatcctggagactcactaaaaatatcatgcaaagcaagcggatataattttatagattaccatatacattgggtcagattagcacctggaagaggattagaatggatgggatggatagacccagtcggaggaataacaaaatacgcaggacaattccaaggaagattaagtttaacaagagatacatcaacaaatacattatttttagaattatcaagactaacagcaggagacacagcagtatatttttgtgcaagaagtatgagaccagtagaccatggaatagactattcaggactatttgtatttcacttttggggacgaggttcagatgtattagtatcttcagcatcaacaaaaggaccctcagtatttccactagcaccatcaagcaaatcaacatcaggaggaacagcagcattaggatgtttagtaaaagattattttccagaaccagtaactgttagttggaactcaggagcactaacaagcggagtacatacatttccagcagtattacaatcaagtggattatattcattaagctcagtagtaacagtaccaagttcatcattaggaacacaaacatatatatgtaatgtaaaccataaaccatcaaatacaaaagtagacaaaaaagtagaaccaaaatcatgtgac

SEQ ID NO: 47012 - RNA, 621 nt, synthetic construct
  misc_feature 1..621: note = derived and/or modified sequence opt6 from anti-HIV_3BNC55_LightChain
  source 1..621: mol_type = other RNA
gacatacaaatgacacaatccccatcatcattatccgcatcagtcggagacaaagtaacaataacatgccaaacatcagcaggataccttaactggtaccaacaaagaagaggaagagccccaaaactactaatgtacgacggatcaagactagtaacaggagtaccatcaagattctcaggaagaagatggggaacacaatacaatctaacaataggatcattacaaccagaagacatagcaacatattactgtcaagtatacgaattcttcggaccaggaacaagactagacctaaaaagaacagtagcagcaccaagcgtattcatattcccaccatcagacgaacaactaaaatccggaacagcatcagtagtatgcttactaaacaacttctacccaagagaagcaaaagtacaatggaaagtagacaacgcactacaatcaggaaactcacaagaatcagtaacagaacaagattcaaaagattcaacatattcactatcatcaacactaaccttatccaaagcagactacgaaaaacacaaagtatacgcatgcgaagtaacacaccaaggactctcatcaccagtaacaaaaagcttcaacagaggagaatgc

SEQ ID NO: 47013 - RNA, 675 nt, synthetic construct
  misc_feature 1..675: note = derived and/or modified sequence opt6 from anti-HIV_3BNC55_HeavyChain
  source 1..675: mol_type = other RNA
caagtacaattagtacaatcaggaacagcagtaaaaagaccaggagcatcagtaagagtatcatgtcaagcatcaggatacacattcactgactatttcatatactggtggagacaagctccaggacaaggactagaatggctaggctggataaacccattaacaagtcaaccaagttatccatcaagatttcaaggtagattaacattaacaagagacacattcgatgaaatgctatatatggatctaagaggattaagatccgacgatacaggaatatatttctgtgcaagaagacacagcgattactgtgactttgacatatggggttcaggaacacaaataatagtctcatcagcatcaacaaaaggaccatcagtatttccattagcaccttcatcaaaatcaacatcaggaggaacagcagcattaggatgtctagtaaaagactactttccagaaccagtaacagtatcatggaactcaggagcactaacaagcggagtacatacatttccagcagtattacaatcatcaggactatattcattatcatcagtcgtaacagtaccatcatcatcattaggaacacaaacatatatatgtaacgtaaaccataaaccatcaaatacaaaagtagataaacgagtagaaccaaaatcatgtgacaaaaca

SEQ ID NO: 47014 - RNA, 618 nt, synthetic construct
  misc_feature 1..618: note = derived and/or modified sequence opt6 from anti-HIV_3BNC60_LightChain
  source 1..618: mol_type = other RNA
gacatacaaatgacacaatcaccatcaagcctatcagcaagagtaggagacacagtaacaataacatgccaagcaaacggatacctaaactggtaccaacaaagaagaggaaaagcaccaaaactactaatatacgacggatcaaaactagaaagaggcgtaccagcaagattctcaggaagaagatggggccaagaatacaacttaacaataaacaacctacaaccagaagacgtagcaacatacttctgccaagtatacgaattcatagtaccaggaacaagactagacttaaaaagaacagtagcagcaccatcagtcttcatattcccaccatcagacgaacaactaaaatcaggcacagcatcagttgtatgcctactaaacaacttctacccaagagaagctaaagtacaatggaaagtagacaatgcattacaatccggaaactcacaagaatcagtaacagaacaagattcaaaagactcaacctactcactatcatcaacactaacactatcaaaagcagactacgaaaaacacaaagtatacgcatgcgaagtaacacaccaaggactatcatcaccagtaacaaaatcattcaatagaggcgaatgt

SEQ ID NO: 47015 - RNA, 687 nt, synthetic construct
  misc_feature 1..687: note = derived and/or modified sequence opt6 from anti-HIV_3BNC60_HeavyChain
  source 1..687: mol_type = other RNA
caagtacatctatcacaatcaggagcagcagtaacaaaaccaggagcatcagtaagagtatcatgtgaagcatcaggatacaaaataagtgaccacttcatacattggtggagacaagccccaggtcaaggattacaatgggtaggatggataaacccaaaaacaggacaaccaaacaaccctcgccaattccaaggaagagtatcactaacaagacaagcatcatgggacttcgacacatactcattctatatggatttaaaagcagtaagatcagacgacacagcaatatacttttgcgcaagacaaagatcagacttttgggacttcgacgtatggggctcaggaacacaagtaacagtatcatcagcatctacaaaaggaccatcagtattcccattagcaccatccagtaaatcaacaagcggaggaacagcagccctaggctgcttagtaaaagactattttcccgaaccagtaacagtatcatggaacagcggagcactaacatcaggagtacacacatttccagcagtattacaatcatcaggactatactcactatcatcagtagtaacagtaccaagctcatcactaggaacacaaacatacatatgcaatgtaaatcacaaaccatcaaacaccaaagtagacaaacgagtagaaccaaaatcatgtgacaaaaca

SEQ ID NO: 47016 - RNA, 687 nt, synthetic construct
  misc_feature 1..687: note = derived and/or modified sequence opt6 from anti-HIV_3BNC60_HeavyChain
  source 1..687: mol_type = other RNA
gaagtacatctaagtcaatcaggtgcagcagtaacaaaaccaggagcatcagtaagagtatcatgtgaagcatcaggttacaaaatatcagaccatttcatacactggtggagacaagcaccaggacaaggactacaatgggtaggatggataaatccaaaaacaggacaaccaaacaatgcaagacaatttcaaggaagagtatcactaacaagacaagcatcatgggactttgacacatatagcttctatatggatttaaaagcagtaagatcagacgacacagcaatatatttctgtgcaagacaaagaagtgatttctgggattttgacgtatggggatcaggtacccaagtcacagtaagctcagcatcaacaaaaggaccatcagtatttccactagcaccatcaagtaaaagtacatcaggtggaacagcagcattaggatgtctagtaaaagattactttccagaaccagtaacagtatcatggaactcaggcgcattaacatcaggagtacatacattcccagcagtactacaaagcagtggactatatagcctatcaagtgtagtaacagtcccaagttcatcactaggaacacaaacatatatatgtaatgttaaccataaaccatcaaatacaaaagtagacaaaagagtagaaccaaaatcttgtgacaaaaca

SEQ ID NO: 47017 - RNA, 648 nt, synthetic construct
  misc_feature 1..648: note = derived and/or modified sequence opt6 from anti-HIV_447-52D_LightChain
  source 1..648: mol_type = other RNA
caatcagtactaacacaaccaccatcagtatcagccgcacccggacaaaaagtaactatatcatgctcaggatcctcatcaaacataggcaacaactacgtactatggtaccaacaattcccaggaaccgcaccaaaactattaatatacggaaacaacaaaagaccatcaggaataccagacagattctcaggatcaaaatcaggaacatcagcaacactaggaataacaggattacaaacaggagacgaagcagactacttctgcgcaacatgggactcaggactctcagcagactgggtatttggaggaggaacaaaactaacagtactatcacaaccaaaagcagcaccatcagtaacactattcccaccatcttcagaagaactacaagctaacaaagcaacattagtatgcctaatatcagacttctatccaggagcagtaacagtagcatggaaagcagactcctcaccagtaaaagcaggagtagaaaccacaacaccatcaaaacaatccaacaacaaatacgcagcatcatcatatctatcactcacacctgaacaatggaaatcacacagatcatacagctgccaagtaacccacgaaggatccacagtagaaaaaacagtagcaccaacagaatgc

SEQ ID NO: 47018 - RNA, 693 nt, synthetic construct
  misc_feature 1..693: note = derived and/or modified sequence opt6 from anti-HIV_447-52D_HeavyChain
  source 1..693: mol_type = other RNA
gaagtacaattagtagaatcaggaggaggtttagtaaaaccaggaggatcactacgattaacatgtgtagcatcaggattcacatttagcgatgtatggttaaattgggtaagacaagcaccaggaaaaggattagaatgggtaggaagaataaaatcaagaacagatggaggaacaacagattatgcagcaagcgtaaaaggaagatttacaatatcaagagatgatagtaaaaatacattatatttacaaatgaatagtctaaaaacagaagatacagcagtatactcatgtacgacagatggatttataatgataagaggagtatcagaagattattattattattatatggatgtatggggaaaaggaacaacagtaacagtaagctcagcaagtacaaaaggaccaagtgtatttccattagcaccatgtagtagaagcacaagtggaggaacagcagcattaggatgtttagtaaaagattactttccagaacctgtaacggtgtcatggaatagcggagcattaacttcaggagtacatacatttccagcagtattacaaagctcaggattatatagtttatcaagtgtagtaacagtaccaagttcatcattaggaacacaaacatatacatgtaatgtaaatcataaaccatcaaatacaaaagtagataaaagagtagaatta

SEQ ID NO: 47019 - RNA, 645 nt, synthetic construct
  misc_feature 1..645: note = derived and/or modified sequence opt6 from anti-HIV_447-52D_LightChain
  source 1..645: mol_type = other RNA
caatccgtactaacacaaccaccatccgtatcagcagcaccaggacaaaaagtaacaatatcctgctcaggatcatcatcaaatataggaaacaactatgttctatggtaccaacaattcccaggaacagcaccaaaactattaatatatggaaacaacaaaagaccatccggaatacctgacagattctcaggatcaaaatcaggaacatcagcaacactcggaataacaggactacaaacaggcgacgaagctgactacttctgcgcaacatgggactcaggattatcagcagactgggtattcggaggaggaacaaaactaaccgttctatcacaaccaaaagccgccccatcagtaacactattcccaccctcatcagaagaactacaagcaaacaaagcaacattagtatgtttaatatcagacttctacccaggagcagtaacagtcgcatggaaagcagactcatcaccagtaaaagcaggagtagaaacaacaacaccatcaaaacaatccaacaacaaatacgcagcatcatcatacctatcattaacaccagaacaatggaaatcacacagatcatactcttgccaagtaacacacgaaggatcaacagtagaaaaaacagtagcaccaacagaa

SEQ ID NO: 47020 - RNA, 705 nt, synthetic construct
  misc_feature 1..705: note = derived and/or modified sequence opt6 from anti-HIV_447-52D_HeavyChain
  source 1..705: mol_type = other RNA
gaagtacaattagtagaatcaggaggagggctagtaaaaccaggaggatcattacgactaacatgtgtagcatcaggattcacattcagtgacgtatggttaaactgggtaagacaagcaccaggaaaaggactcgaatgggtaggaagaataaaatccagaacagatggaggcacaactgactatgcagcatcagtaaaaggaagatttacaatatcaagagacgatagcaaaaacacactctatctacaaatgaatagcctaaaaactgaagatacagcagtatattcatgtacaacagacggattcataatgataagaggcgtatcagaagactactattactattacatggacgtatggggaaaaggaacaacagtaacagtatcatcagcatcaactaaaggtccatcagtatttccattagcaccatgttcaagatcaacatcaggaggaacagcagcactaggatgtctagtaaaagactattttccagaaccagtaacagtttcatggaactcaggagcattaacatcaggagtacatacatttccagcagtattacaatcttcaggattatattcactatcatcagtagtaacagtaccaagttcatctttaggaacacaaacatatacatgtaacgttaaccataaaccatcaaacacaaaagtagataaaagagtagaactaaaaacacctaca

SEQ ID NO: 47021 - RNA, 624 nt, synthetic construct
  misc_feature 1..624: note = derived and/or modified sequence opt6 from anti-HIV_5H/I1-BMV-D5_LightChain
  source 1..624: mol_type = other RNA
gacatccaaatgacacaatcaccatcaacactatcagcatcaataggagacagagtaacaataacctgcagagcatcagaaggaatataccactggctagcatggtaccaacaaaaaccaggaaaagcaccaaaactcctaatctacaaagcatcatcactagcatcaggagcaccatcaagattctcaggatcaggatcaggaacagacttcacactaacaatatcctcactccaaccagacgacttcgcaacctactactgccaacaatactcaaactacccactaaccttcggaggaggaacaaaactcgaaataaaaagaacagtagcagcaccatcagtattcatattcccaccatcagacgaacaactaaaatcaggaacagcatcagtagtatgcctactaaacaacttctacccacgagaagcaaaagtacaatggaaagtagacaacgcactacaatcaggaaactcccaagaatcagtaacagaacaagactcaaaagactcaacatactcactatcctcaacactaacactatcaaaagcagactacgaaaaacataaagtatacgcatgcgaagtaacacaccaaggactatcatcacctgtaacaaaatca

SEQ ID NO: 47022 - RNA, 651 nt, synthetic construct
  misc_feature 1..651: note = derived and/or modified sequence opt6 from anti-HIV_5H/I1-BMV-D5_HeavyChain
  source 1..651: mol_type = other RNA
caagtacaattagtacaatcaggagcagaagtaagaaaaccaggagcttcagtaaaagtatcatgtaaagcatcaggagacacatttagtagctacgcaatatcatgggtaagacaagcaccaggacaaggactagaatggatgggaggaataataccaatattcggaacagctaactatgcacaagcatttcaaggtagagtaacaataacagcaaacgaatcaacatcaacagcatatatggagctatcatcactcagatcagaagatacagcaatatattactgtgcaagagacaatccaacactattaggatcagattattggggagcaggaaccctagtaacagtatcatcagcaagcacaaaaggaccatcagtattcccactagcaccatgctcaagaagtacaagcggaggaacagcagcactaggatgtttagtaaaagattactttccagaaccagtaacagtatcatggaactcaggagcactaacatcaggagtacatacatttccagcagtattacaatcatcaggactatattcactatcaagtgtagtaacagtaccaagctcatcactaggaacacaaacatatatctgcaatgtaaaccataaaccatcaaatacaaaagtagataaaagagta

SEQ ID NO: 47023 - RNA, 657 nt, synthetic construct
  misc_feature 1..657: note = derived and/or modified sequence opt6 from anti-HIV_5H/I1-BMV-D5_A-Chain
  source 1..657: mol_type = other RNA
atgcaactactaagcggaatagtacaacaacaaaacaacctcctaagagcaatagaagcacaacaacacctactacaactaacagtatggggaataaaacaactacaagcaagaatactagcaggaggaagcggaggacacacaacatggatggaatgggacagagaaataaacaattacacaagcctaatacacagtctaatagaagaatcacaaaaccaacaagaaaaaaacgaacaagaactactagaaggatcatcaggaggacaactactatcaggaatagtccaacaacaaaacaacctactacgagcaatagaagcccaacaacacctattacaactaacagtatggggaataaaacaactacaagcaagaatactagcaggaggaagcggaggacacacaacatggatggaatgggacagagaaataaataactacacatcattaatccactcattaatagaagaatcacaaaaccaacaagaaaaaaacgaacaagaactactagaaggaagctcaggaggacaactattatcaggaatagttcaacaacaaaacaatttactaagagcaatagaagcccaacaacacctactacaactaacagtatggggaataaaacaactacaagcaagaatactagcaggagga

SEQ ID NO: 47024 - RNA, 390 nt, synthetic construct
  misc_feature 1..390: note = derived and/or modified sequence opt6 from anti-HIV_8ANC195_LightChain
  source 1..390: mol_type = other RNA
gatatacaaatgacacaaagtccatcaacattatcagcaagcataggagatacagtaagaataagctgtagagcaagccaatcaataacaggaaactgggtagcatggtatcaacaaagaccaggaaaagcaccaagattactaatatacagaggagcagcattactaggaggagtaccatcaagatttagcggaagcgcagcaggaacagatttcacactaactataggaaacttacaagcagaagatttcggaacattttactgtcaacaatacgatacatatccaggaacctttggacaaggaacaaaagtagaagtaaaaagaacagtagcagcaccatcagtatttatatttccaccatcagatgaacaactaaaaagcggaaca

SEQ ID NO: 47025 - RNA, 423 nt, synthetic construct
  misc_feature 1..423: note = derived and/or modified sequence opt6 from anti-HIV_8ANC195_HeavyChain
  source 1..423: mol_type = other RNA
caaatacacctagtacaatcaggaacagaagtaaaaaaaccaggatcatcagtaacagtatcatgcaaagcatacggagtaaacacattcggactatatgcagtaaactgggtaagacaagcaccaggacaatcactagaatacataggacaaatatggagatggaaatcatcagcatcacaccacttcagaggaagagtactaatatcagcagtagacctaaccggatcatcaccaccaatatcatcactagaaataaaaaacttaacatcagacgacacagcagtatacttctgcacaacaacatcaacatacgacaaatggtcaggactacaccacgacggagtaatggcattctcatcttggggacaaggaacactaatatcagtatcagcagcatcaactaaaggaccatcagtattc

SEQ ID NO: 47026 - RNA, 333 nt, synthetic construct
  misc_feature 1..333: note = derived and/or modified sequence opt6 from anti-HIV_CAP256-VRC26.01_LightChain
  source 1..333: mol_type = other RNA
caatcagtactaacacaaccaccatcagtatcagcagcaccaggacaaaaagtaacaatatcatgctcaggatcatcatcaacaataggaaacaactacgtatcatggtacagactattaccaggaacagcaccaaaattactaatatacaaaaacgacaacagaccatcaggaataccagacagattctcaggatcaaaatcaggaacatcagcaacactaggaatatcaggactacaaacaggagacgaagcagactactactgcggaacatgggacacatcactatcaggaggaggagtattcggaacaggaacaaaagtaacagtacta

SEQ ID NO: 47027 - RNA, 432 nt, synthetic construct
  misc_feature 1..432: note = derived and/or modified sequence opt6 from anti-HIV_CAP256-VRC26.01_HeavyChain
  source 1..432: mol_type = other RNA
gaagtacaagtagtagaaagcggaggaggagtagtacaaccaggaagaagtttaagattaagttgtacagcaagtggattcacattctcaaactttgcaatgggatgggtaagacaagcaccaggaaaaggactagaatgggtagcatttatatcaagcgatggatcaaacaaaaactatggagatagcgtaaaaggaagatttaccataagtagagacaatagcaaaaacacagtatttctacaaatgaatagcttaagagtagaagatacagcactatattactgtgcaaaagacgtaggagattacaaaagcgatgaatggggaacagaatattacgatatatcaatatcatacccaatacaagacccaagagcaatggtaggagcattcgatctatggggacaaggaacaatggtaacagtaagccca

SEQ ID NO: 47028 - RNA, 324 nt, synthetic construct
  misc_feature 1..324: note = derived and/or modified sequence opt6 from anti-HIV_CAP256-VRC26.02_LightChain
  source 1..324: mol_type = other RNA
caatcagtactaacacaaccaccatcagtatcagcagcaccaggacaaaaagtaacaatatcatgctcaggatcaaactcaaacataggaaacaaagacgtaagctggtaccaacaaataccagcaacagcaccaaaactactaatatacgaaaacaacaaaagaccatcaggaatatcagacagattctcaggatcaaaatcaggaacatcagcaacattagcaataacaggactacaaacaggagacgaagcagactactactgcgcaacatgggacggaagagtatcagtaataggaacaggaacaaacgtaatagtacta

SEQ ID NO: 47029 - RNA, 432 nt, synthetic construct
  misc_feature 1..432: note = derived and/or modified sequence opt6 from anti-HIV_CAP256-VRC26.02_HeavyChain
  source 1..432: mol_type = other RNA
gaagtacaattagtagaaagcggaggaggagtagtacaaccaggaagaagtttaagattaagctgtgcagcaagtcaattctcattcggaaattatggaatgcactgggtcagacaagcaccaggaaaaggattagaatgggtagcagcaatatcatttgcaggaacaaaaacaaattatgcagatagtgtaaaaggaagatttacaataagtagagacaatagtaaaaatacagtatatctacaaatgaatagcttgagagcagaagatacagcactatatttctgtgcaaaagacataagagaatatgaatgtgaatactggacatcagactattatgatttcggaagaccacaaccatgtatagactcaagaggagtagtaggaacattcgatgtatggggacaaggaacaatggtaacagtaagttca

SEQ ID NO: 47030 - RNA, 333 nt, synthetic construct
  misc_feature 1..333: note = derived and/or modified sequence opt6 from anti-HIV_CAP256-VRC26.03_LightChain
  source 1..333: mol_type = other RNA
caatcagtactaacacaaccaccatcagtatcagcagcaccaggacaaaaagtaacaatatcatgctcaggatcaagctcaaacataggaaacaacttcgtatcatggtaccaacaaagaccaggaacagcaccaaaaatactaatatacgaaaacaacaaaagaccatcagaaacaccagacagattctcaggatcaaaatcaggaacatcagcaacactagcaataacaggactacaaacagcagacgaagcagaatactactgcgcaacatggtcagcatcactatcatcagcaagagtattcggaacaggaacaagaataacagtacta

SEQ ID NO: 47031 - RNA, 432 nt, synthetic construct
  misc_feature 1..432: note = derived and/or modified sequence opt6 from anti-HIV_CAP256-VRC26.03_HeavyChain
  source 1..432: mol_type = other RNA
gaagtacaattagtagaaagtggaggaggagtagtacaaccaggaaaaagtttaagattaagctgtgcagcaagcagatttagttttaatagatatggaatgcattgggtaagacaagcaccaggaaaaggattagaatgggtagcagcaataagttacgatggaacagataaatatcatgcagataaagtatggggaagatttacaataagtagagataatagtaaaaatacattatatttacaaatgaatagtttaagagcagaagatacagcattatattattgtgcaaaagatttaagagaagatgaatgtgaagaatggtggagtgattattatgattttggaaaacaattaccatgtagaaaaagcagaggagtagcaggaatatttgatggatggggacaaggaacaatggtaacagtaagtagt

SEQ ID NO: 47032 - RNA, 333 nt, synthetic construct
  misc_feature 1..333: note = derived and/or modified sequence opt6 from anti-HIV_CAP256-VRC26.04_LightChain
  source 1..333: mol_type = other RNA
caaccagtactaacacaaccaccatcagtatcagcagcaccaggacaaaaagtaacaatatcatgctcaggatcatcatcaaacataggaaacaacttcgtatcatggtaccaacaaagaccaggaacagcaccatcactactaatatacgaaacaaacaaaagaccatcaggaataccagacagattctcaggatcaaaatcagcaacatcagcaacactagcaataacaggactacaaacaggagacgaagcagactactactgcgcaacatgggcagcatcactaacatcagcaagagtattcggaacaggaacaaaagtaatagtatca

SEQ ID NO: 47033 - RNA, 432 nt, synthetic construct
  misc_feature 1..432: note = derived and/or modified sequence opt6 from anti-HIV_CAP256-VRC26.04_HeavyChain
  source 1..432: mol_type = other RNA
gaagtacaattagtagaaagcggaggaggagtagtacaaccaggaaaaagtttaagattaagctgtgcagcaagccaattctcattcaatagatatggaatgcactgggtaagacaagcaccaggaaaaggattagaatgggtagcagcaatatcatacgatggaacagacaaataccatgcagataaagtatggggaagatttacaataagcagagacaatagcaaaaacacactatatctacaaatgaatagtttaagagcagaagatacagcactatattactgtgcaaaagacttaagagaagacgaatgcgaagaatggtggtcagactattacgatttcggaaaacaactaccatgcagaaaatcaagaggagtagcaggcatattcgataaatggggacaaggaacaatggtaatagtaagctca

SEQ ID NO: 47034 - RNA, 324 nt, synthetic construct
  misc_feature 1..324: note = derived and/or modified sequence opt6 from anti-HIV_CAP256-VRC26.05_LightChain
  source 1..324: mol_type = other RNA
caaagcgcactaacacaaccaccaagcgtatcagcagcaccaggacaaaaagtaacaatatcatgctcaggaaatataggaaacaattacgtaagctggtaccaacaagtaccaggaacagcaccaaaactattaatatatgaaaataacaaaagaccaagcggaataccagacagattctcaggatcaaaatcaggaacaagcgcaacattagtaataacaggactacaaacaggagacgaagcagatttctattgcggaacatggggaggatcattaagaacaggaggagtattaggaacaggaacaagagtaacagtacta

SEQ ID NO: 47035 - RNA, 432 nt, synthetic construct
  misc_feature 1..432: note = derived and/or modified sequence opt6 from anti-HIV_CAP256-VRC26.05_HeavyChain
  source 1..432: mol_type = other RNA
gaagtacaattagtagaaagtggaggaggagtagtacaaccaggaaggagtttaagattaagttgtgcagcaagtcatttttcattatcaagttatggaatgcattgggtaagacaagcaccaggaaaaggactagaatgggtaacaggaataagttttgcaggaacaaaaacatattatggagatagtgtaagaggaagatttacagtaagtagagatataagtaaaaatacattatttttacaaatgaatagtctaagaccagatgatacagcaatgtattattgtgcaagagatcaaagatattatgaatgtgaagaatgggcatcagattattatgattttggaagagaacaaccatgtttagatccaagaggagtagtaggaatatttgatttatggggacaaggaacaatggtaacagtaagtagt

SEQ ID NO: 47036 - RNA, 324 nt, synthetic construct
  misc_feature 1..324: note = derived and/or modified sequence opt6 from anti-HIV_CAP256-VRC26.06_LightChain
  source 1..324: mol_type = other RNA
caatcagtactaacacaaccaccatcagtatcagcagcaccaggacaaaaagtaacaatatcatgctcaggatcaacatcaaaaataggacaaaactcagtatcatggtaccaacaactaccaggaacagcaccaaaactactaatatacgaaaacgacagaagaccatcaggaacaccagacagattctcaggatcaaaaagcggaacatcagcaacactagcaataacaggactacaaacaggagacgaagcagaatactactgcgaaacatgggacggatcaggaggagtattcggaacaggaacaaaagtaacagtacta

SEQ ID NO: 47037 - RNA, 435 nt, synthetic construct
  misc_feature 1..435: note = derived and/or modified sequence opt6 from anti-HIV_CAP256-VRC26.06_HeavyChain
  source 1..435: mol_type = other RNA
gaagtacaattaatagaaagtggaggaggagtagtacaaccaggaagaagtttaagattaagttgtggagcaagtggatttagttttaataattatggaatgcattgggtaagacaagcaccaggaaaaggattagaatgggtagcaggaataagttttgcaggaataaaaaaatattatggaacaagtgtaaaaggaagatttacaataagtagagataatagtaaaaataatttttatttacaaatgaatagtttaagagtagaagatacagcattatattattgtgcaagagatttaagggaattggaatgtgaagaatggacattatataattattatgattttggaagtagaggaccatgtgtagatccaagaggagtggcaggaagttttgatgtatggggacaaggaacaatggtaacagtaagtagt

SEQ ID NO: 47038 - RNA, 333 nt, synthetic construct
  misc_feature 1..333: note = derived and/or modified sequence opt6 from anti-HIV_CAP256-VRC26.07_LightChain
  source 1..333: mol_type = other RNA
caagcagtactaacacaaccaccatcagtatcagcagcaccaggacaaaacgtaacaatatcatgctcaggatcaggatcaaacataggaaacaacttcgtatcatggtaccaacaaagaccaggaacagcaccaaaactactaatatacgaatcaaacaaaagaccatcaggaataccagacagattctcaggatcaaaatcaggaacatcagcaacactagcaataacaggactacaaacaggagacgaagcatactactactgcgcaacatgggcagcaagactaaactcagcaagagtattcggaacaggaacaatggtaacagtacta

SEQ ID NO: 47039 - RNA, 432 nt, synthetic construct
  misc_feature 1..432: note = derived and/or modified sequence opt6 from anti-HIV_CAP256-VRC26.07_HeavyChain
  source 1..432: mol_type = other RNA
gaagtacaattagtagaaagtggaggaggagtagtacaaccaggaagaagtttgagattgagttgtgtaggaagtcaatttagttttaatagatatggaatgcattgggtaagacaagcaccaggaaaaggattagaatgggtggcaggaataagttttgatggaacagatagatatcatgcagataatgtatggggaagatttacaataagtagagataatagtaaaaatacattatatttacaaatgagtagtttaagagcagaagatacagcattatattattgtgcaaaagatttaagagaagatgaatgtgaagaatggtggagtgattattatgattttggaaaaaaattaccatgtagaaaaagtagaggagtagcaggagtatttgataaatggggacaaggaacaatggtaacagtaagtagt

SEQ ID NO: 47040 - RNA, 333 nt, synthetic construct
  misc_feature 1..333: note = derived and/or modified sequence opt6 from anti-HIV_CAP256-VRC26.08_LightChain
  source 1..333: mol_type = other RNA
caatcagcattaacacaaccaccaagcgtaagcgcagcaccaggacaaaaagtaacaataagttgtagcggaaactcaagtaatataggaaacaatttcgtaagctggtaccaacaagtaccaggaacagcaccaaaactattactatatgaaacatacagaagaccaagcggaataccagacagattctcaggatcaaaatcaggaacaagcgcaacattagcaataacaggactacaaacaggagacgaagcagattactattgcacagtatggggagtaagaaaaggagtaggagcagtatttggaacaggaacaaaagtaacagtacta

SEQ ID NO: 47041 - RNA, 438 nt, synthetic construct
  misc_feature 1..438: note = derived and/or modified sequence opt6 from anti-HIV_CAP256-VRC26.08_HeavyChain
  source 1..438: mol_type = other RNA
gaagtacaattagtagaaagtggaggaggagtagtacaaccaggaagaagtttaacattaagttgtgcagcaagtcaatttacatttagtaattatggaatgcattgggtaagacaagcaccaggaaaaggattagaatgggtagcaagtgtaagtaatgatggaacaaaaaaatatcatggagatagtgtatggggaagatttacaataagtagagataatagtaaaaatacattatttttacaaatgagtagtttaagagcagaagatacagcagtatatttttgtgtaagagatcaaagagaagatgaatgtgaagaatggtggagtgattattatgattttggaagagaattaccgtgcagaaaatttagaggattaggattagcaggaatatttgatatatggggacatggaacaatggtaacagtaagtagt

SEQ ID NO: 47042 - RNA, 333 nt, synthetic construct
  misc_feature 1..333: note = derived and/or modified sequence opt6 from anti-HIV_CAP256-VRC26.09_LightChain
  source 1..333: mol_type = other RNA
caatcagcactaacacaaccaccaagcgtaagcgcagcaccaggacaaaaagtaacaataagctgtagcggaaactcaagcaatataggaaacaatttcgtaagctggtaccaacaattaccaggaacagcaccaaaactattaatatatgaaaataacagaagaccaagcggaataccagacagattctcaggatcaaaatcaggaacaagcgcaacattagcaataagcggactacaaacaggagacgaagcagattactggtgcgcagtatggggagtaagaagaggagcaggagcagtatttggagcaggaacaaaagtaacagtacta

SEQ ID NO: 47043 - RNA, 438 nt, synthetic construct
  misc_feature 1..438: note = derived and/or modified sequence opt6 from anti-HIV_CAP256-VRC26.09_HeavyChain
  source 1..438: mol_type = other RNA
gaagtacaattagtagaaagcggaggaggagtagtacaaccaggaagaagtttaacattaagttgtgcagcaagccaattcaatttcgcaaactatggaatgcactgggtaagacaagcaccaggaaaagggctagaatgggtagcatcaatatcaaacgatggaacaaaaaaataccatgaagaaagcgtatggggaagatttacaataagcaaagacaatagcaaaagcacactatttttacaaatgaatagcttaagaatagaagatacagcactatatttctgtgtaaaagaccaacgagaagacgaatgcgaagaatggtggtcagactattacgatttcggaagagaattaccatgcagaaaatcaagaggactaggactagcaggaatattcgatatgtggggacatggaacaatggtaacagtaagttca

SEQ ID NO: 47044 - RNA, 333 nt, synthetic construct
  misc_feature 1..333: note = derived and/or modified sequence opt6 from anti-HIV_CAP256-VRC26.10_LightChain
  source 1..333: mol_type = other RNA
caatcagtactaacacaaccaccatcagtatcagcagcaccaggacaaaaagtaacaatatcatgctcaggatcatcatcaaacataggagacaactacgtatcatggtaccaacacctaccaggaacagcaccaaaactactaatatacgaaaacacaagaagaccatcaggaataccagacagattctcaggatcaaaatcaggaacatcagcaacactagcaataacaggactacaaacaggagacgaagcagactactactgcggaacatgggacgtaagaccaaacagaggagcagtattcggaacaggaacaaaagtaacagtacta

SEQ ID NO: 47045 - RNA, 432 nt, synthetic construct
  misc_feature 1..432: note = derived and/or modified sequence opt6 from anti-HIV_CAP256-VRC26.10_HeavyChain
  source 1..432: mol_type = other RNA
caagcaatattagtagaaagtggaggaggagtagtacaaccaggaagaagtttaagattaagttgtgcagcaagtcaatttacatttagtggacatggattacattgggtaagacaagcaccaggaaaaggactagaatgggtagcaagtataagttttgcaggaacaaaaatggattatgcagatagtgtaaaaggaagatttgcaataagtagagataatagtaaaaatacattatatttacaaatgaatagtttaagagtagaagatacagcattatattattgtgcaaaagatatgagagaatatgaatgtgaatattggacatcagattattatgattttggaagaccacaaccatgtatagatagaagaggagtagtaggaatatttgatatgtggggacaaggaacaatggtaacagtaagtaca

SEQ ID NO: 47046 - RNA, 321 nt, synthetic construct
  misc_feature 1..321: note = derived and/or modified sequence opt6 from anti-HIV_CAP256-VRC26.11_LightChain
  source 1..321: mol_type = other RNA
caatcagtattaacacaaccaccatcagtatcagcagcaccaggacaaaacgtaacaatatcatgttcaggaccaccatcacatatagaaaaaaatgacgtatcatggtaccaaagactaccaggaatggcaccaaaaatggtaatatatgaatcaaaaagaagaccactaggaataccagtaagattctcagcatcaagatcaggatcatcagcaacattagtaataacaggactacaaacagcagacgaagcagattactactgcggaacatgggacggaagaatgaactttggcacaggaacaacagtatcagtacta

SEQ ID NO: 47047 - RNA, 429 nt, synthetic construct
  misc_feature 1..429: note = derived and/or modified sequence opt6 from anti-HIV_CAP256-VRC26.11_HeavyChain
  source 1..429: mol_type = other RNA
gaagtacaattagtggaaagtggaggaggagtagtaccaccaggaaaaagtttaacattaagttgtgtagcaagtagatttacatttagtgcatttggaatgcattgggtaagacaagcaccaggaaaaggattagaatgggtagcaagtataagttttgcaggaataaaaaaatattatgcagatagtgtaaaaggaagatttagtataagtagagataatagtaatacattatttttacaaatgaatggattaagaggagaagatacaggattatatcattgtgtaaaagatatgagagaattagaatgtgaagaatgggcaagcgattattatgattttggaaaaccacaaccatgtttagatagaagaggagtaagtggaataagtgcatggtggggaccaggaacaatggtaacagtaagtagt

SEQ ID NO: 47048 - RNA, 321 nt, synthetic construct
  misc_feature 1..321: note = derived and/or modified sequence opt6 from anti-HIV_CAP256-VRC26.12_LightChain
  source 1..321: mol_type = other RNA
caatcagtactaacacaaccaccatcagtatcaacagcaccaggacaaacagtaacagtatcatgctcaggaggaacatcaaacacaggaaacaacttcgtatcatggtaccaacacctaccaggaacagcaccaaaactattaatatacgaaaacaacaaaagaccactaggagtaccagacagattctcaggagcaaaatcaggaacatcagcaacactagcaataacaggactacaaacaggagacgaaggagactactactgcgcaacatggtcaggaagcctaaacataggaacaggaacaaaagtatcagtacta

SEQ ID NO: 47049 - RNA, 432 nt, synthetic construct
  misc_feature 1..432: note = derived and/or modified sequence opt6 from anti-HIV_CAP256-VRC26.12_HeavyChain
  source 1..432: mol_type = other RNA
gaagtacaattggtacaaagtggaggaggagtagtacaaccaggaagaagcttaagattaagttgtgcagcaccatattttgaatttggaagatatggatttcattgggtaagacaagcaccaggaaaaggattagaatgggtggcaagtataagttttgcaggaagagattattatcatagtccaagtgtatgggggagatttacaataagtagagataatagtaaaaatacattatatttacaaatgaatagtttaagaatagaagatacagcactatatttttgtgcaagagatttaagagaaagcgaatgtgaagaatgggaaagtgattattatgattttggaaaaaaaggaccatgtgtaaaaccaagaggagtagcaggaggattagatctatggggacaaggaacaatggtaatagtaagtagt

SEQ ID NO: 47050 - RNA, 333 nt, synthetic construct
  misc_feature 1..333: note = derived and/or modified sequence opt6 from anti-HIV_CAP256-VRC26.I1_LightChain
  source 1..333: mol_type = other RNA
caaagcgtattaacacaaccaccaagcgtaagcgcagcaccaggacaaaaagtaacaataagctgtagcggaagctcaagcaatataggaaacaattacgtaagctggtaccaacaattaccaggaacagcaccaaaactattaatatataaaaataacgaaagaccaagcggaataccagacagattctcaggatcaaaatcaggaacaagcgcaacattaggaataacaggactacaaacaggagacgaagcagattactattgcggaacatgggacacatcattaagcgcaggaggagtatttggaacaggaacaaaagtaacagtacta

SEQ ID NO: 47051 - RNA, 432 nt, synthetic construct
  misc_feature 1..432: note = derived and/or modified sequence opt6 from anti-HIV_CAP256-VRC26.I1_HeavyChain
  source 1..432: mol_type = other RNA
caagtacaattagtagaaagtggaggaggagtagtacaaccaggaagatcattaagattaagctgtgcagcaagcggattcacattcagcaactatgcaatggactgggtaagacaagcaccaggaaaaggactagaatgggtagcagtaatatcaagtgatggatcaaacaaaaactatgcagatagcgtaaaaggaagatttacaataagcagagacaatagtaaaaacacactatatttacaaatgaatagcttaagagcagaagatacagcagtatattactgtgcaaaagacttaggagaaaacaaaaacgatgaatgggcaacagactattacgatctatcaatagcatacccagtacaagacccaagagcagtagtaggagcattcgatatatggggacaaggaacaatggtaacagtaagctca

SEQ ID NO: 47052 - RNA, 333 nt, synthetic construct
  misc_feature 1..333: note = derived and/or modified sequence opt6 from anti-HIV_CAP256-VRC26.I2_LightChain
  source 1..333: mol_type = other RNA
caatcagtactaacacaaccaccatcagtatcagcagcaccaggacaaaaagtaacaatatcatgctcaggatcatcatcaacaataggaaacaactacgtatcatggtaccaactattaccaggaacagcaccaaaactactaatatacaaaaacgacaaaagaccatcaggaataccagacagattctcaggatcaaaatcaggaacatcagcaacactaggaataacaggactacaaacaggagacgaagcagactactactgcggaacatgggacacatcactatcagcaggaggagtattcggaacaggaacaaaagtaacagtacta

SEQ ID NO: 47053 - RNA, 432 nt, synthetic construct
  misc_feature 1..432: note = derived and/or modified sequence opt6 from anti-HIV_CAP256-VRC26.I2_HeavyChain
  source 1..432: mol_type = other RNA
caagtacaattagtagaaagcggaggaggagtagtacaaccaggaagaagcctaagattaagctgtgcagcaagcggattcacattctcaaactttgcaatgggatgggtaagacaagcaccaggaaaaggactagaatgggtagcatttatatcgagcgatggatcaaataaaaactatggagatagcgtaaaaggaagatttacaataagcagagacaatagcaaaaacacactatttctacaaatgaatagcttaagagcagaagatacagcactatattactgtgcaaaagacgtaggagaatacaaaagcgatgaatgggcaacagactattacgatctatcaatagcatacccaatacaagacccacgagcaatggtaggagcattcgatatatggggacaaggaacaatggtaacagtaagctca

SEQ ID NO: 47054 - RNA, 333 nt, synthetic construct
  misc_feature 1..333: note = derived and/or modified sequence opt6 from anti-HIV_CAP256-VRC26.UCA_LightChain
  source 1..333: mol_type = other RNA
caatcagtactaacacaaccaccatcagtatcagcagcaccaggacaaaaagtaacaatatcatgcagcggctcatcaagcaatataggaaacaattacgtatcatggtaccaacaattaccaggaacagcaccaaaactattaatatacgaaaataacaaaagaccatcaggaataccagacagattctcaggaagcaaatcaggaacatcagcaacactaggaataacaggactacaaacaggagacgaagcagactactactgcggaacatgggactcatcactatcagcaggaggagtattcggaacaggaacaaaagtaacagtacta

SEQ ID NO: 47055 - RNA, 432 nt, synthetic construct
  misc_feature 1..432: note = derived and/or modified sequence opt6 from anti-HIV_CAP256-VRC26.UCA_HeavyChain
  source 1..432: mol_type = other RNA
caagtacaattagtagaaagcggaggaggagtagtacaaccaggaagaagtttaagattaagctgtgcagcaagtggatttacatttagtagttatggaatgcattgggtaagacaagcaccaggaaaaggattagaatgggtagcagtaataagttatgatggaagtaataaatattatgcagatagtgtaaaagggagatttacaataagtagagataatagtaaaaatacactatatttacaaatgaatagtttaagagcagaagatacagcagtatattattgtgcaaaagatctaggagaaagtgaaaatgaagaatgggcaacagattattatgattttagtataggatatccaggacaagatccaagaggagtagtaggagcatttgatatatggggacaaggaacaatggtaacagtaagtagt

SEQ ID NO: 47056 - RNA, 324 nt, synthetic construct
  misc_feature 1..324: note = derived and/or modified sequence opt6 from anti-HIV_CH01_LightChain
  source 1..324: mol_type = other RNA
gaaatagtactagcacaatcaccaggaacattatcattaagcccaggagaaagagcaacattaagctgtagagcaagccataacgtacacccaaaatatttcgcatggtatcaacaaaaaccaggacaaagcccaagattactaatatacggaggaagcacaagagcagcaggaataccaggaaaatttagcggaagcggaagcggaacagatttcacactaacaatatcaagagtagacccagaagatttcgcagtatattactgtcaacaatacggaggatcaccatatacatttggacaaggaacaaaagtagaaataaaa

SEQ ID NO: 47057 - RNA, 399 nt, synthetic construct
  misc_feature 1..399: note = derived and/or modified sequence opt6 from anti-HIV_CH01_HeavyChain
  source 1..399: mol_type = other RNA
gaagtacaattagtagaaagtggagcaaatgtagtaagaccaggaggaagtttaagattaagctgtaaagcaagtggatttatatttgaaaattttggatttagttgggtaagacaagcaccaggaaaaggattacaatgggtagcaggattaaattggaatggaggagatacaagatatgcagatagtgtaaaaggaagatttagaatgagtagagataatagtagaaattttgtatatttagatatggataaagtaggagtagatgatacagcattttattattgtgcaagaggaacagattatacaatagatgatgcaggaatacattatcaaggaagtggaacattttggtattttgatttatggggaagaggaacattagtaagtgtaagtagt

SEQ ID NO: 47058 - RNA, 324 nt, synthetic construct
  misc_feature 1..324: note = derived and/or modified sequence opt6 from anti-HIV_CH02_LightChain
  source 1..324: mol_type = other RNA
gaaatagtactaacacaatcaccagcaacattaagcgtaagcccaggagaaagagcaacattaagctgtagagcaagccaaaacgtacacccaagatatttcgcatggtatcaacaaaaaagaggacaaagcccaagattactaatacactcaggatcaacaagagcagcaggaatagcagatagatttagtggaggaggaagcggaatgcatttcacactaacaataacaagagtagaaccagaagatttcgcagtatatttctgtcaacaatacggaggatcaccatatacatttggacaaggaacaagagtagaattaaga

SEQ ID NO: 47059 - RNA, 399 nt, synthetic construct
  misc_feature 1..399: note = derived and/or modified sequence opt6 from anti-HIV_CH02_HeavyChain
  source 1..399: mol_type = other RNA
gaagtacaattagtagaaagtggaggaagtgtagtaagaccaggaggaagtttaagattaagttgtagagcaagtggatttatatttgaaaattatggattaacatgggtaagacaagtaccaggaaaagggttacattgggtaagcggaatgaattggaatggaggagatacaagatatgcagatagtgtaagaggaagatttagtatgagtagagataatagtaataatatagcatatttacaaatgaataatttaagagtagaagatacagcattatattattgtgcaagaggaacagattatacaatagatgatcaaggaagattttatcaaggatcaggaacattttggtattttgatttttggggaaggggaacattagtaacagtaagcagt

SEQ ID NO: 47060 - RNA, 324 nt, synthetic construct
  misc_feature 1..324: note = derived and/or modified sequence opt6 from anti-HIV_CH03_LightChain
  source 1..324: mol_type = other RNA
gaaatagtactaacacaatcaccagcaacattatctttaagcccaggagaaagagcaacattaagctgtagagcaagccaaagcgtacacccaaaatatttcgcatggtatcaacaaaaaccaggacaaagcccaagattattaatatacagcggatcaacaagagcagcaggaatagcagatagatttagcggaggaggaagcggaatacatttcacactaacaataacaagagtagaaccagaagatttcgcagtatatttctgtcaacaatacggaggatcaccatatacatttggacaaggaacaaaagtagaattaaga

SEQ ID NO: 47061 - RNA, 399 nt, synthetic construct
  misc_feature 1..399: note = derived and/or modified sequence opt6 from anti-HIV_CH03_HeavyChain
  source 1..399: mol_type = other RNA
gaagtgcaattagtagaaagtggaggaggagtagtaagaccaggaggaagtttaagattaagttgtgcagcaagtggatttatatttgaaaattatggattaacatgggtaagacaagtaccaggaaaaggattacattgggtaagtggaatgaattggaatggaggagatacaagatatgcagatagtgtaagaggaagatttagtatgagtagagataatagcaataatatagcatatttacaaatgaaaaatttaagagtagatgatacagcattatattattgtgcaagaggaacagattatacaatagatgatcaaggaatattttataaaggaagtggaacattttggtattttgatttatggggaagaggaacattagtaacagtaagtagt

SEQ ID NO: 47062 - RNA, 324 nt, synthetic construct
  misc_feature 1..324: note = derived and/or modified sequence opt6 from anti-HIV_CH04_LightChain
  source 1..324: mol_type = other RNA
gaaatagtactaacacaatcaccagatacattatcattaagcccaggagaaagagcaacattaagctgtagagcaagccaaagcgtacacagcagatatttcgcatggtatcaacataaaccaggacaaccaccaagattactaatatacggaggatcaacaagagcaacaggaataccaaatagatttagcgcaggaggaagcggaacacaattcacactaacagtaaatagattagaagcagaagatttcgcagtatattactgtcaacaatacggaagatcaccatatacatttggacaaggaacaaaagtagaaataaga

SEQ ID NO: 47063 - RNA, 399 nt, synthetic construct
  misc_feature 1..399: note = derived and/or modified sequence opt6 from anti-HIV_CH04_HeavyChain
  source 1..399: mol_type = other RNA
gaagtacaattagtagaaagtggaggaggattaataaggccgggaggaagtttaagattaagttgtaaaggaagtgggtttatatttgaaaattttggatttggatgggtaagacaaggaccaggaaaaggattagaatgggtaagtggaacaaattggaatggaggagatagtagatatggagatagtgtaaaaggaagatttacaataagtagagataatagtaataattttgtatatttacaaatgaatagtttaaggccagaagatacagcaatatattattgtgcaagaggaacagattatacaatagatgatcaaggaataagatatcaaggaagtggaacattttggtattttgatgtatggggaagaggaacattagtaacagtaagtagt

SEQ ID NO: 47064 - RNA, 627 nt, synthetic construct
  misc_feature 1..627: note = derived and/or modified sequence opt6 from anti-HIV_CH103_LightChain
  source 1..627: mol_type = other RNA
tacgaactaacacaaccaccatcagtatcagtctcaccaggccaaacagcaacaattacgtgctcaggagcatcaacaaacgtatgctggtaccaagtaaaaccaggacaatcaccagaagtagtaatattcgaaaactacaaaagaccatcaggaataccagacagattctcaggatcaaaatcaggatcaacagcaacactaacaataagaggaacacaagcaatagatgaagccgactactactgccaagtttgggactcattctcaacattcgtattcggatcaggaacacaagtaacagtattaagacaaccaaaagcaaacccaacagtaacactattcccaccatcttccgaagaactacaagcaaacaaagccacactagtatgccttatatcagacttctaccccggagcagtaacagtagcatggaaagcagactcatcaccagtaaaagcaggagtagaaaccacaacaccctcaaaacaatctaacaacaaatacgcagcatcatcatatctatcactaacaccagaacaatggaaatcccacagatcatactcctgccaagtaacacacgaaggaagcacagtagaaaaaacagtagcaccaacagaatgctca

SEQ ID NO: 47065 - RNA, 678 nt, synthetic construct
  misc_feature 1..678: note = derived and/or modified sequence opt6 from anti-HIV_CH103_HeavyChain
  source 1..678: mol_type = other RNA
caagtacaattacaagaaagcggaccaggtgtagtaaaatcatcagaaacactatcattaacatgtacagtcagtggaggatctatgggaggaacatactggtcatggctaagattatctccaggtaaaggattagaatggattggatatatatttcacacaggagaaacaaattactcaccatcactaaaaggacgagtatcaatatcagtagatacatctgaagatcaattttcattaagattaagatcagtaacagcagcagacacagcagtatacttttgcgctagcttaccaagaggacaactagtaaacgcatactttagaaattggggaagaggatcattagtatcagtaacagcagcatcaacaaaaggaccatcagttttcccattagcaccaagttcaaaatctacctctggaggaacagcagcactaggatgcctagtaaaagattattttccagaaccagtaacagtaagctggaactcaggagcattaacatcaggagtacacacctttccagcagtactacaatcatcaggactatattcactaagctcagtagtaacagtaccatcttcatcactaggaacacaaacatatatatgtaacgtaaaccataaaccatcaaatacaaaagtagataaaaaagtagaaccaaaatcatgtgacaaa

SEQ ID NO: 47066 - RNA, 321 nt, synthetic construct
  misc_feature 1..321: note = derived and/or modified sequence opt6 from anti-HIV_M66.6_LightChain
  source 1..321: mol_type = other RNA
gacatacaactaacacaatcaccatcatcactatcagcatcagtaggagatagagtaacaataacatgcagagcatcacaatcaataggatcatacctaaactggtaccaacaaaaaccaggaaaagcaccaaaactactaatatacgcagcatcaacactacaatcaggagtaccatcaagattctcaggctcaggatcaggaacagacttcacactaacaatatcatcactacaaccagaagactcagcaacatactactgccaacaatcatactcaacaccattcacattcggaccaggaacaaaagtagacataaga

SEQ ID NO: 47067 - RNA, 390 nt, synthetic construct
  misc_feature 1..390: note = derived and/or modified sequence opt6 from anti-HIV_M66.6_HeavyChain
  source 1..390: mol_type = other RNA
caagtacaattagtacaaagcggagcagaagtaaaaaaaccaggagaaagcttaaaaataagctgtaaagtaagcggatacaatttcgcaagcgaatggataggatgggtaagacaaatgccaggaaaaggactagaatggatgggaataatatatccaggagactcagacacaaaatatagcccaagctttcaaggacaagtaataataagtgcagacaaaagcataaacacagcatatctacaatggtcaagcttaaaagcaagcgatacagcaatatattactgtgcaagacaaaatcactatggatcaggatcatacttttacagaacagcatactattacgcaatggatgtatggggacaaggaacaacagtaacagtaagctca

SEQ ID NO: 47068 - RNA, 327 nt, synthetic construct
  misc_feature 1..327: note = derived and/or modified sequence opt6 from anti-HIV_NIH45-46_LightChain
  source 1..327: mol_type = other RNA
gaaatagtactaacacaatcaccagcaacattaagcctaagcccaggagaaacagcaataataagctgtagaacaagtcaaagcggatcattagcatggtaccaacaaagaccaggacaagcaccaagattagtaatatatagcggaagcacaagagcagcaggaataccagacagattcagcggatcaagatggggagcagactataacttaagcataagtaatctagaaagcggagactttggagtatactattgccaacaatatgaatttttcggacaaggaacaaaagtacaagtagatataaaaagaacagtagcagcacca

SEQ ID NO: 47069 - RNA, 399 nt, synthetic construct
  misc_feature 1..399: note = derived and/or modified sequence opt6 from anti-HIV_NIH45-46_HeavyChain
  source 1..399: mol_type = other RNA
caagtaagattaagtcaaagcggaggacaaatgaaaaaaccaggagaaagcatgagattaagttgtagagcaagcggatatgaatttttaaattgtccaataaattggataagattagcaccaggaagaagaccagaatggatgggatggctaaaaccaagaggaggagcagtaaattatgcaagaaaatttcaaggaagagtaacaatgacaagagatgtatatagtgatacagcatttttagaattaagaagtttaacatcagatgatacagcagtatatttttgtacaagaggaaaatattgtacagcaagagattattataattgggattttgaacattggggaagaggagcaccagtaacagtaagtagtgcaagtacaaaaggaccaagtgta

SEQ ID NO: 47070 - RNA, 330 nt, synthetic construct
  misc_feature 1..330: note = derived and/or modified sequence opt6 from anti-HIV_PG16_LightChain
  source 1..330: mol_type = other RNA
caaagcgcactaacacaaccagcatcagtatcaggatcaccaggacaaacaataacaatatcatgcaatggaacaagctcagacgtaggaggattcgatagcgtaagctggtaccaacaatcaccaggaaaagcaccaaaagtaatggtatttgacgtaagccatagaccaagcggaatatcaaacagattctcaggatcaaaatcaggaaatacagcatcattaacaataagcggactacatatagaagacgaaggagattacttttgcagcagcttaacagatagatcacacagaatatttggaggaggaacaaaagtaacagtacta

SEQ ID NO: 47071 - RNA, 411 nt, synthetic construct
  misc_feature 1..411: note = derived and/or modified sequence opt6 from anti-HIV_PG16_HeavyChain
  source 1..411: mol_type = other RNA
caagaacaattagtagaaagtggaggaggagtagtacaaccaggaggaagcttaagattaagttgtttagcaagtggatttacatttcataaatatggaatgcattgggtaagacaagcaccaggaaaaggattagaatgggtagcattaataagtgatgatggaatgagaaaatatcatagtgatagtatgtggggaagagtaacaataagtagagataatagtaaaaatacattatatttacaatttagtagtttaaaagtagaagatacagcaatgtttttttgtgcaagagaagcaggaggaccaatatggcatgatgatgtaaaatattatgattttaatgatggatattataattatcattatatggatgtatggggaaaaggaacaacagtaacagtaagtagt

SEQ ID NO: 47072 - RNA, 315 nt, synthetic construct
  misc_feature 1..315: note = derived and/or modified sequence opt6 from anti-HIV_PGT122_LightChain
  source 1..315: mol_type = other RNA
acattcgtaagtgtagcaccaggacaaacagcaagaataacatgtggagaagaatcattaggaagcagaagcgtaatatggtatcaacaaagaccaggacaagcaccatcactaataatatataacaataacgacagaccaagcggaataccagacagattctcaggatcaccaggaagcacattcggaacaacagcaacactaacaataacaagcgtagaagcaggagatgaagcagactattactgtcacatatgggacagcagaagaccaacaaattgggtattcggagaaggaacaacactaatagtatta

SEQ ID NO: 47073 - RNA, 396 nt, synthetic construct
  misc_feature 1..396: note = derived and/or modified sequence opt6 from anti-HIV_PGT122_HeavyChain
  source 1..396: mol_type = other RNA
caagtacacctacaagaatcaggaccaggattagtaaaaccatcagaaacactaagcctaacatgtaacgtatcaggaacattagtaagagacaattactggtcatggataagacaaccactaggtaaacaaccagaatggataggatatgtacacgactcaggagacacaaactacaacccatcactaaaatcaagagtacacctatcactagacaaaagcaaaaatctagtatcactaagactaacaggagtaacagcagcagactcagcaatatactactgcgcaacaacaaaacacggaagaagaatatacggagtagtagcattcaaagaatggttcacatatttctacatggacgtatggggaaaaggaacatcagtaacagtatcatca

SEQ ID NO: 47074 - RNA, 315 nt, synthetic construct
  misc_feature 1..315: note = derived and/or modified sequence opt6 from anti-HIV_PGT123_LightChain
  source 1..315: mol_type = other RNA
agcagcatgtcagtatcaccaggagaaacagcaaaaatatcatgcggaaaagaaagcataggatcaagagcagtacaatggtatcaacaaaaaccaggacaaccaccatcattaataatatacaataaccaagacagaccagcaggagtaccagaaagatttagcgcaagcccagactttagaccaggaacaacagcaacactaacaataacaaatgtagatgcagaagacgaagcagattactattgccatatatatgacgcaagaggaggaacaaactgggtatttgacagaggaacaacattaacagtacta

SEQ ID NO: 47075 - RNA, 396 nt, synthetic construct
  misc_feature 1..396: note = derived and/or modified sequence opt6 from anti-HIV_PGT123_HeavyChain
  source 1..396: mol_type = other RNA
caattacacttacaagaatcaggaccaggactagtaaaaccaccagaaacattaagcttaacatgtagcgtaagcggagcatcaataaatgacgcatactggagctggataagacaatcaccaggaaaaagaccagaatgggtaggatatgtacatcactcaggagacacaaattacaatccatcactaaaaagaagagtaacattctcattagatacagcaaaaaatgaagtatcattaaaattagtagatttaacagcagcagactcagcaacatacttttgcgcaagagcactacatggaaaaagaatatacggaatagtagcattaggagaactatttacatatttctatatggatgtatggggaaaaggaacagcagtaacagtaagctca

SEQ ID NO: 47076 - RNA, 315 nt, synthetic construct
  misc_feature 1..315: note = derived and/or modified sequence opt6 from anti-HIV_PGT125_LightChain
  source 1..315: mol_type = other RNA
caatcagcattaacacaaccaccatcagcatcaggatcaccaggacaatcaataacaatatcatgtaacggaacagcaacaaatttcgtatcatggtaccaacaatttccagataaagcaccaaaactaataatattcggagtagacaaaagaccaccaggagtcccagacagattctcaggatcaagatcaggaacaacagcatcactaacagtatcaagactacaaacagacgacgaagcagtatactactgcggatcattagtaggaaactgggacgtaatattcggaggaggaacaacactaacagtacta

SEQ ID NO: 47077 - RNA, 411 nt, synthetic construct
  misc_feature 1..411: note = derived and/or modified sequence opt6 from anti-HIV_PGT125_HeavyChain
  source 1..411: mol_type = other RNA
caatcacaactacaagaatcaggaccaagattagtagaagcatcagaaacactatcattaacatgcaatgtatcaggagaatcaacaggagcatgcacatacttttggggatgggtaagacaagcaccaggcaaaggactagaatggataggaagcttatcacattgccaatcattttggggatcaggatggacattccataacccatcattaaaatcaagattaacaatatcattagacacaccaaaaaaccaagtatttctaaaactaacatcattaacagcagcagatacagcaacatattactgtgcaagattcgacggagaagtattagtatataaccattggccaaaaccagcatgggtagatctatggggaagaggaataccagtaacagtaacagtatcatca

SEQ ID NO: 47078 - RNA, 315 nt, synthetic construct
  misc_feature 1..315: note = derived and/or modified sequence opt6 from anti-HIV_PGT126_LightChain
  source 1..315: mol_type = other RNA
caatcagcactaacacaaccaccatcagcatcaggatcaccaggacaatcaatatcaatatcatgcacaggaacatcaaacagattcgtatcatggtaccaacaacacccaggaaaagcaccaaaactagtaatatacggagtaaacaaaagaccatcaggagtaccagacagattctcaggatcaaaatcaggaaacacagcatcactaacagtatcaggactacaaacagacgacgaagcagtatactactgctcatcactagtaggaaactgggacgtaatattcggaggaggaacaaaactaacagtacta

SEQ ID NO: 47079 - RNA, 411 nt, synthetic construct
  misc_feature 1..411: note = derived and/or modified sequence opt6 from anti-HIV_PGT126_HeavyChain
  source 1..411: mol_type = other RNA
caaccacaactacaagaatcaggaccaggattagtagaagcatcagaaacactatcattaacatgcacagtatcaggagattcaacagcagcatgcgattacttttggggatgggtaagacaaccaccaggaaaaggattagaatggataggaggattatcacattgcgcaggctattacaatacaggatggacataccataacccatcattaaaatcaagattaacaatatcattagacactccaaaaaaccaagtatttctaaaactaaattcagtaacagcagcagatacagcaatatattactgtgcaagattcgatggagaagtattagtatatcacgattggccaaaaccagcatgggtagatctatggggaagaggaacactagtaacagtaacagtatcatca

SEQ ID NO: 47080 - RNA, 315 nt, synthetic construct
  misc_feature 1..315: note = derived and/or modified sequence opt6 from anti-HIV_PGT127_LightChain
  source 1..315: mol_type = other RNA
caatcagcattaacacaaccaccatcagcatcaggatcaccaggacaatcaataacaataagctgtacaggaacatcaaacaatttcgtatcatggtaccaacaatatccaggaaaagcaccaaaattagtaatatatgaagtaaacaaaagaccatcaggagtaccagacagattctcaggatcaaaatcaggatcaacagcatcactaacagtaagcggactacaagcagacgacgaaggagtatactactgctcatcattagtaggaaactgggacgtaatatttggaggaggaacaaaattaacagtacta

SEQ ID NO: 47081 - RNA, 405 nt, synthetic construct
  misc_feature 1..405: note = derived and/or modified sequence opt6 from anti-HIV_PGT127_HeavyChain
  source 1..405: mol_type = other RNA
caaccacaactacaagaatcaggaccaggattagtagaagcatcagaaacactaagtttaacatgcacagtatcaggagattcaacaggaagatgcaattacttttggggttgggtaagacaaccaccaggaaaaggattagaatggataggatcattatcacactgcagatcatattacaatacagactggacatatcataacccatcactaaaatcaagattaacaatatcattagacacaccaaaaaaccaagtatttctaagactaacaagtgtaacagcagcagatacagcaacatattactgtgcaagattcggaggagaagtattagtatacagagactggccaaaaccagcatgggtagatctatggggaagaggaacattagtaacagtatcatca

SEQ ID NO: 47082 - RNA, 315 nt, synthetic construct
  misc_feature 1..315: note = derived and/or modified sequence opt6 from anti-HIV_PGT128_LightChain
  source 1..315: mol_type = other RNA
caatcagcactaacacaaccaccatcagcatcaggatcaccaggacaatcaataacaatatcatgcacaggaacatcaaacaacttcgtatcatggtaccaacaacacgcaggaaaagcaccaaaactagtaatatacgacgtaaacaaaagaccatcaggagtaccagacagattctcaggatcaaaatcaggaaacacagcatcactaacagtatcaggactacaaacagacgacgaagcagtatactactgcggatcactagtaggaaactgggacgtaatattcggaggaggaacaaaactaacagtacta

SEQ ID NO: 47083 - RNA, 405 nt, synthetic construct
  misc_feature 1..405: note = derived and/or modified sequence opt6 from anti-HIV_PGT128_HeavyChain
  source 1..405: mol_type = other RNA
caaccacaactacaagaatcaggaccaacattagtagaagcatcagaaacactatcactaacatgcgcagtatcaggagattcaacagcagcatgcaattcattttggggatgggtaagacaaccaccaggaaaaggactagaatgggtaggaagcttatcacattgcgcatcatattggaatagaggatggacataccataacccatcattaaaatcaagattaacattagcattagacacaccaaaaaacttagtatttttaaaactaaattcagtaacagcagcagatacagcaacatattactgtgcaagattcggaggagaagtattaagatatacagattggccaaaaccagcatgggtagatctatggggaagaggaacactagtaacagtatcatca

SEQ ID NO: 47084 - RNA, 330 nt, synthetic construct
  misc_feature 1..330: note = derived and/or modified sequence opt6 from anti-HIV_PGT130_LightChain
  source 1..330: mol_type = other RNA
caaagtgcactaacacaaccaccatcagcatcaggatcattaggacaatcagtaacaatatcatgcaatggaacaagttcagacataggaggatggaattttgtaagctggtatcaacaatttccaggaagagcaccaagactaataatatttgaagtaaataaaagaccaagcggagtaccaggaagattctcaggatcaaaatcaggaaatagcgcaagtctaacagtaagcggactacaaagcgatgacgaaggacaatacttttgctcaagcttatttggaagatgggacgtagtatttggaggaggaacaaaattaacagtatta

SEQ ID NO: 47085 - RNA, 387 nt, synthetic construct
  misc_feature 1..387: note = derived and/or modified sequence opt6 from anti-HIV_PGT130_HeavyChain
  source 1..387: mol_type = other RNA
caagtacaactacaagaatcaggaccaggattagtaaaaccagcagaaacactatcactaacatgctcagtatcaggagaatcaataaacacaggacactactactggggatgggtaagacaagtaccaggaaaaggactagaatggataggacacatacactacacaacagcagtactacacaacccatcactaaaatcaagactaacaataaaaatatatacactaagaaatcaaataacactaagactatcaaacgtaacagcagcagacacagcagtataccactgcgtaagatcaggaggagacatactatactactacgaatggcaaaaaccacactggttctcaccatggggaccaggaatacacgtaacagtatcatca

SEQ ID NO: 47086 - RNA, 330 nt, synthetic construct
  misc_feature 1..330: note = derived and/or modified sequence opt6 from anti-HIV_PGT131_LightChain
  source 1..330: mol_type = other RNA
caaagtgcattaacacaaccaccatcagcatcaggatcattaggacaatcattaacaatatcatgttcaggaacaggatcagatataggatcatggaattttgtaagctggtatcaacaatttccaggaagagcaccaaatttaataatatttgaagtaaacagaagaagatcaggagtaccagacagattctcaggatcaaaatcaggaaatacagcaagtttaacagtaagcggactaagaagtgaagacgaagcagaatatttttgttcaagtttaagtggaagatgggacatagtatttggaggaggaacaaaagtaacagtatta

SEQ ID NO: 47087 - RNA, 387 nt, synthetic construct
  misc_feature 1..387: note = derived and/or modified sequence opt6 from anti-HIV_PGT131_HeavyChain
  source 1..387: mol_type = other RNA
caagtacaactacaagaatcaggaccaggactagtaaaaccatcagaaacactatcactaacatgcacagtatcaggagactcaataaacacaggacaccactactggggatgggtaagacaagtaccaggaaaaggaccagaatggatagcacacatacactacaacacagcagtactacacaacccagcattaaaatcaagagtaacaataagcatattcacactaaaaaacctaataacactatcactatcaaacgtaacagcagcagacacagcagtatacttctgcgtaagatcaggaggagacatactatactacatagaatggcaaaaaccacactggttctacccatggggaccaggaatactagtaacagtatcatca

SEQ ID NO: 47088 - RNA, 321 nt, synthetic construct
  misc_feature 1..321: note = derived and/or modified sequence opt6 from anti-HIV_PGT135_LightChain
  source 1..321: mol_type = other RNA
gaaatagtaatgacacaatcaccagacacactatcagtatcaccaggagaaacagtaacactatcatgcagagcatcacaaaacataaacaaaaacctagcatggtaccaatacaaaccaggacaatcaccaagactagtaatattcgaaacatactcaaaaatagcagcattcccagcaagattcgtagcatcaggatcaggaacagaattcacactaacaataaacaacatgcaatcagaagacgtagcagtatactactgccaacaatacgaagaatggccaagaacattcggacaaggaacaaaagtagacataaaa

SEQ ID NO: 47089 - RNA, 399 nt, synthetic construct
  misc_feature 1..399: note = derived and/or modified sequence opt6 from anti-HIV_PGT135_HeavyChain
  source 1..399: mol_type = other RNA
caattacaaatgcaagaaagtggaccaggattagtaaaaccaagtgaaacattaagtttaagttgtacagtaagtggagatagtataagaggaggagaatggggagataaagattatcattggggatgggtaagacatagtgcaggaaaaggattagaatggataggaagcatacattggagaggaacaacacattataaagaaagtttaagaagaagagtaagcatgagtatagatacaagtagaaattggtttagtttaagattagcaagtgtaacagcagcagatacagcagtatatttttgtgcaagacatagacatcatgatgtatttatgctagtgccaatagcaggatggtttgatgtatggggaccaggagtacaagtaacagtaagtagt

SEQ ID NO: 47090 - RNA, 321 nt, synthetic construct
  misc_feature 1..321: note = derived and/or modified sequence opt6 from anti-HIV_PGT136_LightChain
  source 1..321: mol_type = other RNA
gaaatagtaatgacacaatcaccaccaacattaagcgtaagcccaggagaaacagcaacattaagctgtagagcaagccaaaacgtaaaaaataacttagcatggtaccaactaaaaccaggacaagcaccaagactattaatatttgacgcaagctcaagagcaggaggaataccagacagattctcaggatcaggatatggaacagactttacattaacagtaaactcagtacaaagcgaagactttggagattacttttgccaacaatatgaagaatggccaagaacattcggacaaggaacaaaagtagatataaaa

SEQ ID NO: 47091 - RNA, 402 nt, synthetic construct
  misc_feature 1..402: note = derived and/or modified sequence opt6 from anti-HIV_PGT136_HeavyChain
  source 1..402: mol_type = other RNA
caactacaactacaagaaagcggaccaggattagtaaaaccaagtgaaacattaagcctaacatgtacagtaagcggaggatcaatgagaggaacagactggggagaaaacgatttccattacggatggataagacaaagctcagcaaaaggattagaatggataggaagtatacactggagaggaagaacaacacattacaaaacatcattcagaagcagagcaacactatcaatagatacatcaaacaatagatttagcttaacattttcatttgtaacagcagcagacacagcagtatactattgcgcaagacataaatatcacgatatatttagagtagtaccagtagcaggatggttcgatccatggggacaaggactattagtaacagtaagctca

SEQ ID NO: 47092 - RNA, 321 nt, synthetic construct
  misc_feature 1..321: note = derived and/or modified sequence opt6 from anti-HIV_PGT137_LightChain
  source 1..321: mol_type = other RNA
gaaataatgatgacacaatcaccagcaatactatcagtatcaccaggagacagagcaacactatcatgcagagcatcacaatcagtaaaaaacaacttagcatggtaccaaaaaagaccaggacaagcaccaagactactaatattcgacacatcatcaagagcatcaggaataccagcaagattctcaggaggaggatcaggaacagaattcacactaacagtaaactcaatgcaatcagaagacttcgcaacatactactgccaacaatacgaagaatggccaagaacattcggacaaggaacaaaagtagaaataaaa

SEQ ID NO: 47093 - RNA, 399 nt, synthetic construct
  misc_feature 1..399: note = derived and/or modified sequence opt6 from anti-HIV_PGT137_HeavyChain
  source 1..399: mol_type = other RNA
gaagtacatctagaagaaagcggaccaggattagtaagaccaagtgaaacattaagtttaacatgtacagcaagtggaggaagtataagaggaggagaatggggagatagtgattatcattggggatgggtaagacatagtccagaaaaaggattagaatggataggaagtatacattggagaggaacaacacattataatgcaccatttagaggaagaggaagattaagtatagatttaagtagaaatcaatttagtctaagactaacaagtgtaacagcagaagatacagcagtatattattgtgtaaaacataaatatcatgatatagtaatggtagtaccaatagcaggatggtttgatccatggggacaaggattacaagtaacagtatcaagt

SEQ ID NO: 47094 - RNA, 336 nt, synthetic construct
  misc_feature 1..336: note = derived and/or modified sequence opt6 from anti-HIV_PGT141_LightChain
  source 1..336: mol_type = other RNA
gatacagtagtaacacaatcaccattatcattaccagtaacaccaggagaagcagcaagcatgagctgtagcagcacacaaagtttaagacatagcaatggagcaaactatctagcatggtatcaacataaaccaggacaaagcccaagattactaataagattaggaagccaaagagcatcaggagtaccagatagatttagcggaagcggaagcggaacacatttcacactaaaaatatcaagagtagaagcagaagatgcagcaatatattactgtatgcaaggattaaacagaccatggacatttggaaaaggaacaaaattagaaataaaa

SEQ ID NO: 47095 - RNA, 423 nt, synthetic construct
  misc_feature 1..423: note = derived and/or modified sequence opt6 from anti-HIV_PGT141_HeavyChain
  source 1..423: mol_type = other RNA
caagtacaattagtacaaagcggaccagaagtaaaaaaaccaggatcaagcgtaaaagtaagttgtaaagcaagtggaaatacattctcaaaatatgacgtacactgggtaagacaagcaacaggacaaggactagaatgggtaggatggatgtcacacgaaggagataaaacagaatcagcacaaagatttaaaggaagagtaacatttacaagagacacaagcgcaagcacagcatatatggaactaagaggattaacatcagacgatacagcaatatattactgtacaagaggatcaaaacatagattaagagattacgtactatatgacgattacggattaataaactatcaagaatggaatgactatttagaattcttagacgtatggggacacggaacagcagtaacagtatcaagc

SEQ ID NO: 47096 - RNA, 336 nt, synthetic construct
  misc_feature 1..336: note = derived and/or modified sequence opt6 from anti-HIV_PGT142_LightChain
  source 1..336: mol_type = other RNA
gatacagtagtaacacaatcaccattatcattaccagtaacaccaggagaagcagcatcaatgtcatgttcatcaacacaatcattaagacattcaaatggagcaaactatctagcatggtatcaacataaaccaggacaatcaccaagattactaataagactaggatcacaaagagcatcaggagtaccagacagattttcaggatcaggatcaggaacacatttcacactaaaaatatcaagagtagaagcagaagatgcagcaatatattactgtatgcaaggattaaacagaccatggacatttggaaaaggaacaaaattagaaataaaa

SEQ ID NO: 47097 - RNA, 423 nt, synthetic construct
  misc_feature 1..423: note = derived and/or modified sequence opt6 from anti-HIV_PGT142_HeavyChain
  source 1..423: mol_type = other RNA
caagtacaattagtacaaagtggaccagaagtaaaaaaaccaggatcaagcgtaaaagtaagctgtaaagcaagcggaaacacattctcaaaatatgacgtacactgggtaagacaagcaacaggacaaggactagaatgggtaggatggatatcacacgaaagagataaaacagaatcagcacaaagatttaaaggaagagtaacatttacaagagacacaagcgcaacaacagcatatatggaactaagaggattaacatcagacgatacagcaatatattactgtacaagaggatcaaaacatagactaagagattacgtactatatgacgattacggactaataaactatcaagaatggaatgactatctagaattcctagacgtatggggacacggaacagcagtaacagtatcaagc

SEQ ID NO: 47098 - RNA, 336 nt, synthetic construct
  misc_feature 1..336: note = derived and/or modified sequence opt6 from anti-HIV_PGT143_LightChain
  source 1..336: mol_type = other RNA
gacacagtagtaacacaatcaccattatcattaccagtaacaccaggagaagcagcatcaatgtcatgtacatcaacacaatcattaagacattcaaacggagcaaactatctagcatggtatcaacataaaccaggacaatcaccaagattactaataagactaggatcacaaagagcatcaggagtaccagacagattttcaggatcaggatcaggaacacatttcacactaaaaatatcaagagtagaaccagaagacgcagcaatatattactgtatgcaaggactaaacagaccatggacattcggaaaaggaacaaaattagaaataaaa

SEQ ID NO: 47099 - RNA, 423 nt, synthetic construct
  misc_feature 1..423: note = derived and/or modified sequence opt6 from anti-HIV_PGT143_HeavyChain
  source 1..423: mol_type = other RNA
caagtacaattagaacaaagcggagcagaagtaaaaaaaccaggatcaagcgtaaaagtaagttgtaaagcaagcggtaacacattcagtaaatatgacgtacactgggtaagacaagcaacaggacaaggactagaatgggtaggatggatgtcacacgaaggagataaaacagaatcagcacaaagatttaaaggaagagtaacatttacaagagacacaagcgcaagcacagcatatatggaactaagaggattaacatcagacgatacagcaatatattactgtacaagaggatcaaaacatagattaagagattacgtactatatgacgattacggactaataaactatcaagaatggaatgactatctagaattcttagacgtatggggacacggaacagcagtaacagtatcaagt

SEQ ID NO: 47100 - RNA, 336 nt, synthetic construct
  misc_feature 1..336: note = derived and/or modified sequence opt6 from anti-HIV_PGT144_LightChain
  source 1..336: mol_type = other RNA
gatacagtagtaacacaatcaccattatcattaagcgtaacaccaggagaagcagcaagcatgagctgtacaagcacacaatcattaagacatagcaatggagcaaactatctagcatggtatcaacataaaccaggacaaagcccaagattactaataagattaggaagccaaagagcatcaggagtaccagatagattttcaggaagcggaagtggaacacatttcacactaaaaatatcaagagtagaagcagacgatgcagcaatatattactgtatgcaaggattaaacagaccatggacatttggaaaaggaacaaaattagaaataaaa

SEQ ID NO: 47101 - RNA, 423 nt, synthetic construct
  misc_feature 1..423: note = derived and/or modified sequence opt6 from anti-HIV_PGT144_HeavyChain
  source 1..423: mol_type = other RNA
caagtacaattagtacaaagcggagcagaagtaaaaaaaccaggatcaagcgtaaaagtaagctgtaaagcaagtggaaacacattcagaaaatatgacgtacactgggtaagacaagcaacaggacaaggactagaatgggtaggatggatgtcacacgaaggagataaaacagaatcagcacaaagatttaaaggaagagtaagctttacaagagacaatagcgcaagcacagcatatatagaattaagaggattaacatcagacgatacagcaatatattactgtacaggaggatcaaaacatagattaagagattacgtactatatgacgattacggactaataaaccaacaagaatggaatgactatctagaattcctagacgtatgggggcacggaacagcagtaacagtatcaagc

SEQ ID NO: 47102 - RNA, 336 nt, synthetic construct
  misc_feature 1..336: note = derived and/or modified sequence opt6 from anti-HIV_PGT145_LightChain
  source 1..336: mol_type = other RNA
gaagtagtaataacacaatcaccattattcttaccagtaacaccaggagaagcagcatcattatcatgtaaatgttcacattcattacaacacagcacaggagcaaactatctagcatggtatctacaaagaccaggacaaacaccaagactactaatacacttagcaacacacagagcatcaggagtaccagacagattttcaggatcaggatcaggaacagacttcacactaaaaatatcaagagtagaatcagacgacgtaggaacatattactgtatgcaaggattacactcaccatggacattcggacaaggaacaaaagtagaaataaaa

SEQ ID NO: 47103 - RNA, 420 nt, synthetic construct
  misc_feature 1..420: note = derived and/or modified sequence opt6 from anti-HIV_PGT145_HeavyChain
  source 1..420: mol_type = other RNA
caagtacaattagtacaaagcggagcagaagtaaaaaaaccaggatcaagcgtaaaagtaagttgtaaagcaagcggaaattcattctcaaaccatgacgtacactgggtaagacaagcaacaggacaaggactagaatggatgggatggatgtcacacgaaggagataaaacaggattagcacaaaaatttcaaggacgagtaacaataacaagagactcaggagcaagcacagtatatatggaactaagaggattgacagcagacgatacagcaatatattactgtctaacaggatcaaaacatagattaagagattactttctatataacgaatacggaccaaattacgaagaatggggagattacttagcaacactagatgtatggggacatggaacagcagtaacagtaagctca

SEQ ID NO: 47104 - RNA, 657 nt, synthetic construct
  misc_feature 1..657: note = derived and/or modified sequence opt6 from anti-HIV_PGT151_LightChain
  source 1..657: mol_type = other RNA
gacatagtaatgacccaaacacctctaagcctatcagtcacaccaggacaacccgcatcaatatcatgcaaaagttcagaatcactaagacaatcaaacggaaaaacatcactctactggtacagacaaaaaccaggtcaatcaccacaactattagtattcgaagtaagcaacagattctcaggagtatcagacagattcgtaggatcaggatcaggaacagacttcacattaagaatatcaagagtagaagcagaagacgtaggattctactactgcatgcaatcaaaagactttccattaacattcggaggaggaacaaaagtagacttaaaaagaacagtagcagcaccatcagtattcatcttcccaccatcagacgaacaactaaaatcaggaacagcatcagtagtatgtttactaaacaacttctacccacgagaagcaaaagtacaatggaaagtagataacgcactacaatcaggaaactcacaagaatcagtaacagaacaagacagcaaagactcaacatactcactaagctcaacattaaccctatcaaaagccgactatgaaaaacacaaagtatacgcatgcgaagtaacacaccaaggtttatcctcaccagtaacaaaatctttcaacagaggcgaatgc

SEQ ID NO: 47105 - RNA, 720 nt, synthetic construct
  misc_feature 1..720: note = derived and/or modified sequence opt6 from anti-HIV_PGT151_HeavyChain
  source 1..720: mol_type = other RNA
agagtacaattagtagaatcaggaggaggtgtagtacaaccaggaaaaagcgtaagattatcatgtgtagtatcagatttccccttctcaaaatatccaatgtattgggtaagacaagcaccaggaaaaggattagaatgggtagcagcaatatcaggagacgcatggcacgtagtatattcaaatagtgttcaaggaagatttttagtatcaagagacaatgttaaaaacacactatatttagaaatgaatagcctaaaaatagaagatacagcagtatatagatgtgcaagaatgtttcaagaatcaggaccaccaagattagacagatggtcaggaagaaactattactattactcaggaatggatgtatggggacaaggaacaacagtaacagtatcaagcgcatctacaaaaggaccaagtgtatttccattagcaccatcaagtaaatcaacatcaggaggaacagcagcattaggatgtctagtaaaagattactttccagaaccagtaacagtatcatggaactcaggagcactaacaagtggagtacatacatttcccgcagtattacaatcaagcggactatatagcttaagttcagtagtaacagtaccaagctcaagcctaggcacccaaacatatatatgtaacgtaaaccacaaaccctcaaacacaaaagtagataaaagagtagaaccaaaatcatgtgacaaa

SEQ ID NO: 47106 - RNA, 657 nt, synthetic construct
  misc_feature 1..657: note = derived and/or modified sequence opt6 from anti-HIV_PGT152_LightChain
  source 1..657: mol_type = other RNA
gacatcgtaatgacacaaacaccactaagcctatcagtcgacccaggacaaccagcatcaatatcatgcaaatcatcacaatcactaagacaatcaaacggaaaaacaagtctatactggtaccaacaaaaaccaggccaatcaccacaactactaatattcgaagtatcaaacagattctcaggagtatcagacagattcgtcggatcaggatcaggcacagacttcacactaagaataagcagagtagaagcagaagatgtaggattctattactgcatgcaatcaaaagacttcccattaacattcggaggcggaacaaaagtcgatctaaaaagaacagtcgcagccccatcagtatttatattcccaccatcagacgaacaactaaaatcaggaacagcatcagtagtatgcttactaaacaacttctacccaagagaagcaaaagtacaatggaaagtagacaacgcactccaatcaggaaactcacaagaatcagtaacagaacaagacagcaaagactcaacatattcactatcatcaacactaacattaagcaaagccgactacgaaaaacacaaagtatacgcatgcgaagtaacacaccaaggactatcatcaccagtaacaaaatcattcaacagaggagaatgc

SEQ ID NO: 47107 - RNA, 720 nt, synthetic construct
  misc_feature 1..720: note = derived and/or modified sequence opt6 from anti-HIV_PGT152_HeavyChain
  source 1..720: mol_type = other RNA
agagtacaattagtagaatcaggaggaggcgtagtacaaccaggaaaatcagttagattatcatgtgtagtatcagatttcccattctctaaatatccaatgtactgggtaagacaagcaccaggaaaaggattagaatgggtagcagcaatatcagcagatgcatggcacgtagtatattcaggatcagtacaaggaagatttctagtatcaagagacaacagtaaaaacatactatatttagaaatgaacacactaaaaatagaagatacagcagtatatcgctgtgcaagaatgtttcaagaatcaggcccaccaagatttgactcatggtcaggaagaaactactactattattcaggaatggacgtttggggacaaggaacaacagtcactgtctcttcagcatcaacaaaaggaccatctgtatttccattagcaccatcttccaaatcaacatcaggaggaacagcagcattaggatgtttagttaaagattactttccagaaccagtaacagtctcatggaacagtggagctttaacttcaggagtacatacatttccagcagtattacaatcatcaggactatattcactaagctcagttgtaacagtaccatcttcatcactaggaacacaaacatatatatgtaacgtaaaccataaaccatcaaatacaaaagtagataaaagagtagaaccaaaatcatgtgataaa

SEQ ID NO: 47108 - RNA, 309 nt, synthetic construct
  misc_feature 1..309: note = derived and/or modified sequence opt6 from anti-HIV_VRC-CH30_LightChain
  source 1..309: mol_type = other RNA
gacatacaaatgacacaatcaccatcatcactatcagcatcactaggagacagagtaacaataacatgccaagcatcaagaggaataggaaaagacctaaactggtaccaacaaaaaccaggaaaagcaccaaaactactagtatcagacgcatcaatactagaaggaggagtaccatcaagattctcaggatcaggattccaccaaaacttctcactaacaatatcatcactacaaccagaagacgtagcaacatacttctgccaacaatacgaaacattcggacaaggaacaaaagtagacataaaa

SEQ ID NO: 47109 - RNA, 393 nt, synthetic construct
  misc_feature 1..393: note = derived and/or modified sequence opt6 from anti-HIV_VRC-CH30_HeavyChain
  source 1..393: mol_type = other RNA
caagtacaattagtacaaagcggagcagcagtaagaaaaccaggagcaagcgtaacagtaagctgtaaatttgcagaagacgatgactatagtccacactgggtaaatccagcaccagaacattatatacatttcttaagacaagcaccaggacaacaattagaatggctagcatggatgaacccaacaaatggagcagtaaattacgcatggcaactacatggaagattaacagcaacaagagatggatcaatgacaacagcattcttagaagtaagatcactaagaagtgatgacacagcagtatattattgcgcaagagcacaaaaaagaggaagaagtgaatgggcatatgcacattggggacaaggaacaccagtagcagtatcaagc

SEQ ID NO: 47110 - RNA, 309 nt, synthetic construct
  misc_feature 1..309: note = derived and/or modified sequence opt6 from anti-HIV_VRC-CH31_LightChain
  source 1..309: mol_type = other RNA
gacatacaaatgacacaatcaccatcatcactatcagcatcactaggagacagagtaacaataacatgccaagcatcaagaggaataggaaaagacctaaactggtaccaacaaaaagcaggaaaagcaccaaaactattagtatcagacgcatcaacactagaaggaggagtaccatcaagattctcaggatcaggattccaccaaaacttctcactaacaatatcatcattacaagcagaagacgtagcaacatacttctgccaacaatacgaaacattcggacaaggaacaaaagtagacataaaa

SEQ ID NO: 47111 - RNA, 393 nt, synthetic construct
  misc_feature 1..393: note = derived and/or modified sequence opt6 from anti-HIV_VRC-CH31_HeavyChain
  source 1..393: mol_type = other RNA
caagtacaattagtacaaagcggagcagcagtaagaaaaccgggagcaagcgtaacagtaagctgtaaatttgcagaagacgatgactatagtccatactgggtaaatccagcaccagaacattttatacatttcttaagacaagcaccaggacaacaattagaatggctagcatggatgaacccaacaaatggagcagtaaattacgcatggtatttaaatggaagagtaacagcaacaagagatagatcaatgacaacagcattcttagaagtaaaatcactaagaagtgatgacacagcagtatactattgcgcaagagcacaaaaaagaggaagatcagaatgggcatatgcacattggggacaaggaacaccagtagtagtatcaagc

SEQ ID NO: 47112 - RNA, 309 nt, synthetic construct
  misc_feature 1..309: note = derived and/or modified sequence opt6 from anti-HIV_VRC-CH32_LightChain
  source 1..309: mol_type = other RNA
gacatacaaatgacacaatcaccatcatcactatcagcatcactaggagacagagtaacaataacatgccaagcatcaagaggaataggaaaagacctaaactggtaccaacaaaaaccaggaagagcaccaaaactactagtatcagacgcatcaatactagaaggaggagtaccaacaagattctcaggatcaggattccaccaaaacttctcactaacaatatcatcactacaagcagaagacgtagcaacatacttctgccaacaatacgaaacattcggacaaggaacaaaagtagacataaaa

SEQ ID NO: 47113 - RNA, 393 nt, synthetic construct
  misc_feature 1..393: note = derived and/or modified sequence opt6 from anti-HIV_VRC-CH32_HeavyChain
  source 1..393: mol_type = other RNA
caagtacaattagtacaatcaggagcagcagtaagaaaaccaggagcatcagtaacagtaagctgtaaatttgcagaagacgatgacttttcaccacactgggtaaatccagcaccagaacactatatacatttcttaagacaagcaccaggacaacaactagaatggctagcatggatgaaaccaacaaatggagcagtaaattacgcatggcaactacaaggaagagtcacagtaacaagagatagatcacaaacaacagcattcctagaagtaaaaaatctaagatcagatgacacagcagtatactattgcgcaagagcacaaaaaagaggaagatcagaatgggcatatgcacattggggacaaggaacaccagtagtaatatcagca

SEQ ID NO: 47114 - RNA, 309 nt, synthetic construct
  misc_feature 1..309: note = derived and/or modified sequence opt6 from anti-HIV_VRC-CH33_LightChain
  source 1..309: mol_type = other RNA
gacatacaaatgacacaatcaccatcatcactatcagcatcactaggagacagagtaacaataacatgccaagcatcaagaggaataggaaaagacctaaactggtaccaacaaaaaagaggaagagcaccaagactactagtatcagacgcatcagtactagaaggaggagtaccatcaagattctcaggatcaggattccaccaaaacttctcactaacaatatcaacactacaaccagaagacgtagcaacatacttctgccaacaatacgaaacattcggacaaggaacaaaagtagacataaaa

SEQ ID NO: 47115 - RNA, 393 nt, synthetic construct
  misc_feature 1..393: note = derived and/or modified sequence opt6 from anti-HIV_VRC-CH33_HeavyChain
  source 1..393: mol_type = other RNA
caagtacaattagtacaatcaggagcagcagtaagaaaaccaggagcatcaatatcagtaagctgtaaatttgcagatgcagatgactattcaccacactggatgaatccagcaccagaacactatatacatttcttaagacaagcaccaggacaacaattagaatggctagcatggatgaacccaacaaatggagcagtaaattacgcatggtatttaaatggaagagtaacagcaacaagagatagatcaatgacaacagcattcctagaagtaagaagtctaagatcagatgacacagcagtatattattgcgcaagagcacaaaaaagagcaagaagtgaatgggcatatgcacattggggacaaggaacaccagtagttgtatcaagt

SEQ ID NO: 47116 - RNA, 309 nt, synthetic construct
  misc_feature 1..309: note = derived and/or modified sequence opt6 from anti-HIV_VRC-CH34_LightChain
  source 1..309: mol_type = other RNA
gacatacaaatgacacaatcaccatcatcactatcagcatcactaggagacagagtaacaataacatgccaagcatcaagaggaataggaaaagacctaaactggtaccaacaaaaagcaggaaaagcaccaaaactactagtatcagacgcatcaatactagaaggaggagtaccatcaagattctcaggatcaggattccaccaaaacttctcactaacaatatcatcactacaaccagaagacgtagcaacatacttctgccaacaatacgaaacattcggacaaggaacaaaagtagacataaaa

SEQ ID NO: 47117 - RNA, 393 nt, synthetic construct
  misc_feature 1..393: note = derived and/or modified sequence opt6 from anti-HIV_VRC-CH34_HeavyChain
  source 1..393: mol_type = other RNA
caagtacaattagtacaaagcggagcagcagtaagaaaaccaggagcaagtgtaacagtaagctgtaaatttgcagaagacgatgactggagtccacactgggtaaatccagcaccagaacattatatacatttcttaagacaagcaccaggacaacaattagaatggctagcatggatgaacccaacaaatggagcagtaaattacgcatggcaattaaatggaagactaacagcaacaagagatacatcaatgacaacagcattcttagaagtaaaatcactaagaagtgatgacacagcagtatactattgcgcaagagcacaaaaaagaggaagatcagaatgggcatatgcacattggggacaaggaacaccagtagtagtatcaagt

SEQ ID NO: 47118 - RNA, 306 nt, synthetic construct
  misc_feature 1..306: note = derived and/or modified sequence opt6 from anti-HIV_VRC-PG04_LightChain
  source 1..306: mol_type = other RNA
gaaatagtactaacacaatcaccaggaacactatcactatcaccaggagaaacagcatcattatcatgcacagcagcatcatacggacacatgacatggtaccaaaaaaaaccaggacaaccaccaaaactactaatattcgcaacatcaaaaagagcatcaggaataccagacagattctcaggatcacaattcggaaaacaatacacactaacaataacaagaatggaaccagaagacttcgcaagatactactgccaacaactagaattcttcggacaaggaacaagactagaaataagaaga

SEQ ID NO: 47119 - RNA, 375 nt, synthetic construct
  misc_feature 1..375: note = derived and/or modified sequence opt6 from anti-HIV_VRC-PG04_HeavyChain
  source 1..375: mol_type = other RNA
caagtacaattagtacaaagtggatcaggagtaaaaaaaccaggagcatcagtaagagtaagttgttggacaagtgaagatatatttgaaagaacagaattaatacattgggtaagacaagcaccaggacaaggattagaatggataggatgggtaaaaacagtaacaggagcagtaaattttggaagtccagattttagacaaagagtaagtttaacaagagatagagatttatttacagcacatatggatataagaggattaacacaaggagatacagcaacatatttttgtgcaagacaaaaattttatacaggaggacaaggatggtattttgatttatggggaagaggaacactaatagtagtaagtagt

SEQ ID NO: 47120 - RNA, 303 nt, synthetic construct
  misc_feature 1..303: note = derived and/or modified sequence opt6 from anti-HIV_VRC-PG04b_LightChain
  source 1..303: mol_type = other RNA
gaaatagtactaacacaatcaccaggaacactatcactatcaccaggagaaacagcatcactatcatgcacagcagcatcatacggacacatgacatggtaccaaaaaaaaccaggacaaccaccaaaactactaatattcgcaacatcaaaaagagcatcaggaataccagacagattctcaggatcacaattcggaaaacaatacacactaacaataacaagaatggaaccagaagacttcgcaggatactactgccaacaagtagaattcttcggacaaggaacaagactagaaataaga

SEQ ID NO: 47121 - RNA, 375 nt, synthetic construct
  misc_feature 1..375: note = derived and/or modified sequence opt6 from anti-HIV_VRC-PG04b_HeavyChain
  source 1..375: mol_type = other RNA
caagtacaattagtacaaagtggaagtggagtaaaaaaaccaggagcaagtgtaagagtaagttgttggacaagcgaagatatatttgaaagaacagaattaatacattgggtaagacaagcaccaggacaaggattagaatggataggatgggtaaaaacagtaacaggagcagtaaattttggaagtccaaattttagacatagagtaagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagt

SEQ ID NO: 47122 - RNA, 612 nt, synthetic construct
  misc_feature 1..612: note = derived and/or modified sequence opt6 from anti-HIV_VRC-PG20_LightChain
  source 1..612: mol_type = other RNA
caatcagcactaacacaaccaccatcagtatcaggatcaccaggacaatcaataacattatcatgcaccggcgcatcaacatcagtcgcatggtaccaacaatacgcagacaaagcaccaagactaatagtattcgacggaaacaaaagaccatcagacatatcctcaagattctcaggatcacaatcaggaggaacagcatcactaacaatctcaggactacaatcagaagacgaagcatactaccattgcaacgcattcgaattctttggaggaggaacaaaactcacagtactatcacaaccaaaagcagcaccatccgtaacactattcccaccatcatcagaagaactacaagcaaataaagcaacactagtatgcctaatatcagacttctaccccggagcagtcacagtagcatggaaagccgactcctcaccagtaaaagcaggagtcgaaaccacaacaccatccaaacaatcaaataacaaatacgcagcatcatcatacctatcactaacaccagaacaatggaaatcacacaaatcatactcatgccaagtaacacatgaaggatcaacagtcgaaaaaacagtagcacccacagaatgc

SEQ ID NO: 47123 - RNA, 681 nt, synthetic construct
  misc_feature 1..681: note = derived and/or modified sequence opt6 from anti-HIV_VRC-PG20_HeavyChain
  source 1..681: mol_type = other RNA
gaagtacacttaatgcaatcaggaacagaaatgaaaaaaccaggagcatccgtaagagtaacatgccaaacatcaggatacacattttcagactacttcatacactggctaagacaagtaccaggaagaggatttgaatggatgggatggatgaacccacaatggggacaagtaaattacgcaagaacatttcaaggaagagtaacaatgacaagagacgtatacagagaagtagcatacttagacttaagatcattaacattcgcagacacagcagtatacttttgcgcaagacgaatgagatcacaagaccgagaatgggactttcaacactggggtcaaggaacaagaataatagtaagttcagcatcaacaaaaggaccatcagtatttccattagcaccatcaagcaaatcaacatcaggaggcacagcagcattaggatgcctagttaaagactacttcccagaaccagtaacagtatcatggaactcaggagcattaacatcaggagtacacacattcccagcagtactacaatcatcaggtctatattcactatcaagcgtagtaacagtaccatcatcatcactaggaacacaaacatacatatgcaacgtaaaccacaaaccatcaaatacaaaagtagataaaaaagtagaaccaaaatcatgcgacaaa

SEQ ID NO: 47124 - RNA, 1059 nt, synthetic construct
  misc_feature 1..1059: note = derived and/or modified sequence opt6 from anti-HIV_VRC-PG20_G-Chain
  source 1..1059: mol_type = other RNA
gtatggaaagacgcagacacaactctattctgtgcatcagatgccaaagctcacgaaacagaagtacataatgtatgggctacacacgcatgcgtacccaccgacccaaatccacaagaaatacacttagaaaacgtaacagaaaacttcaatatgtggaaaaacaatatggtagaacaaatgcaagaagatgtaatatcactctgggaccaatcacttcaaccatgtgtgaaattaacaggaggaagcgttataaaacaagcatgtccaaaaatatcattcgatccaatacctatacactactgcacaccagcaggatacgtaatactaaaatgcaacgacaaaaacttcaacggaacaggaccatgcaaaaacgtatcatccgtacaatgcacacatggaataaaaccagtagtatcaacacaactactactaaatggcagcttagcagaagaagaaattataataagatcagaaaacctaacaaacaacgcaaaaacaataatagtacacctaaataaaagcgtagaaataaactgtactagaccatcaaatggaggaagcggaagtggaggtgacataaggaaagcatactgtgaaataaacggaacaaaatggaacaaagtactaaaacaagtaacagaaaaactaaaagaacactttaacaacaaaacaataatattccaaccaccatcaggaggcgacctagaaataacaatgcaccacttcaactgcagaggagaatttttctactgcaatacaacacaactattcaacaacacatgcataggaaacgaaacaatgaaaggatgcaacggaacaataacactaccatgcaaaataaaacaaatcataaacatgtggcaaggaacaggacaagccatgtacgccccaccaatagatggaaaaataaactgtgtaagcaacataacaggaatactactaacacgagacggcggagcaaacaacacatcaaacgaaacattcagaccaggaggaggaaacatcaaagacaactggagatcagaactatacaaatacaaagtagtacaaatcgaa

SEQ ID NO: 47125 - RNA, 312 nt, synthetic construct
  misc_feature 1..312: note = derived and/or modified sequence opt6 from anti-HIV_VRC02_LightChain
  source 1..312: mol_type = other RNA
gaaatagtactaacacaatcaccaggaacattaagcctaagcccaggagaaacagcaataataagctgtagaacaagtcaatacggatcattagcatggtaccaacaaagaccaggacaagcacccagattagtaatatatagcggaagcacaagagcagcaggaataccagacagattcagcggatcaagatggggaccagactataacttaacaataagaaatctagaaagcggagactttggattatactattgccaacaatatgaatttttcggacaaggaacaaaagtacaagtagatataaaaaga

SEQ ID NO: 47126 - RNA, 363 nt, synthetic construct
  misc_feature 1..363: note = derived and/or modified sequence opt6 from anti-HIV_VRC02_HeavyChain
  source 1..363: mol_type = other RNA
caagtacaattagtacaatcaggaggacaaatgaaaaaaccaggagaaagtatgagaatatcatgtcaagcaagtggatatgaatttatagattgtacattaaattgggtaagattagcaccaggaagaagaccagaatggatgggatggttaaaaccaagaggaggagcagtaaattatgcaagaccattacaaggaagagtaacaatgacaagagatgtatatagtgatacagcatttttagaattaagaagtctaacagcagatgatacagcagtatattattgtacaagaggaaaaaattgtgattataattgggattttgaacattggggaagaggaacaccagtaacagtaagtagt

SEQ ID NO: 47127 - RNA, 309 nt, synthetic construct
  misc_feature 1..309: note = derived and/or modified sequence opt6 from anti-HIV_VRC03_LightChain
  source 1..309: mol_type = other RNA
gaaatagtactaacacaatcaccaggaatattaagcttaagcccaggagaaacagcaacattattctgtaaagcaagccaaggaggaaacgcaatgacatggtatcaaaaaagaagaggacaagtaccaagattactaatatacgatacatcaagaagagcatcaggagtaccagatagatttgtaggaagcggaagcggaacagatttctttctaacaataaataaattagacagagaagatttcgcagtatattactgtcaacaattcgaattctttggattaggatcagaattagaagtacacaga

SEQ ID NO: 47128 - RNA, 390 nt, synthetic construct
  misc_feature 1..390: note = derived and/or modified sequence opt6 from anti-HIV_VRC03_HeavyChain
  source 1..390: mol_type = other RNA
caagtacaattagtacaaagtggagcagtaataaaaacaccaggaagtagtgtaaaaataagttgtagggcaagtggatataattttagagattatagtatacattgggtaagattaataccagataaaggatttgaatggataggatggataaaaccattatggggagcagtaagttatgcaagacaattacaaggaagagtaagtatgacaagacaattaagtcaagatccagatgatccagattggggagtagcatatatggaatttagtggattaacaccagcagatacagcagaatatttttgtgtaagaagaggatcatgtgattattgtggagattttccatggcaatattggggacaaggaacagtagtagtagtaagtagt

SEQ ID NO: 47129 - RNA, 630 nt, synthetic construct
  misc_feature 1..630: note = derived and/or modified sequence opt6 from anti-HIV_VRC23_LightChain
  source 1..630: mol_type = other RNA
gaaatagtaatgacacaaagcccagtaacagttagcgtaagcagaggaggaacagcaactttaagctgtcgagcaagccaaggagtaggctcagacgtagcatggtaccaacacaaacccggacaaacaccaagattattaatatatggagcaagtacacgtgcaagcggagtaccagaaagattctcaggatcaggatttcacgtagattttacattatcaataagcggactacaaccagaagacgtagcaatatactattgccaacaatacgaaacattcggacaaggaacaaaagtagaaataaaaagaacagtagcagcaccaagcgtattcatattcccaccctcagacgaacaattaaaatcaggaacagcctcagtagtatgcctactaaataacttttacccaagagaagcaaaagtacaatggaaagtagataacgcactacaatcaggaaactcacaagaaagcgtaacagaacaagatagcaaagactcaacatatagcttaagttcaacactaacattaagcaaagcagattacgaaaaacataaagtatacgcgtgcgaagtaacacaccaaggattaagctcaccagtaacaaaatcatttaacagaggagaatgc

SEQ ID NO: 47130 - RNA, 672 nt, synthetic construct
  misc_feature 1..672: note = derived and/or modified sequence opt6 from anti-HIV_VRC23_HeavyChain
  source 1..672: mol_type = other RNA
gaagtacaatttgtacaatcaggagcagaagtaaaaaaaccaggagcatcagtaagagtctcatgtgaagcatcaggatactcattcactgactacgtactacaatggataagacaagcaccaggacaaagaccagaatggatgggatggataaaaccagaaagaggagcagtttcatacgcaccacaatttcaaggacgattaacattaacaagagacttatacacagaaacagcctatatgcacttcaaaaacttaagatcagacgatacagccatatattactgtgccagaggagtaagaagagacgcatcatggtggttacaattttggggccaaggaacattagtaacagtatcatcagcatcaacaaaaggaccatcagtatttccactagcaccatcatcaaaatcaacatcaggaggaacagcagcactaggctgtttagtaaaagactacttcccagaaccagtaacagtatcatggaattcaggagcattaacaagcggagtacatacatttccagcagtactacaatcatcaggactatactcattatcaagcgtagtaacagtaccatcatcatcactaggtacacaaacatatatatgtaacgtaaaccataaaccatcaaacacaaaagtagataaaaaagtagaaccaaaatcatgc

SEQ ID NO: 47131 - RNA, 1077 nt, synthetic construct
  misc_feature 1..1077: note = derived and/or modified sequence opt6 from anti-HIV_VRC23_G-Chain
  source 1..1077: mol_type = other RNA
gtctggagagacgcagacaccacactattctgcgcaagcgacgcaaaagcatatgaaacagaaaaacacaacgtatgggcaacacatgcatgcgtaccaaccgatccaaacccacaagaaatacacttagacaacgtaacagaaaaattcaatatgtggaaaaataacatggtagaacaaatgcacacagatataatatcactatgggaccaatcattaaaaccttgtgtaaaacttacaggaggaagcgcaataacccaagcatgcccaaaagtatcattcgaaccaataccaatacactactgcacgcccgcaggatttgcaatactaaaatgtaaagacgaaggatttaatggaaccggattatgcaaaaacgtatcaacagtacaatgcacacacggaataaaaccagtagtatcaacacaactactactaaacggatcactagcagaaaaaaacataacaatcagatccgaaaatataacaaacaacgcaaaaataataatagtacaactcgtacaaccagtaacaataaaatgtataagaccaaacaacggcggctcaggatcaggaggtgatataagacaagcacactgcaatgtaaccagatcaagatggaataaaacactccaagaagtcgcagaaaaactaagaacatacttcggaaacaaaacaataatattcgcaaacagctcaggaggagacctcgaaataacaacacacagtttcaattgcggcggcgaatttttctattgcaatacaagcggattattcaactccacatggtacgtaaacagcacatggaacgacacagactccacacaagaatcaaatgataccataaccttaccctgcagaataaaacaaataataaatatgtggcaacgagcaggccaagcaatgtacgctccacccatacccggagtcataaaatgcgaatcaaacataacaggattactactaacacgagacggaggaaaagacaacaacgtaaacgaaacattcagaccaggaggaggagacatgagagacaactggagatcagaactatataaatacaaagtagtagaaatcgaa

SEQ ID NO: 47132 - RNA, 648 nt, synthetic construct
  misc_feature 1..648: note = derived and/or modified sequence opt6 from anti-HIV_5CCK_LightChain
  source 1..648: mol_type = other RNA
caatcagcactaacacaaccagcatcagtatcagcatcacccggacaatcaataacaatatcatgctcaggaacaagatcagacgtaggaggatacgacttcgtctcatggtaccaacaacacccaggaaaagtaccaaaactaataatatacgaagtaacaaaaagaccatcaggaatcccacaaagattctcaggatcaaaatcaggaaacacagcatcactaacaatatcaggactacaagcagacgacgaagcagactactactgctgctcatatgcaaactacgacaaactaatactaggtggaggaacaaaactaaccgtacttggacaaccaaaagcaaaccctacagtaacattattcccaccatcatcagaagaactacaagcaaacaaagcaacactagtatgcttaatatcagacttctacccaggagcagtcacagttgcatggaaagcagacggatccccagtaaaagcaggtgtagaaacaacaaaaccatcaaaacaatcaaacaacaaatacgcagcatcatcatacttatcactaacaccagaacaatggaaatcacacagatcatacagctgccaagtaacccacgaaggatcaacagtagaaaaaacagtagcaccaacagaatgctca

SEQ ID NO: 47133 - RNA, 696 nt, synthetic construct
  misc_feature 1..696: note = derived and/or modified sequence opt6 from anti-HIV_5CCK_HeavyChain
  source 1..696: mol_type = other RNA
caagtacaattagtacaaagtggagctgaaatgaaagatccaggagcatcagtaaaagtatcatgtagagcaagtggatataaatttacagattactatatgcattgggtaagacaagcaccaggacaaggattagaatgggtaggatgggtaaatacaaatggaggatttacaaaatatggagcaaaatttcaaggaagagtaacagtaacaagagatacatcaacaaatacagtatttttagaattatcaagattaacatttggagatacagcaatgtatttttgtgcaagaccaatgcgtccagtatcacatgggattgattattctggattatttgtatttcaattttggggaagaggaacaatggtaacagtaagttcagcatcaacaaaaggaccaagcgtatttccactagcaccatcaagtaaaagcacaagcggaggaacagcagcactaggatgtttagtaaaagattattttccagaaccagtaacagtctcatggaattctggagcactaacatcaggagtgcacacatttccagcagtgttacaatcatcaggtttatattcactatcaagtgtagtaacagtaccaagctcatcattaggaacacaaacatatatatgtaatgtaaatcataaaccttcaaatacaaaagtagataagaaagtagaaccaaaatcatgtgat

SEQ ID NO: 47134 - RNA, 648 nt, synthetic construct
  misc_feature 1..648: note = derived and/or modified sequence opt6 from anti-HIV_5AWN_LightChain
  source 1..648: mol_type = other RNA
caaagcgtactcacacaaccagcatcagtatcagcatcacccggacaatcaataacagtatcatgcacaggatcaagaaatgacgtaggaggatacgatttcgtaagttggtaccaacgacatccaggaggagtaccaaaactaataatatatgaaatatccaaacgaccgagtggcataccacaaagattctcaggatcaagatcgggaaatacagcaagtttaacaataagcggactacaagatgatgatgaagcagactactattgctgttcatacgcatcatacgatagattaatatttggaggaggtacacgagtaagcgtattaagacaaccaaaagcagcaccgtcagtaacattattcccaccatcaagcgaagaattacaagcaaacaaagcaacactagtatgcttaatatcagacttctatccaggagcagtaacagtagcatggaaagccgatggatcaccagtaaaagcaggagtagaaacgacaaaaccatcaaaacaaagcaataacaaatacgcagcatcaagttacttatcattaacaccagaacaatggaaatcacacagatcatatagttgtcaagtaacacatgaagggagcacagtagaaaaaacagtagcaccaacagaatgtagc

SEQ ID NO: 47135 - RNA, 696 nt, synthetic construct
  misc_feature 1..696: note = derived and/or modified sequence opt6 from anti-HIV_5AWN_HeavyChain
  source 1..696: mol_type = other RNA
caagtacaactgatgcaaagtggagcacaactaagagatccaggagactcattaaaaatatcatgcaaagcaagcggatataactttatagactatcatatacattgggtaagattagcaccaggaagaggattagaatggatgggatggatagacccagtaggaggaataacaaaatacgcaggacaattccaaggaagattatcattaacaagagatacatcaacaaatacattattcctagaattatcaagattaacagcaggagataccgcagtatacttttgtgcacgatcaatgagaccagtagatcatggaatagactattcaggattatttgtatttcacttttggggaagaggatcagatgtactagtaagttcagcatcaacaaaaggaccatcagtatttccattagctccaagcagtaaatcaacaagtggaggaacagcagcattaggatgtctagtaaaagattattttccagaaccagttacagtttcatggaacagtggagcattaacttcaggagtacatacatttccagctgtattacaatcaagcggactatactcattatcaagtgtagtaacagttccatcatcatcactaggaacacaaacatatatatgcaacgtaaaccataaaccatcaaatacaaaagtagacaaaaaagtagaaccaaaatcatgtgat

SEQ ID NO: 47136 - RNA, 645 nt, synthetic construct
  misc_feature 1..645: note = derived and/or modified sequence opt6 from anti-HIV_3QEG_LightChain
  source 1..645: mol_type = other RNA
gaaatagtaatgatgcaatcaccaggaacactatcactatcaccaggagaaagagcaacactatcatgcagagcaagccaatcagtctcatcatcatacctagcatggtaccaacaaaaaccaggacaagcaccaagattattaatatacggagcatcatcaagagcaacaggaatcccagacagattctcaggatcaggatcaggaaccgacttcaccctaacaatatcaagactagaaccagaagacttcgcagtatactactgccaacaatacggctctagcccagaaacattcggacaaggaacaaaagtagaaataaaaagaacagtagccgcaccatcagtattcatattcccaccatcagacgaacaattaaaatcaggaacagcatcagtcgtatgcctattaaacaacttctacccaagagaagcaaaagtacaatggaaagtagacaacgccctacaatcaggcaactcacaagaaagcgtaacagaacaagattcaaaagactcaacatactcactatcatcaacattaacactatcaaaagcagactacgaaaaacacaaagtatacgcatgcgaagtaactcaccaaggactatcatcaccagtaacaaaatcattcaaccgaggcgaatgc

SEQ ID NO: 47137 - RNA, 717 nt, synthetic construct
  misc_feature 1..717: note = derived and/or modified sequence opt6 from anti-HIV_3QEG_HeavyChain
  source 1..717: mol_type = other RNA
caagtacaactagtacaatcaggagcagaagtaaaaaaaccaggctcatcagtaaaagtatcatgcagagcatcaagaggaacattcagctcatatggaataacatgggtcagacaagcaccaggacaaggattagaatggatgggaggaataataccaatatttgacgtcacaaattacgcacaaaatttccaaggaagagtcgcaataactacagatgcagaaatgtcaacagcatacatggaacttagatcactaaaatcagaagactcagcagtttactattgcgcttcagatagtagagacttttcatattacgaaccaggaacaagttactcacactattacaatataatggacgtatggggacaaggcacaacagtaacagtatcatcagcatccacaaaaggaccatctgtatttccactagctccatcatcaaaatctacatcaggaggaacagcagctcttggctgtctagttaaagattactttccagaaccagtaacagtatcatggaactcaggagcattaacatcaggagtacatacatttccagcagtattacaatcatcaggattatattcactatcatcagtagtaacagtcccatcatcatcactcggaacacaaacatatatctgcaacgtaaaccataaaccatcaaatacaaaagtagataaaagagtagaaccaaaatcatgtgacaaaacacat

SEQ ID NO: 47138 - RNA, 690 nt, synthetic construct
  misc_feature 1..690: note = derived and/or modified sequence opt6 from anti-HIV_1N0X_K-Chain
  source 1..690: mol_type = other RNA
caagtacaactagtacaatcaggagcagaagtaaaaaaaccaggagcatcagtaaaagtatcatgtcaagcaagcggatacagattctcaaactttgtaatacactgggtaagacaagcaccaggacaaagattcgaatggatgggatggataaatccatataacggtaacaaagaattctcagcaaaatttcaagatagagtaacatttacagcagacacatcagcaaacacagcctatatggaactaagatcattaagatcagcagatacagcagtatattactgtgcacgagtaggtccatattcatgggacgattcaccacaagataactattatatggacgtatggggaaaaggaacaacagtaatagtatcatcagcttcaacaaaaggaccatcagtatttccattagcacctagctcaaaatctacatcaggaggaacagccgcattaggatgtctagtaaaagattactttccagaaccagtaacagtatcatggaactcaggagctctaacaagcggagtacatacatttccagcagtattacaatcaagcggattatatagcctatcatctgtagtaacagtaccatcatcatcattaggaacacaaacctatatatgtaacgtaaaccacaaaccatcaaatacaaaagtagataaaaaagtagaaccaaaatcatgt

SEQ ID NO: 47139 - RNA, 645 nt, synthetic construct
  misc_feature 1..645: note = derived and/or modified sequence opt6 from anti-HIV_1N0X_M-Chain
  source 1..645: mol_type = other RNA
gaaatcgtattaacacaaagcccaggaacattatcactatcaccaggtgaaagagcaacattctcatgcagatcatcacactcaataagaagcagaagagtagcctggtatcaacacaaacctggacaagcaccaagattagtaatacacggcgtatcaaacagagcatcaggaatatcagatagattttcaggatcaggcagcggaacagacttcaccctaacaataacaagagtagaaccagaagacttcgcactatactactgccaagtatacggagcaagctcatacacattcggacaaggaacaaaactagaaagaaaaagaacagtagcagcaccatcagtattcatattcccaccatcagacgaacaactaaaatcaggaacagcatcagtagtatgcctattaaacaacttctacccaagagaagcaaaagttcaatggaaagtagacaatgcactacaaagtggaaactcacaagaatcagtaacagaacaagactcaaaagactcaacatatagtttaagctcaacattaacattatcaaaagcagattacgaaaaacacaaagtatacgcatgcgaagtaacacaccaaggattaagatcaccagtaacaaaatcattcaacagaggagaatgc

SEQ ID NO: 47140 - RNA, 654 nt, synthetic construct
  misc_feature 1..654: note = derived and/or modified sequence opt6 from anti-HIV_3QEH_HeavyChain
  source 1..654: mol_type = other RNA
gacatagtaatgacacaatcaccactatcactaccagtaacaccaggagaagccgcatccatatcctgcagatcctcccaatcattactacatacaaacggattccaatacctagactggtacctacaaaaaccaggacaatcaccacaactactcatatacctaggatcaaacagagcaacaggagtaccacacagattctcaggatcaggatcaggtacagaattcacactaaaaatatcaagagtagaagcagaagacgtaggagtatactactgcatgcaagcaaaagaatcaccaacattcggacaaggaacaaaagtagaaataaaaagaacagtagcagccccatcagtattcatattcccaccatccgacgaacaattaaaatcaggcacagcatcagtagtatgcctactaaacaacttctacccaagagaagcaaaagtacaatggaaagtagacaacgcactacaatcaggaaactcacaagaatcagtaacagaacaagactccaaagactcaacctactcactatcctcaacactaacactatcaaaagcagactacgaaaaacacaaagtatacgcatgcgaagtaacacaccaaggactatcatccccagtaacaaaatcattcaacagaggagaatgc

SEQ ID NO: 47141 - RNA, 696 nt, synthetic construct
  misc_feature 1..696: note = derived and/or modified sequence opt6 from anti-HIV_3QEH_G-Chain
  source 1..696: mol_type = other RNA
caagtccaattagtacaatcaggagccgaagtaagaaaaccaggagcatcagtaacagtctcctgcaaaacatctggctacacattcgtaaacttctacatagtatgggtaagacaagcaccaggacaaggactagaatggatgggagtaataaacccattcagaggagacacatactttgcacaaaaatttaaaggaagagtaacactaacaagagacacatcaacctcaacagtattcatggaactaagttcactaagaagtgacgacacagcaatatactactgcgcaagagacctagaaatgcgagacggaaacaaccacggatcacacctagaattttggggacaaggaactctagtaacagtatcatcagcatcaacaaaaggcccatcagtattcccactagcaccttcaagcaaatcaacaagcggaggaacagcagccttaggatgcttagtaaaagactacttcccagaaccagtaacagtatcctggaactcaggagcactaacatcaggagtccatacattcccagcagtactacaatcatcaggattatactcattatcatcagtagtaacagtaccaagttcaagcctaggaacacaaacatacatatgcaacgtaaaccacaaaccatcaaacacaaaagtagacaaaagagtagaaccaaaatcatgcgacaaaacacac

SEQ ID NO: 47142 - RNA, 678 nt, synthetic construct
  misc_feature 1..678: note = derived and/or modified sequence opt6 from anti-HIV_2B1H_HeavyChain
  source 1..678: mol_type = other RNA
gaaatacaactagaacaaagcggagctgaagtaaaaaaatcaggcgaaagcctaaaaatatcatgccaaacatcaggatattcattttcagattactggataggctgggttagacaaatgccaggaaaaggattagaatggatgggaatattttatcccggagattcagattcaagatacagtccatcattcgaaggacaagtaacaatgtcagcagatagaagtacaaatacagcacacttacaatggtcaagtttaaaaccaagcgacacagcattatactactgcgcaagattaggaggagactatgaagattcaggagcagatgcatttgacttttggggacaaggaacacttgtaacagtatcatcagcaagtacaaaaggaccatcagtatttccactagcaccatcatcaaaaagtacatcaggaggaacagcagctttaggatgtctagtaaaagattactttccagaaccagtaacagtaagttggaactcaggagcactaacatcaggagtacatacatttccagccgtattacaatcatcaggactatattcattatcatcagtagtaacagtaccatcatcatcactaggaacacaaacctatatatgtaacgtaaaccacaaaccatcaaatacaaaagtagataaaaaagtagaaccaaaatca

SEQ ID NO: 47143 - RNA, 645 nt, synthetic construct
  misc_feature 1..645: note = derived and/or modified sequence opt6 from anti-HIV_2B1H_LightChain
  source 1..645: mol_type = other RNA
caatctgtactaacacaaccaccatcagcatcaggaacacctggacaaagaatatcaatctcatgctcaggaacatcatccaacgtcgaaaacaactacgtctactggtaccaacacttaccaggcacagcaccaaaactactaatatacagaaacgaccacagatcatcaggcataccagacagattcagcgcatcaaaatcaggaacatcagcatcactagcaatatcaggactaagacctgaagacgaaggagactactactgcgcagcatgggacgactcacgcggaggaccagactgggtattcggaggaggaacaaaattaacagtactagcacaaccaaaagcagccccatccgtaacactattcccaccctcatctgaagaattacaagcaaacaaagcaacactagtatgcttaatatcagacttctatccaggagcagtaacagtagcatggaaagcagactcatcaccagtaaaagcaggagtagaaacaacaacaccatcaaaacaatccaacaataaatacgcagcatcatcttacctatcactaacaccagaacaatggaaatcacacaaatcatacagctgccaagtaacacacgaaggatcaacagtagaaaaaacagtagcaccaaca

SEQ ID NO: 47144 - RNA, 648 nt, synthetic construct
  misc_feature 1..648: note = derived and/or modified sequence opt6 from anti-HIV_3TNM_B-Chain
  source 1..648: mol_type = other RNA
caatcagtactaacccaaccaccatcagcatcaggatcaccaggacaatcagtaacaatatcttgcacaggaacatcatcagacgtaggaggatacaattacgtatcatggtaccaacaccacccaggaaaagctccaaaactaataatatccgaagtaaataacagaccatctggagtcccagacagattctcaggatcaaaatcaggaaacacagcatcactaacagtatcaggattacaagcagaagacgaagccgaatactactgctcatcatacacagacatacacaacttcgtattcggaggaggaacaaaattaacagtactaggacaaccaaaagcagcaccatcagtaacactattcccaccatcatcagaagaactacaagcaaacaaagcaacactagtatgcctaatatcagacttctaccccggcgcagtaacagtagcatggaaagcagactcatcacctgtaaaagcaggcgtagaaacaacaacaccatcaaaacaatcaaacaacaaatacgcagcatcatcatacctatcactcacaccagaacaatggaaatcacaccgatcatactcatgccaagtaacacacgaaggatcaacagtagaaaaaacagtagcacctacagaatgctca

SEQ ID NO: 47145 - RNA, 693 nt, synthetic construct
  misc_feature 1..693: note = derived and/or modified sequence opt6 from anti-HIV_3TNM_A-Chain
  source 1..693: mol_type = other RNA
caagtacaattacaagaatcaggaccaggcctagtcaaaccatcacaaacactatcactttcatgcacagtctcaggaggatcatcatcatccggagcacattactggtcatggataagacaatacccaggaaaaggcctagaatggataggatatatccattactcaggaaatacatattacaatccatcactaaaatcacgtataacaatatcacaacatacatcagaaaatcaattctcactaaaattaaactcagtaaccgtagcagacacagcagtatactactgcgccagaggtacaagattaagaacactcagaaatgcattcgatatatggggtcaaggaacaatggtaacagtatcatcagcttcaactaaaggaccatcagtattcccactagctccctcatctaaatcaacatcaggaggaacagcagcactaggatgtctagtcaaagactactttccagaaccagtaacagtttcatggaactcaggagcactaacatcaggagtacatacatttccagcagtattacaatcatcaggattatactcattatcatcagtagtaacagtaccatcatcatcactaggcacacaaacatatatatgtaatgtaaaccataaaccatcaaacacaaaagtagacaaaagagtagaaccaaaatcatgtgacaaaacacataca

SEQ ID NO: 47146 - RNA, 690 nt, synthetic construct
  misc_feature 1..690: note = derived and/or modified sequence opt6 from anti-HIV_3UJJ_HeavyChain
  source 1..690: mol_type = other RNA
gaagtacaactagtacaatcaggagctgaagttaaaaaaccaggagaatcattaaaaatatcatgcaaagcatcaggatattcatttagctcatactggatagcctgggttagacaaatgcctggaaaaggactagaatggatgggattcatatacccagcagattcagacacaagatactcaccatcattccaaggacaaggaacaatatcagcagataaatcaatatcaacagcatacttacaatggtcatcactaaaagcatcagacacagcaatgtactattgtgcaatattaggcttttggggagcaaacagaggaggcggtggcatggacgtatggggacaaggaacaacagtaatagtatcttcagcatcaacaaaaggaccaagtgtatttccattagccccatcatctaaatcaacatcaggcggaacagctgcattaggatgtctagtaaaagattactttccagaaccagtaacagtatcatggaactcaggagcactaacatcaggagtacatacattcccagcagtattacaatcttcaggactatattcactatcatctgtagtaacagtaccatcaagctcactaggaacacaaacatatatatgtaacgtaaaccataaaccatcaaatacaaaagtagataaaaaagttgaaccaaaatcatgtgacaaaaca

SEQ ID NO: 47147 - RNA, 639 nt, synthetic construct
  misc_feature 1..639: note = derived and/or modified sequence opt6 from anti-HIV_3UJJ_LightChain
  source 1..639: mol_type = other RNA
tcatacgaactaacccaaccaccatcagtatcagtatcaccaggacaaacagcaagaataacatgctcaggagatgccctaccagaaaaatatgcatactggtaccaacaaaaatcaggacaagcaccagtactaataatatacgaagactcaaaaagaccatcaggaataccagaaagattctcaggatcaagatcaggtaccatggcaacattaacaatatcaggagcacaagtagacgacgaagcagactactactgctactcaacaaactcaggtggaacattcttcgtattcggaacaggaacaaaagtaacagtattaggacaaccaaaagcaaacccaacagtaacactattcccaccatcttcagaagaactacaagcaaataaagcaacactagtatgcctaatatcagatttctacccaggagccgtaacagtagcatggaaagcagactcatcaccagtaaaagcaggagtagaaaccacaacaccatccaaacaatcaaacaacaaatacgcagcatcatcctacctatcattaacaccagaacaatggaaatcacacagatcatactcatgccaagtaacacacgaaggatcaacagtagaaaaaacagtagccccaacagaatgc

SEQ ID NO: 47148 - RNA, 669 nt, synthetic construct
  misc_feature 1..669: note = derived and/or modified sequence opt6 from anti-HIV_3UJI_HeavyChain
  source 1..669: mol_type = other RNA
caagtacaactagtacaatcagcagcagaagtaaaaaaaccaggagaagcactaaaaatatcatgcaaaggatcaggatactcattctcaaattattggatagcatgggtaagacaaatgccaggaaaaggattagaatggatgggaatagtttacccagatgactcagactcatcatacaacagctcatttcaaggacaaataacattctcagcagacaaatcaatatcaaccgcatacctacactggacatcactacaagcatcagacacagccatgtactactgcgcacgactaggatttgaaggagactactcaggatctttctttgactattggggacaaggaacattactaatagtatcatcagcatcaacaaaaggaccatcagtatttccactagcaccctcatcaaaatcaacttcaggaggaacagcagcactaggatgcctagtaaaagactacttcccagaaccagtaacagtatcatggaactcaggagcactaacatcaggagtacacacattcccagcagtactacaatcatcaggactatactcactatcatcagtagtaacagtaccatcatcatctctaggaacacaaacatacatatgcaacgtcaaccacaaaccatcaaatacaaaagtagacaaaaaagtagaacca

SEQ ID NO: 47149 - RNA, 627 nt, synthetic construct
  misc_feature 1..627: note = derived and/or modified sequence opt6 from anti-HIV_3UJI_LightChain
  source 1..627: mol_type = other RNA
tcatacgaattaacacaaccaccatcagtatcagtatcaccaggacaaacagcatcaatcacatgctcaggagatatactaggagacaaatacgtatcatggtaccaacaaaaatcaggacaatcaccactattagtaatatacgaagacactaaaagaccatcaggaataccagacagattttcaggctcaaaatctggaaacacagcaacactaacaatatcaggaacacaagcaatggacgaagcagactactactgccaagcatgggactcaacactaggcgtagtattcggaggaggaacaaaagtaacagtcctaggacaaccaaaagcagcaccatccgtaacactattcccaccctcatccgaagaactacaagcaaacaaagcaacactagtatgcttaatatcagacttctaccccggagcagtaacagtagcatggaaagcagactcatcaccagtaaaagcaggagtagaaacaacaacaccctcaaaacaatcaaacaacaaatacgcagcatcatcatacctatcattaacaccagaacaatggaaatcacacaaatcatattcatgccaagtaacacacgaaggatctacagtagaaaaaacagtagcacca

SEQ ID NO: 47150 - RNA, 666 nt, synthetic construct
  misc_feature 1..666: note = derived and/or modified sequence opt6 from anti-HIV_2QSC_HeavyChain
  source 1..666: mol_type = other RNA
caagtacaattagtacaatcaggaggaggcctagttcaaccaggaggatcactaagattatcatgcgcagcattcggattcaatttctcatcatatgtaatgcactgggtaagacaagcaccaggacaaggactagaatacctatcagcaatatcatcagatggagaaacaacataccacgcaaactcagtaaaaggaagatttacaagctccagagacaactctaaaaacacactattcctacaaatgggatcattaagaacagaagacgtcgcagtatattactgcgcaagagacagatactatgaaacatcaggatcaaatgcatttgacgtatggggacaaggaacaatggtagtagtatcatcagcatcaacaaaaggaccatcagtatttcccctagcaccatgctcaagatcaacatcagaaagcactgcagcactaggatgcttagtaaaagattatttccccgaaccagtaacagtatcctggaactcaggagctctaacatccggagtacacacattcccagcagtattacaatcttcaggtctatattcattatcatcagtagtaacagtaccatcatcaaacttcggaactcaaacttatacatgtaatgtagaccataaaccttcaaatacaaaagtagacaaaacagtagaa

SEQ ID NO: 47151 - RNA, 645 nt, synthetic construct
  misc_feature 1..645: note = derived and/or modified sequence opt6 from anti-HIV_2QSC_LightChain
  source 1..645: mol_type = other RNA
aactcagtactaacacaatcaccatcatctctatcagcatcagtaggagacagagtaacaataacatgccaagcatcacaagacatatcaaactacttaaactggtatcaacacaaaccaggaaaagccccaaaactattaatatacacagcctcaaacctagaaacaggagtaccatcaagattctcaggaggaggatcaggaacacacttctcattcacaataacatccctccaaccagaagacgcagcaacatacttctgccaacaatacgacaacttaggagacctatcattcggaggaggaacaaaagtagaaataaaacgaacagtagccgcaccatcagtattcatattcccaccctcagacgaacaactaaaatcaggaacagcttcagtagtatgcctactaaacaacttctacccacgcgaagccaaagtacaatggaaagtagacaacgcactacaatcaggaaactcacaagaatcagtaacagaacaagactcaaaagactcaacatactccttatcatccacactaacactatcaaaagcagactacgaaaaacacaaagtatacgcctgcgaagtcacacaccaaggactatcatcaccagtaacaaaatcattcaacagaggagaatgc

SEQ ID NO: 47152 - RNA, 690 nt, synthetic construct
  misc_feature 1..690: note = derived and/or modified sequence opt6 from anti-HIV_3MLZ_HeavyChain
  source 1..690: mol_type = other RNA
caagtacaactacaagaatcaggaccaggactagtaaaaccatcagaaacactatcattaacatgcacagtatcaggaggctcaatatcaggatttcactggtcatggataagacaaccaccaggaaaaggactagaatacataggatacatatactattccggatcaacctcatacaatccatcactaaaatcaagagtatcaatgtcagtagatacatcaagaaatcaattttcactagaactatcctcagtcacagcagcagacacagcagtatactattgcgcaagagacttcggtgaatatcactacgatggaagaggattccaatgcgaaggatttgatttatggggacaaggaacactagtaacagtatcatcagcaagcacaaaaggaccatcagtatttccattagcaccatcatctaaatctacatcaggaggaacagcagccttaggatgtctagtaaaagattactttccagaaccagtaacagtctcatggaactcaggagcactaacatcaggagtacatacatttccagcagtcttacaatcatcaggtctatactcattatcatcagtagtaacagtaccatcatcatcactaggaacacaaacatacatatgtaacgtaaaccataaaccatcaaatacaaaagtagataaaaaagtagaaccaaaatcatgc

SEQ ID NO: 47153 - RNA, 642 nt, synthetic construct
  misc_feature 1..642: note = derived and/or modified sequence opt6 from anti-HIV_3MLZ_LightChain
  source 1..642: mol_type = other RNA
caatctgtactaacacaaccaccatcagtatcagcagcaccaggacaaaaagtaacaatatcatgctcaggatcatcatcaaacataggaaacaatatggtatcttggtaccaacaacaccccggaacagccccaaaactattaatatacgaaaactcaaaaagaccatcaggaataccagacagattctccggatcaagatcaggaacatcagcaacactaggaatcataggactacaaaccggagacgaagcagaatactactgcgcaacctgggacggatcactaagaacagtattcggaggaggaacaaaattaacagtattatcccaaccaaaagccgcaccatccgtaacattattcccaccctcatcagaagaattacaagcaaacaaagcaacattagtatgcctaatctcagacttctacccaggagcagtaacagtagcatggaaagccgactcatcaccagtaagagcaggagtagaaacaacaacaccatcaaaacaatcaaacaacaaatacgcagcatcatcatacttatcattaacaccagaacaatggaaatcccacagatcatactcatgccaagtaacacacgaaggatcaacagtagaaaaaacagtagcaccaacagaatgt

SEQ ID NO: 47154 - RNA, 684 nt, synthetic construct
  misc_feature 1..684: note = derived and/or modified sequence opt6 from anti-HIV_3MLX_I-Chain
  source 1..684: mol_type = other RNA
caagtacaactacaagaatcaggaccaggattagtaaaaccatctgaaacattatcattaacatgtacagtatcaggaggatcaatatcaggattccactggtcatggatacgacaaccacccggaaaaggactagaatatataggatacatatattatagtggatcaacatcctacaatccatcattaaaatcaagagtatccatgtcagtagatacatcacgaaaccaattttcactagaactatcatccgtaacagcagcagacaccgcagtttactattgcgcaagagacttcggagaatatcactatgacggaagaggattccaatgcgaaggatttgacttatggggtcaaggaacattagtaacagtatcatcagcatcaacaaaaggaccatcagtatttccactagcaccatcatctaaatcaacatcaggcggaacagcagcattaggatgcctagtaaaagattactttccagaaccagtaacagtatcatggaactcaggagcactaacatcaggagtacatacctttccagcagtactccaatcatcaggattatattcactatcatcagtagtcacagtaccatcatcatcactaggaacacaaacatacatatgcaacgtaaaccataaaccatcaaatacaaaagtagataaaaaagtagaaccaaaa

SEQ ID NO: 47155 - RNA, 633 nt, synthetic construct
  misc_feature 1..633: note = derived and/or modified sequence opt6 from anti-HIV_3MLX_M-Chain
  source 1..633: mol_type = other RNA
tcagtactaacacaaccaccatcagtatctgcagcaccaggacaaaaagtaacaataagctgctcaggatcatcatcaaacataggaaacaacatggtatcatggtatcaacaacacccaggaacagcaccaaaactattaatatatgaaaactcaaaaagaccatcaggaataccagacagattctcaggatcaagatcaggaacatcagcaacattaggaataataggactacaaacaggagacgaagcagaatactactgcgcaacatgggacggcagcctaagaacagtattcggaggtggaacaaaactaacagtattatcacaaccaaaagcagccccaagcgtaacattattcccaccatcatcagaagaactacaagcaaacaaagcaacattagtatgcctaatatcagacttctacccaggagcagtaacagtagcatggaaagcagactcatcaccagtaagagcaggagtagaaacaacaacaccatcaaaacaatcaaacaacaaatacgcagcatcatcatacctatcactaacaccagaacaatggaaatcacaccgatcatatagctgccaagtaacacacgaaggatcaacagtagaaaaaacagtagcaccaaca

SEQ ID NO: 47156 - RNA, 684 nt, synthetic construct
  misc_feature 1..684: note = derived and/or modified sequence opt6 from anti-HIV_3MLW_I-Chain
  source 1..684: mol_type = other RNA
caagtacaactagtacaatcaggagcagaagtaaaaaaagcaggagaatcattagaaatatcttgcaaaggatcaggatatacatttacagatcactggatagcatgggtaagacaagtaccaggaaaaggcctagaatggatgggaatgatatatcctggagatagcgacacaagatactcaccatccctacaaggacgagtcacaatgagtgcagataaaacactatcaacagcatacctacaatggtcaagactcgaagcatcagatacagcaatgtactattgcgctagattacactattcagatagatctggatcatactttaacgatgtatttcacatgtggggacaaggaacaacagtaacagtatcatcagcatcaacaaaaggaccaagtgtatttccactagcccctagctcaaaatcaacatctggaggaacagcagcattaggatgtctagtaaaagactactttccagaaccagtaacagtatcatggaactcaggagcactaacaagcggagtacatacattcccagcagtattacaaagttcaggactatattcattatcatctgtagtaacagtaccatcatcatcactaggaacacaaacatatatatgtaacgtaaaccataaaccaagcaatacaaaagtagataaaaaagtagaaccaaaatca

SEQ ID NO: 47157 - RNA, 645 nt, synthetic construct
  misc_feature 1..645: note = derived and/or modified sequence opt6 from anti-HIV_3MLW_M-Chain
  source 1..645: mol_type = other RNA
caatcagtactaacacaaccaccatcagcatcaggaacaccaggacaaagagtaacaatatcctgctcaggaaactcatcaaacatagaaaacaactacgtatactggtaccaacaactaccaggctcaacaccaaaactactaatattcagagacgaccaaagaccatcaggagtaccagacagattctcaggaagtaaatcaggaacatcagcatcactagcaatatcaggactaagatcagaagacgaagccgactactactgcgcatcatgggatgactcaagaggaggaccagactatgtattcggaacaggaacaaaagtaacagtactaggacaaccaaaagcaaacccaacagtaacactattcccaccatcttcagaagaactacaagcaaacaaagcaacattagtctgcctaatatcagacttctaccctggagcagtaacagtagcatggaaagcagacggatcaccagtaaaagcaggagtagaaaccacaaaaccatcaaaacaatcaaataacaaatacgccgcatcctcatatctatcactaacaccagaacaatggaaatcacacagatcatacagctgccaagtaacacacgaaggatcaaccgtagaaaaaacagtagcaccaaca

SEQ ID NO: 47158 - RNA, 678 nt, synthetic construct
  misc_feature 1..678: note = derived and/or modified sequence opt6 from anti-HIV_3MLV_N-Chain
  source 1..678: mol_type = other RNA
gaagtacaactagttgaatcaggaggagaagtaaaacaaccaggacaatctctaaaaatatcatgcaaatcatcaggatataacttcttagattcatggataggatgggtaagacaaataccaggaaaaggactagaatggataggaataatttacccagacgattcagatgctcattactcaccatcattcgaaggacaagtaactatgtcagtagacaaatcaatatcaacagcatacttacaatggacaactctacaagcatcagacacaggaaaatatttttgcacaagactatacttattcgaaggagcacaatcttcaaatgcatttgacttatggggacaaggaacaatgatacttgtatcttctggaacaacaaaaggtccatcagtatttcccttagcaccatcatcaaaatcaacatcaggaggaacagcagcattaggatgtttagtaaaagattacttcccagaaccagtaacagtatcatggaactcaggagcactaacatcaggagtacatacatttccagcagtattacaatcctcaggactatattcactatcatctgtagtaactgtaccatcatcatcactaggaacacaaacatatatatgtaacgtaaaccataaaccatcaaatacaaaagtagataaaaaagtcgaaccaaaatca

SEQ ID NO: 47159 - RNA, 657 nt, synthetic construct
  misc_feature 1..657: note = derived and/or modified sequence opt6 from anti-HIV_3MLV_M-Chain
  source 1..657: mol_type = other RNA
tcatacctactaacacaaccaccatcagtatcagtatcaccaggacaaacagcatcaatatcatgctcaggagataaactagacgacaaatacgtatcatggtactaccaacgaccaggacaatcaccagtcttactcatgtaccaagacttcaaaagaccctcaggaataccagaaagactaagcggatcaaaaagcggaaaaacagcaacactaacaatatcaggaacacaatctctagacgaaggagactactattgccaagcatgggacgcatcaacaggagtatcaggaggcggaacaaaactaacagtactattcggagaaggaacaagactaacagtactagcacaaccaaaagcagcacctagcgtaacactatttccaccctcatcagaagaattacaagcaaacaaagcaacactagtatgcctaatatcagacttttacccaggtgcagtaacagtagcatggaaagcagactcatcaccagtcaaagcaggcgtagaaacaacaacaccatcaaaacaatcaaacaacaaatacgcagcatcatcatacctatcactcacaccagaacaatggaaatcacacaaatcatactcctgccaagtcacacacgaaggatcaacagtagaaaaaacagtagcacccaca

SEQ ID NO: 47160 - RNA, 654 nt, synthetic construct
  misc_feature 1..654: note = derived and/or modified sequence opt6 from anti-HIV_3MLU_LightChain
  source 1..654: mol_type = other RNA
tacctactaacacaaccaccatccgtctcagtatcaccaggccaaacagcatcaatatcatgctcaggagacaaactcgacgacaaatacgtatcatggtactaccaaagaccaggacaatcaccagtactattaatgtaccaagactttaaaagaccatcaggaataccagaaagactatcaggttcaaaatcaggaaaaacagcaacattaacaatatcaggcacacaatcactagacgaaggagactactactgccaagcatgggacgcaagtacaggagtatccggaggaggaacaaaactaacagtactattcggagaaggaacacgattaacagtactagcacaacctaaagcagcaccatcagtaacactattcccaccatcatcagaagaactacaagcaaacaaagcaacacttgtatgtctaatatcagacttctacccaggagcagtaacagtagcttggaaagcagactcatcaccagtaaaagcaggagtagaaacaacaacaccatcaaaacaatcaaataacaaatacgcagcatcaagttacttatcactaacaccagaacaatggaaatcacacaaatcatactcatgccaagtaacacacgaaggaagcacagtagaaaagacagtagcaccaact

SEQ ID NO: 47161 - RNA, 657 nt, synthetic construct
  misc_feature 1..657: note = derived and/or modified sequence opt6 from anti-HIV_3MLT_G-Chain
  source 1..657: mol_type = other RNA
tcctacgacctaacacaaccaccctcagtatcagtatcaccaggacaaacagcatcaatatcatgctcaggcgacaaattagacgacaaatacgtatcatggtactaccaaagaccaggacaatcaccagtattattaatgtaccaagacttcaaaagaccatcaggaatacccgaaagactatcaggaagcaaatcaggaaaaacagcaacattaacaatatccggcacacaatcactagacgaaggagactactactgccaagcatgggacgcatcaacaggagtatccggaggaggaacaaaattaacagtcttattcggcgacggcacaagactaacagtactaggacaaccaaaagcagcaccatcagtaacattattcccaccatcaagtgaagaactacaagcaaacaaagccacactagtatgcttaatatcagacttctacccaggagccgtaacagtagcatggaaagcagactcatcaccagtaaaagcaggagtagaaacaacaacaccatcaaaacaaagtaacaataaatatgcagcttcatcatacctatcactcacaccagaacaatggaaatcccacaaatcatattcatgtcaagtaacacacgaaggaagcacagtagaaaaaacagtagcaccaaca

SEQ ID NO: 47162 - RNA, 666 nt, synthetic construct
  misc_feature 1..666: note = derived and/or modified sequence opt6 from anti-HIV_3GO1_HeavyChain
  source 1..666: mol_type = other RNA
gaagtacaattacaagaatcaggaccaggcctagtaaaaccatcagaaacactatcactaacatgcacagtatcaggaggaccaataaacaacgcatactggacatggataagacaaccaccaggaaaaggactagaatacttaggatatgtataccacacaggagtaacaaactataatccatcactaaaatcaagactaacaataacaatagacacatcaagaaaacaattatcactatccttaaaattcgtaacagcagcagactcagccgtatactactgcgcaagagaatgggcagaagacggagacttcggaaacgccttccacgtatggggacaaggaacaatggtagcagtatcatcagcatcgacaaaaggaccaagcgtgttcccactagcaccatcatccaaatcaacaagcggaggaacagcagcactaggatgcttagtcaaagactacttcccagaaccagtaacagtatcatggaactcaggagcacttacatcaggagtacacacattcccagcagtactacaatcatcaggactatactccttatcatcagtcgtaacagtaccatcatcaagtctaggaacacaaacatacatatgcaacgtcaaccacaaaccctcaaacacaaaagtagacaaaagagtagaacca

SEQ ID NO: 47163 - RNA, 627 nt, synthetic construct
  misc_feature 1..627: note = derived and/or modified sequence opt6 from anti-HIV_3GO1_LightChain
  source 1..627: mol_type = other RNA
tcatacgtattaacacaaccaccatcagtatctgtaagtccaggacaaacagcaagaataacatgctcagcagaagcattatcaaaccaatacgcatactggtacagacaaagaccagggcaagcaccactactaataatatataaagacacaaaaagaccatcaggcataccagaaagattctcaggctcaacatcaggaacaacagtaacactaactatatcaggagtacaagcagaagacgaagcagactattattgccaaagcgcagactcatcaggagactacgtattcggaggaggaacaaaagtaacagtactaggacaaccaaaagcaaacccaacagtaacattattcccaccctcaagcgaagaactacaagcaaataaagcaacattagtatgcctaatatcagatttttacccaggagcagtaacagtagcatggaaagcagatggatcaccagtaaaagcaggagtagaaacaaccaaaccatccaaacaatcaaacaacaaatacgcagcatcatcatatttatcattaacaccagaacaatggaaatcacacagaagctactcatgccaagtaacacacgaaggctcaacagtagaaaaaacagtagcacca

SEQ ID NO: 47164 - RNA, 690 nt, synthetic construct
  misc_feature 1..690: note = derived and/or modified sequence opt6 from anti-HIV_4XCY_J-Chain
  source 1..690: mol_type = other RNA
caagtacaattagtacaaagtggcgcagaagtaaaaagaccaggatcatcagtcacagtatcatgtaaagcatcaggaggaagcttctcaacatatgcattatcatgggtaagacaagcaccaggaagaggattagaatggatgggaggagtaattccactactaacaataacaaactatgcaccaagatttcaaggaagaataacaataaccgcagacagatcaactagcactgcatatttagaattaaatagtttaagaccagaagatacagcagtatattactgtgcaagagaaggaacaacaggatggggatggttaggtaaaccaatcggagcatttgcacattggggacaaggaacactagtaacagtaagttcagcctcaactaaaggaccatcagtatttccactagccccctcatcaaaaagcacaagtggaggtacagctgcattaggatgtctagtaaaagattattttccagaaccagtaacagtttcatggaactcaggagcattaacatcaggagtacatacatttccagcagtattacaatcatcaggactatattcattatcaagcgtagtaacagtaccaagttcatcattaggcacacaaacatatatatgtaatgttaaccataaaccatcaaatacaaaagtagataaaaaagtagaaccaaaatcatgt

SEQ ID NO: 47165 - RNA, 645 nt, synthetic construct
  misc_feature 1..645: note = derived and/or modified sequence opt6 from anti-HIV_4XCY_K-Chain
  source 1..645: mol_type = other RNA
gaaatagtcctaacacaatcaccaggaacacaatccctatcaccaggagaaagagcaacactatcatgccgagcatcacaatcagtaggaaacaacaaactagcatggtaccaacaaagaccaggacaagcaccaagattactaatatacggagcaagctcacgaccatcaggagtagcagacagattctcaggatcaggatcaggaacagacttcacattaacaatatcaagactagaaccagaagacttcgcagtatattactgccaacaatacggacaatcactaagtacattcggacaaggaaccaaagtagaagtaaaaagaacagtagcagcaccatcagtattcatattcccaccatcagacgaacaattaaaatcaggaacagcatcagtagtatgcttactaaacaacttctacccaagagaagccaaagtacaatggaaagtagacaacgcactacaatcaggaaactcacaagaatcagtaacagaacaagactcaaaagactcaacatacagcttaagctcaacactaacactatcaaaagcagactacgaaaaacacaaagtatacgcatgcgaagtaactcaccaaggactatcatcaccagtaacaaaatcattcaacagaggcgaatgt

SEQ ID NO: 47166 - RNA, 630 nt, synthetic construct
  misc_feature 1..630: note = derived and/or modified sequence opt6 from anti-HIV_4YBL_C-Chain
  source 1..630: mol_type = other RNA
gtcctaacacaaccaccatcagcatcaggatcaccaggacaatcagtaacaatatcatgcacaggaacatcatcagacgtaggaggatacaactacgtaagctggtaccaacaccatcccggaaaagctccaaaactaataatatcagaagtaaacaatagaccatcaggagtaccagacagattctcaggatcaaaatcaggaaatacagcatcattaacagtatcaggactacaagccgaagacgaagcagaatactattgctcatcatatacagacatacataacttcgtattcggaggaggaacaaaattaacagtactaggacaaccaaaagcagcaccatcagtaacactattcccaccatcctcagaagaactacaagcaaacaaagcaacactagtatgtctaatatcagacttctacccaggtgcagtaacagtagcctggaaagcagactcatcacccgtaaaagccggtgtagaaacaacaacaccatcaaaacaatcaaataacaaatacgcagcatcatcatacctatcattaacaccagaacaatggaaatcacacagatcctactcatgccaagtaacacacgaaggatcaacagtagaaaaaacagtagcacca

SEQ ID NO: 47167 - RNA, 672 nt, synthetic construct
  misc_feature 1..672: note = derived and/or modified sequence opt6 from anti-HIV_4YBL_B-Chain
  source 1..672: mol_type = other RNA
caagtacaactacaagaatcaggaccaggtctagtaaaaccatcacaaacactatcactatcatgcacagtatctggaggatcatcatcatcaggagcacactactggtcatggatacgacaatacccaggaaaaggactagaatggataggatacatacactattcaggaaacacatactacaacccatcactaaaatccagaataacaatatcacaacacacatcagaaaaccaattctcacttaaactaaactcagtcactgtagctgacacagcagtatactactgcgcaagaggaacacgactaagaacattaagaaacgcattcgacatatggggacaaggaacaatggtaacagtatcatcagcatcaacaaaaggaccatcagtattcccactagcaccatcatccaaatcaacatcaggaggaacagcagcactaggatgcctagttaaagactacttcccagaacccgtaacagtatcatggaacagcggcgcactaacatcaggagtacacacattcccagcagtattacaatcatcaggattatattcactatcatcagtagtaacagtaccatcaagctctctaggcacacaaacatacatatgcaacgtaaaccacaaaccatcaaacacaaaagtagataaaagagtagaaccaaaa

SEQ ID NO: 47168 - RNA, 630 nt, synthetic construct
  misc_feature 1..630: note = derived and/or modified sequence opt6 from anti-HIV_4R4N_X-Chain
  source 1..630: mol_type = other RNA
gacatacaaatgacacaatcaccatcattcgtatcagcatcagtaggagacagagtaacaataacatgcagagcatcacaaggaatatcatcatacctagcatggtaccaacaaaaaccaggaaaagcaccaaaattagtaatatatgcagcatcaacactacaatcaggagtaccatcaagattctcaggatccggatcaggaacagaattcacactaacaatatcctcactacaaccagaagacttcgcaacatactactgccaacacctaattggactacgatcattcggacaaggaacaaaattagaaataaaaagaacagttgcagcaccatcagtattcatattcccaccatcagacgaacaactaaaatcaggaacagcatccgtagtatgtctattaaacaacttctacccaagagaagcaaaagtccaatggaaagtagacaacgcactacaaagcggaaactcacaagaaagcgtaacagaacaagactcaaaagactcaacatactcactaagctcaacactaacactatccaaagcagactatgaaaaacacaaagtatacgcatgcgaagtaacacaccaaggactatcatcaccagtaacaaaatcattcaacaga

SEQ ID NO: 47169 - RNA, 660 nt, synthetic construct
  misc_feature 1..660: note = derived and/or modified sequence opt6 from anti-HIV_4R4B_F-Chain
  source 1..660: mol_type = other RNA
caagtacaactccaacaatggggagcaggacttctaaaaccatcagaaacactatcactaacatgcggagtatacggagaatcactatcaggacactactggtcatgggtaagacaaccaccaggaaaaagattagaatggataggagaaataaaacacaacggatccccaaattaccacccatcactaaaatcaagagtaacaatatcattagacatgtcaaaaaaccaattctcactaaacctaacatcagtaacagcagcagacactgcagtatacttctgcgcaagaagatcaaactggccatacctaccattcgacccatggggccaaggaacattagtaacagtatcctcagcatccacaaaaggaccatcagtattcccactagcaccatcatcaaaatccacatcaggaggaaccgcagcactaggatgcctagtaaaagactacttcccagaaccagtaacagtatcatggaactcaggagcactaacatccggcgtacacacatttccagcagtcctacaatcatcaggtctatactcactatcatcagtagtcacagtaccatcatcatcattaggaacacaaacatacatatgcaacgtaaaccacaaaccaagcaacacaaaagtagacaaaaaagtagaaccaaaa

SEQ ID NO: 47170 - RNA, 750 nt, synthetic construct
  misc_feature 1..750: note = derived and/or modified sequence opt6 from anti-HIV_3JUY_D-Chain
  source 1..750: mol_type = other RNA
caagtacaattagtacaaagtggagcagaagtaaaaaaaccaggagcaagtgtaaaagtaagttgtcaagcaagtggatatagatttagccattttacagtacattgggtaagacaagcaccaggacaaagatttgaatggatgggatggataaatccatacaatggaaacaaagaatttagtgcaaaatttcaagatagagtaacttttacagcagatacaagtgcaaatacagcatatatggaactaagaagtttaagaagtgcagatacagcggtatattattgtgcaagagtaggagaatggggatgggatgatagtccgtatgataattattatatggatgtatggggaaaaggaacaacagtaatagtaagtagtgggggaggagggtcaggaggaggaggaagtggaggaggaggaagtgaaatagtattaacgcaagcaccgggaacattatcactaagtccaggagaaagagcaacttttagttgtagaagcagtcacagtataagaagtagaagagtcgcatggtatcaacataaaccaggacaagcaccaagactagtaatacatggagtaagtaatagagcgagtggaataagtgatagatttagtggaagtggaagtggaacggattttacactaacaataacaagagtagaaccagaagattttgcattatattattgtcaagtatatggagcatcaagttatacttttggacaaggaacaaaattagaaagaaaa

SEQ ID NO: 47171 - RNA, 369 nt, synthetic construct
  misc_feature 1..369: note = derived and/or modified sequence opt6 from anti-HIV_4KG5_HeavyChain
  source 1..369: mol_type = other RNA
caattagtacaaagtggaccagaagcaaaaagaccaggatcatcagtaaaagtatcatgcaaagcatcaagagacacattcaacaactacgtactaaactgggtaagacaagcaccaggacaaggactagaatggatgggaggaataggaccaataatagaaacagcagactacgcagaaaaattcagaggaagactatcaataacagcagacgaatcaacaacaacagcatacatggaactatcatcactaacatcagacgacacagcagtatactactgcgcaagatcaccatacagctcactaacagacacatactactactacatggacctatggggaaaaggaacaacagtaacagtatcatca

SEQ ID NO: 47172 - RNA, 336 nt, synthetic construct
  misc_feature 1..336: note = derived and/or modified sequence opt6 from anti-HIV_4KG5_LightChain
  source 1..336: mol_type = other RNA
ctaacacaatcaccagactcactagcagtatcactaggagaaagagcaacaataaactgcaaatcatcccaatcaatactagactcatcaaacaacagaaactacctaacatggtaccaacaaaaaccaggacaaccaccaaaactactaatatactgggcatcaacaagagaatcaggagtaccagacagattctcaggatcaggatcatcaacagacttcacactaacaatatcatcactacaagcagaagacgtagcagtatactactgccaacaatacttctcaacaccaggaataacattcggacaaggaacaagactagaaataaaaaga

SEQ ID NO: 47173 - RNA, 309 nt, synthetic construct
  misc_feature 1..309: note = derived and/or modified sequence opt6 from anti-HIV-1_LightChain
  source 1..309: mol_type = other RNA
gaaatagtactaacacaatcaccagcaacactaagcctatcaccaggagaaagagcaacactatcatgcagagcatcacaatcagtatacacaaaactagcatggtaccaacaaaaaccaggacaaccaccaagactactaatatacgacgcatcaaacagagcagcaggaataccagcaagattctcaggatcaggatcaggaacagaattcacactaacaataaaaagaatggaaagagaagacttcgcagtatactactgccaaatactagaattcttcggacaaggaacaacaatagacatgaac

SEQ ID NO: 47174 - RNA, 312 nt, synthetic construct
  misc_feature 1..312: note = derived and/or modified sequence opt6 from anti-HIV-1_LightChain
  source 1..312: mol_type = other RNA
gatatacaaatgacacaatcaccatcatcagtaagcgcaagcgtaggagatagagtaacaataacatgtagagcaagccaaggaatactatcaagccaactagcatggcatcaacaaagaagaggacaaccaccaagattactaatatacggaggatcaaacagagcaccaggaataccagaaagatttacaggaagcggaagcggaacagatttcgtactaacaataaaaagattacaaagagacgatttcgcagtatattactgtcaaatactagaatttttcggaagaggaacaagagtagaaatgaac

SEQ ID NO: 47175 - RNA, 312 nt, synthetic construct
  misc_feature 1..312: note = derived and/or modified sequence opt6 from anti-HIV-1_LightChain
  source 1..312: mol_type = other RNA
ggattattactaacacaatcaccaggaccagtatcatttttcccaggagaaagagcaacagtaagctgtagagcaagccatagcgtaaacagcgcagcaataaattggtatcaacaaaaacgaggacaaccaccaagattaataatagtagatggatcaacaagagcaacagcagtaccagaaagatttagcgcaacaggaagcggaacagaatttacattagtaatatcaagactagaaccagaagatttcgcagtatatttctgtcaacatctacaattcttcggattaggaacaaaagtagacataaaa

SEQ ID NO: 47176 - RNA, 312 nt, synthetic construct
  misc_feature 1..312: note = derived and/or modified sequence opt6 from anti-HIV-1_LightChain
  source 1..312: mol_type = other RNA
gcattcgtaatgacacaatcaccaggaacattagcattaagcccaggagaaagagcaacattaagctgtagaacaagccaagaaatactatcaaaccaactagcatggcatcaacaaagaagaggacaaccaccaagattactaatatacggaggatcaaacagagcaccaggaataccagaaagatttacaggaagcggaagcggaacagatttcgtactaacaataaatagattagaaagagacgatttcgcagtatattactgtcaaatactagaatttttcggaagaggaacaagagtagaaatgaac

SEQ ID NO: 47177 - RNA, 312 nt, synthetic construct
  misc_feature 1..312: note = derived and/or modified sequence opt6 from anti-HIV-1_LightChain
  source 1..312: mol_type = other RNA
ggaatagtactaacacaatcaccagatacactatcactatcaccaggagacagagcaacattatcatgtaaaacatcacaatcaatagcatcagaacacctagcatggtatcaacaaagaccaggacaaccaccaagactattaatattcggagcatcaaacagagcatcaggaataccaacaagattctcaggatcaggatcaggagcagacttcacactatcaataacaagattagaaccagaagacttcgcagtatactactgtcaattctcagaatttttcggaagaggagcaagagtagaagtaaaa

SEQ ID NO: 47178 - RNA, 312 nt, synthetic construct
  misc_feature 1..312: note = derived and/or modified sequence opt6 from anti-HIV-1_LightChain
  source 1..312: mol_type = other RNA
caattcgtaatgacacaatcaccagcaacactatcatcatcaccaggaggaacagcaacactatcatgcagaacatcacactcaatactaaactcacaactagcatggcaccaacaaagaagaggacaaccactaagactactaatatacggagcatcaaacagagcaccaggaataccagaaagattctcagcatcaggatcaggaacagaattcgtactaacaataaaacgaatggaaagagaagacttcgcagtatactactgccaaatactagaattcttcggacaaggaacaacaatagacatgaac

SEQ ID NO: 47179 - RNA, 354 nt, synthetic construct
  misc_feature 1..354: note = derived and/or modified sequence opt6 from anti-HIV-1_HeavyChain
  source 1..354: mol_type = other RNA
agagtacatttagtacaaagtggaacacaagtaaaaaaaccaggagcaagtgtaaaagtaagttgtgaaacaagtggatttaaatttttagatagtttaatacattgggtaagacaagcaccaggacaaggattatattggatgggatggataaaaccatatagaggaagtgtaaattatgatggatattttagaggaagagtaagtatgacaagagatatatatacagatacagcatatttagaattaagtggattaagaagtgatgatacagcaatatattattgtgcatttggagcaggagatggatgggatttagtatggggacaaggaacattagtaatagtaagtagt

SEQ ID NO: 47180 - RNA, 354 nt, synthetic construct
  misc_feature 1..354: note = derived and/or modified sequence opt6 from anti-HIV-1_HeavyChain
  source 1..354: mol_type = other RNA
agagtacatttagtacaaagtggaacacaagtaaaaaaaccaggagcaagtgtaaaagtaagttgtgaaacaagtggatttaaatttttagattcactaatacattgggtaagacaagcaccaggacaaggattatattggatgggatggataaaaccatttagaggaagtgtaaattatgatggatattttagaggaagagtaagtatgacaagagatatatatacagatacagcatatatggaattatcaggattaagaagtgatgatacagcaatatattattgtgcatttggagcaggagatggatgggatttagtatggggacaaggaacattagtaatagtaagtagt

SEQ ID NO: 47181 - RNA, 354 nt, synthetic construct
  misc_feature 1..354: note = derived and/or modified sequence opt6 from anti-HIV-1_HeavyChain
  source 1..354: mol_type = other RNA
caagtacatttagtacaaagtggaacacaagtaaaaaaaccaggagcaagtgtaagagtaagttgtgaaacaagtggatttaaatttttagatagtataatacattggtttagacaagcaccaggagaaggattattttggatgggatggataaaaccatatacaggaagtgtaaattatgtaagaagatatcaaggaagagtaagtatgacaagagatgtatatagtgatacagcatatatggatttatcaggattaaatagtgatgatacagcagtatatttttgtacatatggagcaggagatggatggaatttagtatggggacaaggaacattagtaatagtaagtgca

SEQ ID NO: 47182 - RNA, 363 nt, synthetic construct
  misc_feature 1..363: note = derived and/or modified sequence opt6 from anti-HIV-1_HeavyChain
  source 1..363: mol_type = other RNA
caagtaagattagtacaaagtggaaatcaagtaagaaaaccaggagcaagtgtaagaataagttgtgaagcaagtggatataaatttatagatcattttatacattgggtaagacaagtaccaggacatggattagaatggttaggatggataaatccaagaggaggaggagtaaattatagtagaggatttcaaggaaaattaagtatgacaatgacaagagataattttgaagaaacagcatatttagatttaagtagattaaatccaggagatacagcagtatattattgtgcaagaggatttgcaggatatgaatggagttttttatggggacaaggaacattagtaatagtaagtagt

SEQ ID NO: 47183 - RNA, 357 nt, synthetic construct
  misc_feature 1..357: note = derived and/or modified sequence opt6 from anti-HIV-1_HeavyChain
  source 1..357: mol_type = other RNA
caagtaagtttagtacaaagtggaaatcaattaaaaaaaccaggagcaagtgtaagaataagttgtgaaacaagtggatataattttttaaatcattttatacattgggtaagacaagtaccaggacatggattagaatggttaggatggataaatccaagaggaggaggagtaaattatagtagaaattttcaaggaaaagtaagtttaacaagaaatatagatatggaaacagtatatttagatgtaagaggactaacaccaggagatacagcagtatattattgtgcaagaggatttggaggaagtgattggaattttgtatggggacaaggaacaagaataacagtaagtgca

SEQ ID NO: 47184 - RNA, 357 nt, synthetic construct
  misc_feature 1..357: note = derived and/or modified sequence opt6 from anti-HIV-1_HeavyChain
  source 1..357: mol_type = other RNA
agaataaatttacatcaaagtggaagtcaagtaaaaagaagtggagcaagtgtaagaataagttgtgaaacaagtggatttaaatttatggatagtcatttacattgggtaagacaagtagcaggacaaggatttgaatggatgggatggatatttacaagtggaggaggagtaaattatgcaagacaatttcaaggaagattaacattaacaagagatgtatttacagatacagtatttatggatttaagtggagtaaatgtaggagatacaggagtatattattgtgtaaaaggaacaggaggaaatgaatggggatttagttggggacaaggaacagtagtagtagtaagtcca

SEQ ID NO: 47185 - RNA, 357 nt, synthetic construct
  misc_feature 1..357: note = derived and/or modified sequence opt6 from anti-HIV-1_HeavyChain
  source 1..357: mol_type = other RNA
agaataaatttagatcaaagtggaagtcaagtaaaaaaaagtggagcaagtgtaagaataagttgtgaaacaagtggatttaaatttatggatagtcatttacattgggtaagacaagtagcaggacaaccatttgaatggatgggatggatatttacaagtggaggaggagtaaattatgcaagacaatttcaaggaagattaacattaacaagagatgtatttagtgaaacagtatttatggatttaagtggattaaatgcaggagatacaggagtatatttttgtgtaaaaggaacaggaggaaatgaatggggatttgtatggggacaaggaacagtagtagtagtaagtcca

SEQ ID NO: 47186 - RNA, 357 nt, synthetic construct
  misc_feature 1..357: note = derived and/or modified sequence opt6 from anti-HIV-1_HeavyChain
  source 1..357: mol_type = other RNA
agaatagaattacatcaaagtggaagtcaagtaaaaaaaagtggagcaagtgtaagaataagttgtgaaacaagtggatttaaatttatggatagtcatttacattgggtaagacaagtagcaggacaaagatttgaatggatgggatggatatttacaagtggaggaggagtaaattatgcaagacaatttcaaggaagattaagattaacaagagatgtatttagtgaaagtgtatttatggatttaagtggattaaatagtggagatacaggagtatattattgtgtaaaaggaacaggaggaaatgaatggggatttgtatggggacaaggaagtctagtagtagtaagtcca

SEQ ID NO: 47187 - RNA, 372 nt, synthetic construct
  misc_feature 1..372: note = derived and/or modified sequence opt6 from anti-HIV-1_HeavyChain
  source 1..372: mol_type = other RNA
caagcattagtacaaagcggaagccaaatgaaaaaaccaggagattcagtaagattaagctgtcaaacaagcgatagcgcaataacaaaatatttcatacactggataagacaagcaccaggaaaaggactagaatggatagcatggatatcaccatatggaggaagagtaaactatggatggcaagtaagagatagagcaacattaacaagaaacatacacatggaaacagtatatatggatttaagaggattaagaccagacgatacagcaacatattactgtgcaatgagagattactgtagagatgacaattgcaatagatgggacttaggacattggggacaaggaagcctaatagtagtatcagca

SEQ ID NO: 47188 - RNA, 357 nt, synthetic construct
  misc_feature 1..357: note = derived and/or modified sequence opt6 from anti-HIV-1_HeavyChain
  source 1..357: mol_type = other RNA
caagtaacattagtacaaagtggaaatcaattaaaaagaccaggagcaagtgtaagaataagttgtgaaacaagtggatataattttatggatcattttatacattgggtaagacaagtaccaggacatggaccagaatggttaggatgggtaaatccaagaggaggaggagtaaattatagtagaaaatttcaaggaagatttagtatgacaagagatgtatatatggaaacagcatatttagatgtaacaggattaagtccagcagatacagcagtatattattgtgcaagaggatttggaggaagtgattggagttttttatggggacaaggaacattaataatagtaagtagt

SEQ ID NO: 47189 - RNA, 324 nt, synthetic construct
  misc_feature 1..324: note = derived and/or modified sequence opt6 from anti-HIV-1_LightChain
  source 1..324: mol_type = other RNA
gaaatagtactaacacaatcaccaggcacactatcactatcagcaggagaacgagcatcactatcatgcagagcatcacaaacactaaactcaaacttcttcgcatggtaccaccaaaaaccaggacaagcaccaagactactaatatacggagcatcaaacagagcaacaggaataccagacagattctcaggatcaggatcaggatcagacttcacactaacaatatcaagactagaaccagaagacttcggaaaatactactgcgaacaatacgacgtatcaccaagaacattcggacaaggaacaaaagtagaaataaaa

SEQ ID NO: 47190 - RNA, 324 nt, synthetic construct
  misc_feature 1..324: note = derived and/or modified sequence opt6 from anti-HIV-1_LightChain
  source 1..324: mol_type = other RNA
gaagtagtactaacacaatcaccaggaacattaagcctatcaccaggagaaagagcaacactatcatgcagagcatcacaatcaataaactcaaacttcttcgcatggtaccaccaaaaaccaggacaagcaccaagactactaatatacggagcatcatcaagagcaacaggaataccagacagaatatcaggaacaggatcaggagcagacttcacactaacaataacaggactagaaccagaagacttcggactatactactgccaacaatacgacttctcaccaagaacattcggacaaggaacaagagtagaaataaaa

SEQ ID NO: 47191 - RNA, 324 nt, synthetic construct
  misc_feature 1..324: note = derived and/or modified sequence opt6 from anti-HIV-1_LightChain
  source 1..324: mol_type = other RNA
gaagtagtactaacacaatcaccaggaacactatcactatcaccaggagaaagagcaacactatcatgcagagcatcacaaacaataaactcaaacttcttcgcatggtaccaccaaaaaccaggacaagcaccaagactactaatatacggagcatcatcaagagcaacaggaataccagacagaatatcaggatcaggatcaggaacagacttcacactaacaataacaggactagaaccagaagacttcggactatactactgccaacaattcgacttctcaccaagaacattcggacaaggaacaagagtagaaataaaa

SEQ ID NO: 47192 - RNA, 324 nt, synthetic construct
  misc_feature 1..324: note = derived and/or modified sequence opt6 from anti-HIV-1_LightChain
  source 1..324: mol_type = other RNA
gaaatagtactaacacaatcaccaggaacactatcactagcaccaggagaaagagcaacactatcatgcagagcatcacaatcaatatcaacaacatacctagcatggtaccaacaaaaaccaggacaagcaccaagattactaatatacgaaacatcatcaagagcatcagacataccagacagattctcaggatcaggatcaggaacagacttcacactaacaatatcaagactagaaccagaagacttcgcagtatattactgccaccaatacgacagatcaccaagaacattcggacaaggaacaaaagtagaaataaaa

SEQ ID NO: 47193 - RNA, 336 nt, synthetic construct
  misc_feature 1..336: note = derived and/or modified sequence opt6 from anti-HIV-1_LightChain
  source 1..336: mol_type = other RNA
gatatagtaatgacacaatcaccagcaagtttaagcgtaacaccaggagaaacagcaagcataagctgtaaatgtagcagaagcctaagagaagaagtaggatataactatctagattggtatctacaaagaccaggaaaaagcccacaattactaatatacgtaggatcattcagagcaccaggagtaagcgaaagatttagaggaagcggagaacataaagatttcacactaaaaatagcaagagtagaaccaggagatgcaggaatatattactgtatgcaaggaatagacacaccaagaacatttggacaaggaacaacattagaaataaac

SEQ ID NO: 47194 - RNA, 321 nt, synthetic construct
  misc_feature 1..321: note = derived and/or modified sequence opt6 from anti-HIV-1_LightChain
  source 1..321: mol_type = other RNA
gacatacaaatgacacaatcaccatcatcactatcagcatcagtcggagacagagtaacaataacatgcagagcatcacaagcattcagaaacgacctaggatggtaccaacacaaaccaggaaaagcaccagaaagactaatatacgcaacatcaacactagaatcaggagtaccatcaagattctcaggatcaggatcaggaacaaacttcacactaacaatatcatcactacaagcagaagacttcgcaacatactactgcctacaatacaacacattcccaagaacattcggacaaggaacaaaagtagaaataaaa

SEQ ID NO: 47195 - RNA, 333 nt, synthetic construct
  misc_feature 1..333: note = derived and/or modified sequence opt6 from anti-HIV-1_LightChain
  source 1..333: mol_type = other RNA
aactttatgttaacacaaccacattcagtatcagaatcaccaggaaaaacagtaacaatatcatgcgcaagaacaagaggaggaatagactcagcatacgtacactggtaccaacaaagaccaggatcagtaccaacaacagtaatattcgaagacaacagaagaccaccaggagtaccagacagattctcaggatcaatagacacatcatcaaacacagcatcattaacaatatcaggactaaaaacagaagacgaagcagactactactgccaatcatatgacgacacatacttctgggtattcggaggaggaacaaaattaacagtacta

SEQ ID NO: 47196 - RNA, 333 nt, synthetic construct
  misc_feature 1..333: note = derived and/or modified sequence opt6 from anti-HIV-1_LightChain
  source 1..333: mol_type = other RNA
aacttcatgctaacacaaccacactcagtatcagaatcaccaggaaaaacagtaacaatatcatgcgcaagaacaagaggaacaatagactcagcatacgtacactggtaccaacaaagaccaggagcagtaccaacaacagtaatattcgaagacgacagaagaccatcaggagtaccagacagattctcaggatcaatagacagctcatcaaactcagcatcactaacaatatcaggactaaaaacagaagacgaagcagactactactgccaatcatacgactcaaactactactgggtattcggaggaggaacaaaactaacagtacta

SEQ ID NO: 47197 - RNA, 396 nt, synthetic construct
  misc_feature 1..396: note = derived and/or modified sequence opt6 from anti-HIV-1_HeavyChain
  source 1..396: mol_type = other RNA
caagtacaactacaacaatcaggaccagcattagtaaaaccatcagaaacactatcactaacatgttcagtaagctcaggaagagtatcatcatattactggtcatggataagacaatcaccaggaaaaggactagaatggataggatatatacattacgatccagatacaaatacaaattacagaacacattaccatccatcactaagaggaagagtagtaatatcagtagattcatcaaaatctcaagtatcattaaaagtaagatcagtaacagcagcagactcagcactatactattgcgcaagacatcgatatgacccatggtcaaaaggatacgatataagatcaccattcgatttctggggacaaggaacattagtaacagtatcatca

SEQ ID NO: 47198 - RNA, 396 nt, synthetic construct
  misc_feature 1..396: note = derived and/or modified sequence opt6 from anti-HIV-1_HeavyChain
  source 1..396: mol_type = other RNA
caagtacacctacaacaatcaggaccaggattagtaaaaccatcagaaacactatcactaacatgtacagtatcaggaggaagagtatcatcatattactggtcatggataagacaatcaccaggaaaaggactagaatggataggatatatacattacgatccagatacatcaacaaattacagaacccattaccatccatcactaagaggaagagtagtaatatcagtagatacaagtaaaaatcaagtatcattaacagtaagatcagtaacagcagcagactcagcattatactattgcgcaagacatagatatgacgtatggtcaaacggatacgatataagatcaccatacgatttctggggaagaggaacattagtaacagtatcatca

SEQ ID NO: 47199 - RNA, 396 nt, synthetic construct
  misc_feature 1..396: note = derived and/or modified sequence opt6 from anti-HIV-1_HeavyChain
  source 1..396: mol_type = other RNA
caagtacacctagaacaaagtggaccagcattagtaaaaccaagcgaaacactaagtttaacatgtacagtaagcggaggaagagtatcaagttattactggagctggataagacaatctccaggaaaaggactagaatggataggatatatacattacgatccagatacatcaacaaattacagaacacattaccatccatcactaagaggaagagtagtaatatcagtagatagcagcaaaaatcaagtatcattaaaagtaagatcagtaacagcagcagactcagcattatactattgcgcaagacatagatatgacgtatggtcaaaaggatacgatataagatcaccattcgatttctggggaagaggaacattagtaacagtaagctca

SEQ ID NO: 47200 - RNA, 390 nt, synthetic construct
  misc_feature 1..390: note = derived and/or modified sequence opt6 from anti-HIV-1_HeavyChain
  source 1..390: mol_type = other RNA
caagtagtatttcaaaaaccaggaccaggagtagtaaaaccaagcgaaacattaagcctaacatgtacagtaagcggaggaagagtaagaagctattactggagctggataagactaccaccaggacaaggactagaatggataggatatatacattacgatgaaacaacagaatacaaaagatcatacaatccatcactaaaaagcagaataacaatatcaatggatacaagtaaaaatcaagtatcattaaaattaagctcagtaacagcagcagacgcagcagtatactattgcgcaagacatagatatgacagatggtcagactcatacgatataagaagcccattcgatatatggggacaaggaacagtagtaacagtaagcgca

SEQ ID NO: 47201 - RNA, 396 nt, synthetic construct
  misc_feature 1..396: note = derived and/or modified sequence opt6 from anti-HIV-1_HeavyChain
  source 1..396: mol_type = other RNA
caagtacaactacaacaatggggagcaggactactaaaaccatcagaaacactatcactaacatgcgcaatatacggatcatcattctcaggacactactggatgtggataagacaatcaccagcaaaaacactagaatggatagcagaaataaaccacacaggaggaacaagatataacccatcattagcatcaagagtaagagtattctcagacacaagcaaaaaccaattctcactaaacatgacatcattaacagcagcagacacaggaatatattactgcgtaagaggacacctatcaagagacagattaggacaatacgcattctggtcaggagcattaatagattacttagacccatggggacaaggaacattagtaacagtatcatca

SEQ ID NO: 47202 - RNA, 387 nt, synthetic construct
  misc_feature 1..387: note = derived and/or modified sequence opt6 from anti-HIV-1_HeavyChain
  source 1..387: mol_type = other RNA
caagtacaattacatcaatggggagcaggattattaaaaccaagtgaaacattaagtttaacatgtgcagtatatggaagttttacaggatttcaatggacatgggtaagacaaacaccaggaaaaggattagaatggataggagaaataaatcatagtggattattagtaacaggaaaaacagattataatccaagtttagaaagtagagtaacaataagtgtagatacaagtaaaaatcaatttagtttaaaattaacaagtgtaacagcagcagatacaggagtatattattgtgcaagagcaggaggaatgagtgattgggcatatccatattattatggaatggatgtatggggacaaggaacaatggtaacagtaagtagt

SEQ ID NO: 47203 - RNA, 357 nt, synthetic construct
  misc_feature 1..357: note = derived and/or modified sequence opt6 from anti-HIV-1_HeavyChain
  source 1..357: mol_type = other RNA
caagtacaattagtagaaagtggaggaggagtggtacaaccaggaagaagtttaacattaagttgtgcaacaagtggatttgattttagtagttatggatttcattgggtaagacaagcaccaggaaaaggattacaatgggtaagtataataagtcatgatggaagtataaaaaattatggagatagtatgaaaggaagatttagtgtaagtagagataatgcaaaagatatattatatttacaaatgaatagtttaagaccagatgatacagcattatatcattgtgtaagaggagatggagaaaatggaggaacagattattggggattaggaacattagtaacagtaagtgca

SEQ ID NO: 47204 - RNA, 357 nt, synthetic construct
  misc_feature 1..357: note = derived and/or modified sequence opt6 from anti-HIV-1_HeavyChain
  source 1..357: mol_type = other RNA
caagtagatttagtagaaagtggaggaggagtagtacaaccaggaaaaagtttaaaattaagttgtacagcaagtggatttacatttacaagttatggaatgcattgggtaagacaaataccaggaaaaggattagaatgggtagcaataataagtcatgatggaacaataaaaaattatggagatagtgtaaaaggaagatttacaataagtagagataatgcaatgaatatattatatttacaaatgaataatttaagaggagatgatacagcattatattattgtgtaagaggagatggagaaaatggaggaacagattattggggacaaggaacagtagtaacagtaagtagt

SEQ ID NO: 47205 - RNA, 369 nt, synthetic construct
  misc_feature 1..369: note = derived and/or modified sequence opt6 from anti-HIV_V3_HeavyChain
  source 1..369: mol_type = other RNA
gaagtacaattagtgcaatcaggagcagaagtaaaaaaaccaggagaatcactaaaaatatcatgccaaggatttggatatacatttagcacatactggataggatgggtaagacaaatgccaggaaaaggattagaatggctaggaataatatacccagaagatagcgaaacaatatactcaccatcattccaaggacaagcaacaatatcagcagataaatcattaagtacagcatacttacaatggagcggactaagagcatcagactcagcaatatactattgcgcaagattaggatattgcggaagcacaagctgtagttttttcgatttctggggaagaggaacactagtaacagtaagttca

SEQ ID NO: 47206 - RNA, 369 nt, synthetic construct
  misc_feature 1..369: note = derived and/or modified sequence opt6 from anti-HIV_V3_HeavyChain
  source 1..369: mol_type = other RNA
gaagtacaattagtacaaagtggagcagaagtaacaaaaccaggagaaagtttaaaaataagttgtaaaggaagtggatatagttttagtacacattggatagcatgggtaagacaaatgccaggaagaggattagaatggatgggatttatatatccagatgatagtgatacaagatatagcccaagtttacaaggacatgtaataataagtgcagataaaagtttaagtacagcatatttacaatggagtagtttaaaagcaagtgatacagcaatgtattattgtgcaagattaggaggagatgaatatcaaagtagtggaggaatggatgtatggggacaaggaacaacagtaatagtaagtagt

SEQ ID NO: 47207 - RNA, 393 nt, synthetic construct
  misc_feature 1..393: note = derived and/or modified sequence opt6 from anti-HIV_V3_HeavyChain
  source 1..393: mol_type = other RNA
gaagtccaattagtacaaagtggagcagaagtaaaaaaaccaggagcaacagtaaaaatatcatgcaaagtatcaggatacacactaacagactactacatacactgggtacaacaagcaccaggaagaggactagaatggctaggactagtagacccagaaaacggagaaacactatacgcagaaaaattccaaggaagagtaacactaacagcagacacatcaacagacacagcatacatggaactaaaatcactaagatacgaagacacagcagtatactactgcgcaacagaaggaccaccatcatactacgactcaggaacatacgcaaaatcactaccagcatcattcgcatgttggggacaaggaacactagtaacagtatcatca

SEQ ID NO: 47208 - RNA, 369 nt, synthetic construct
  misc_feature 1..369: note = derived and/or modified sequence opt6 from anti-HIV_V3_HeavyChain
  source 1..369: mol_type = other RNA
caagtacaactacaagaatcaggaccaggacttgtaaaaccatcagaaacactatcactaacatgcacagtatcaggaggatcaataaacaactactactggtcatggataagacaaccaccaggaaaaggactagaatacataggatacatattctactcaggatcaacaaactacaacccatcactaaaatcaagagtaacattctcagtagacacatccaaaaaccaattctcactaaaactaacatcagtaacagcaacagacacagcagtatactactgcgcaagaggaccactactatacttcggagcaccaagaacacacttcgactactggggacaaggagcattagtaacagtatcatca

SEQ ID NO: 47209 - RNA, 372 nt, synthetic construct
  misc_feature 1..372: note = derived and/or modified sequence opt6 from anti-HIV_V3_HeavyChain
  source 1..372: mol_type = other RNA
gaagtacaactagtacaatcaggagcagaagtaaaaaaaccaggagaatcactaaaaatatcatgcaaaggatcaggatatagctttagctcacactggataggatgggtaagacaactaccaggaaaaggattagaatggatgggaataatatacccagacgatagtgatacaaaatacaatccatcattccaaggacaagtaacaatatcagcagatagatcaatatcaacagcatacttacaatggagctcactaaaagcatcagacacagcaatgtactattgcgcaagagtaggatatgactcatacggatactcaggatcaaactttgacgaatggggacaaggaacattagtaacagtatcaagc

SEQ ID NO: 47210 - RNA, 357 nt, synthetic construct
  misc_feature 1..357: note = derived and/or modified sequence opt6 from anti-HIV_V3_HeavyChain
  source 1..357: mol_type = other RNA
gaagtacaattagtacaaagtggagcagaagtaaaaaaaccaggagaaagtttaaaaataagttgtaaaggaagtggatataattttaatagtgattggataggatgggtaagacaaatgccaggaaaaggattagaatgggtaggaatgatatatccagatgattttgaagtaagacatagtccaccatttcaaggaagagtaacaatgagtgtagataaaagcataagtacagcatatttacaatggagtagtttaaaaagtagtgatacaggaatgtatttttgtgcaagattagatggaaatgcagcagcatttgattattggggacaaggaacacaagtaacagtaagtagt

SEQ ID NO: 47211 - RNA, 360 nt, synthetic construct
  misc_feature 1..360: note = derived and/or modified sequence opt6 from anti-HIV_V3_HeavyChain
  source 1..360: mol_type = other RNA
gatgtacaattagtacaaagcggagcagaagtaaaaaaagcaggagaaagtttaaaaataagttgtagaccaagtggatataattttgcagattattggataggatgggtaagacaaatgccaggaaaaggattagaatggatgggaataatatttccagatgattcagatacaagatatggaccaagttttgaaggacaagtaacaataagtgcagataaaagtataaatacagcatatctacaatggaatagtttaaaagcaagtgatacagcaatgtatttttgtgcaagacatggaggaagtggagcagcaccaggagattattggggacaaggaacattagtaacagtaagtagt

SEQ ID NO: 47212 - RNA, 363 nt, synthetic construct
  misc_feature 1..363: note = derived and/or modified sequence opt6 from anti-HIV_V3_HeavyChain
  source 1..363: mol_type = other RNA
gaagtacaattagtacaaagtggagcagaagtaaaaaaaccaggagcaacagtaaaaataagttgtaaagtaagtggatatacatttacagattattttatgcattgggtacaagaagcaccaggaaaaggattagcatggatgggattagtagatccagaaaatggagatacagtatatgcagaaaaattacaaggaagagtaacaatgagtgcagatacaagtagagatacagcatatatggaattaacaagtttaagaagtgaagatacagcagtatattattgtgcaataggaaaaagtgtagcaggaacaagtgcatatgatatatggggacaaggaacaatggtaacagtaagtagc

SEQ ID NO: 47213 - RNA, 369 nt, synthetic construct
  misc_feature 1..369: note = derived and/or modified sequence opt6 from anti-HIV_V3_HeavyChain
  source 1..369: mol_type = other RNA
caagtacaattagtacaaagtggagcagaagtaagaaaaccaggagcaagtgtaaaagtaagttgtaaagcaagtggagatacatttaataatcatgatataaattgggtaagacaagcaccaggacaaggaccagaatgggtaggatggatgaatccaaaaagtggaaatgcaggatatgcacaaaaatttcaaggaagagtaacaatgacaagagatacaagtataagtacagcatatatggaattaagaagtttaacaagtgaagatacaggagtatattattgtgcaagattaacagtagattgtgatgatggaggatgttatggagattattggggacaaggaacattagtaacagtaagtagt

SEQ ID NO: 47214 - RNA, 354 nt, synthetic construct
  misc_feature 1..354: note = derived and/or modified sequence opt6 from anti-HIV_V3_HeavyChain
  source 1..354: mol_type = other RNA
gaagtatatttacaacaaagtggagcagaattaaaagaaccaggagcaaatgtaaaaataagttgtaaagcatttggatttatatttacagattattttatacattggctaagacaagcaccaggaaaaggaccacaatgggtaggagtagtagatccagaagacggaagtacaacatatgcagaagcatttcaaggaagagtaagtataacagcagacagaagtacagatacagcatatatggatttagcaggattaacatcagatgatacagcagtatattattgtgcattaatgtggaatgaaagtggaccagataattggggacaaggaacattagtaatagtaagttca

SEQ ID NO: 47215 - RNA, 393 nt, synthetic construct
  misc_feature 1..393: note = derived and/or modified sequence opt6 from anti-HIV_V3_HeavyChain
  source 1..393: mol_type = other RNA
gaagtgcaagtagtagaatttggaggagaagtaaaaaaaccaggagcaagtgtaaaagtaagctgtgaagcaagtggatatacatttgcaaaatttgcaatacattgggtaagacaagcaccaagacaaggactagaatggatgggatggataaatggagatgatggaaaaacagaatatagtcaaaaatttcaagatagagtaacaatgacaagagatacaagtgcaagtacagtatatatggaactatcaagtttaagatcagaagatacagcattatattattgtgcaagagcaatgtatccagatacagtaacaggaaatgataatccagcaccaccaccatttgaaggagattattggggacaaggaacattagtaacagtatcaagt

SEQ ID NO: 47216 - RNA, 393 nt, synthetic construct
  misc_feature 1..393: note = derived and/or modified sequence opt6 from anti-HIV_V3_HeavyChain
  source 1..393: mol_type = other RNA
gaagtacaattagtagaaagtggaggaggattagtaaaaccaggaggaagtctaagattaacatgtgtagcaagtggatttacatttagtgatgtatggttaaattgggtaaggcaagcaccaggaaaaggattagaatgggtaggaagaataaaaagtagaacagatggaggaacaacagattatgcagcaagtgtaaaaggaagattcacaataagtagagatgatagtaaaaatacattatatttacaaatgaatagtttaaaaacagaagatacagcagtatatagttgtacaacagatggatttataatgataagaggagtaagtgaagattattattattattatatggatgtatggggaaaaggaacaacagtaacagtaagtagt

SEQ ID NO: 47217 - RNA, 387 nt, synthetic construct
  misc_feature 1..387: note = derived and/or modified sequence opt6 from anti-HIV_CD4bs_HeavyChain
  source 1..387: mol_type = other RNA
gaagaacaattagtagaaagtggaggaggattagtaaaaccaggaggaagtcaaagactaagttgtgcagcaagtgaatttacatttagtagatatacaatgaattgggtaagacaagcaccaggaaaaggattagaatgggtaagtagtataagtggaaatgataataatatatattatgcagatagtgtaaaaggaagatttacaataagtagagataatgcaagaaatagtttatatttacaaataaatagtttaagagtagaagatacagcagtatattattgtgcaagaggaccattagatagttatgatttttggtcaggaagtagacattattatggattagatgtatggggacaaggaacaacagtaacagtaagtagt

SEQ ID NO: 47218 - RNA, 372 nt, synthetic construct
  misc_feature 1..372: note = derived and/or modified sequence opt6 from anti-HIV_CD4bs_HeavyChain
  source 1..372: mol_type = other RNA
caagtacaattagtacaaagcggaagcgaattaaaaaaaccaggagcaagcgtaaaagtaagctgtaaagcaagcggatacacattcacaagccatataataaactgggtaagacaagcaccaggacaaggactagaatggatgggatggataaatacaaatacaggaaacccaacatatgcacaaggatttacaggaagatttgtatttagtttagacacaagcgtaagcatggcatatctacaaatatcaagcttaaaagcagaagatacaggagtatattactgtgcaagaggatttagacaatggttagtagcaagaataacatatttcgattactggggacaaggaacactagtaacagtaagctca

SEQ ID NO: 47219 - RNA, 369 nt, synthetic construct
  misc_feature 1..369: note = derived and/or modified sequence opt6 from anti-HIV_CD4bs_HeavyChain
  source 1..369: mol_type = other RNA
gaattaagattacaagcaagtggaccaggattagtaaaaccaagtgaaacattaagtttagtatgtagtgtaagtggagtatcaatatcagatagttattggaattggataagacaaccagcaggaaaaggattagaatggataggaagagtatatacaagaggaacacatacatataatccaagtttaggaggaagagcaacagtaagcggagatacaaataaaaatgaagtaagtttaaaattaatgagtgtaacagcagcagatacagcagtatattattgtgcaagagcattatcaggagattggacaagaagatatttttatatggatgtatggggaagaggaacaccagtaacagtaagcagt

SEQ ID NO: 47220 - RNA, 381 nt, synthetic construct
  misc_feature 1..381: note = derived and/or modified sequence opt6 from anti-HIV_CD4bs_HeavyChain
  source 1..381: mol_type = other RNA
caactacaactacaagaatcaggaccaagactagtaaaaccatcagaaacactatcactaacatgcacagtatcaggaggatcaatatcatcaggagactactactggacatggataagacaaccaccaggagaaggactagaatacataggatacatatactcaggaggatcaacagactacaacccatcactaaaatcaagagcatcaatatcacaagacacatcaacaaacgaattctcactaaaattaacatcagtaaccgcagcagacacagcagtatacttctgcgcaagagacagaagagtactactatggttcggagaaccaagaagaggactagacttctggggaccaggaacactagtaacagtatcatca

SEQ ID NO: 47221 - RNA, 396 nt, synthetic construct
  misc_feature 1..396: note = derived and/or modified sequence opt6 from anti-HIV_CD4bs_HeavyChain
  source 1..396: mol_type = other RNA
gaagtacaattagtagaaagcggaggaggattagtaaaaccaggaggaagcctaagattaagctgtgcagcaagcggattcacattctcaagcgcatggatgagctgggtaagacaagcaccaggaaaaggactagaatgggtaggaagaataaaaagcaaaagcgatggagaaacaacagactatgcagcaccagtaaaaggaagatttacaataagcagagacaatctagaaagcacactatatctacaactaaatagcttaaaaacagaagatacagcagtatattactgtgcaacagcaacaccatcatactatgacataatgacgggaaattacaaatactattactatatggatgtatggggaaaaggaacaacagtaacagtaagttca

SEQ ID NO: 47222 - RNA, 363 nt, synthetic construct
  misc_feature 1..363: note = derived and/or modified sequence opt6 from anti-HIV_CD4bs_HeavyChain
  source 1..363: mol_type = other RNA
caagtacaactagtagaaagcgggggaggactagtaaaaccaggaggaagtttaagattaagctgtgcagcaagcggattcatattcagagaccattacatgacatggataagacaagcaccaggaaaaggactagaatgggtaagttatatatcaagctcaagcaataacatacaatatgcagatagcgtaaaaggaagatttacagtaagtagagacaatgcaaaaaactcactatatctacaaatgaatagcttaagagcagacgatacagcagtatattactgtgcaagaagcggaccattttacaattacggaccaccaaacaattggggacaaggaacattagtaacagtatcaagc

SEQ ID NO: 47223 - RNA, 378 nt, synthetic construct
  misc_feature 1..378: note = derived and/or modified sequence opt6 from anti-HIV_CD4bs_HeavyChain
  source 1..378: mol_type = other RNA
caagtacaattagtagaaagcggaggaggagtagtacaaccaggaggaagtctaacattaagctgtacagcaagtggattcccattcaatagctatgcaatgcactgggtaagacaagcaccaggaaaaggattagaatgggtaagcatgacatcacacgatggaggaaataaagactttgtagatagtgtgaaaggaagatttacaataagtagagataatagcagaaacacactatttctacaaatgaatagtttaagtcaagacgatacaggagtatattactgtgtaagaggaaaattagaagattataatttttggggacattatagagattttgatagttggggacaaggaacattggtaacagtaagtgca

SEQ ID NO: 47224 - RNA, 405 nt, synthetic construct
  misc_feature 1..405: note = derived and/or modified sequence opt6 from anti-HIV_CD4bs_HeavyChain
  source 1..405: mol_type = other RNA
gaaccacatgtagtagaaagtggaggaggaatggcaaaaccaggaggaagtttaagattaagctgtgcaggaagtggatttacatttacaaatgcatggatgaattgggtaagacaagcaccaggaaaaggattagaatgggtaggattaataaaaagtaaaagcgatggaggaacaacagattatgcagcagatgtagaaggaagatttacaataagtagagatgatttagaaagtacaatgtttttagaaatgcatagtttacaaatagaagatacagcagtatatttttgtacaacacaatatccaagatattatgatttaatgacaggaaattataaaagaagatattttagtagtggaatggatgtatggggacaaggaacagcagtaacagtaagtagt

SEQ ID NO: 47225 - RNA, 384 nt, synthetic construct
  misc_feature 1..384: note = derived and/or modified sequence opt6 from anti-HIV_CD4bs_HeavyChain
  source 1..384: mol_type = other RNA
caagtacaactacaagaatcaggaccaggactagtaaaaccatcacaaacactatcactaacatgcacagtatcaggagactcagtatcatcaggaaactactactggtcatggataagacaaccagcaggaaaaccactagaatggataggacacatatcaacaggaggaggaacaaaaaacaacccaagcctacaatcaagagtaacaatatcattagactcatcaaaaaaccaagtatcactatcactatcatcagtaacagcagcagacacagcagtatacacatgcgcaagaggaccaccaagatcactatggttcggagacccaacatactcatacatggacgtatggggaaaaggaacaacagtaacagtatcatca

SEQ ID NO: 47226 - RNA, 372 nt, synthetic construct
  misc_feature 1..372: note = derived and/or modified sequence opt6 from anti-HIV_CD4bs_HeavyChain
  source 1..372: mol_type = other RNA
caagtacaattagtacaaagcggagcagaagtaaaaaaaccaggatcaagcgtaaaagtaagctgtaaagcaagcggaggaacattcaatagccatgcatttacatgggtaagacaagcaccaggacaaggactagaatggatgggaggaataataccaacactaggactagcaaacgatgcacaaaaatttcaaggaagatttacaataacagcagacgaaagcacaacaacagtatatatggaattaagtagcttaagatcagaagatacagcagtatattactgtgcaagaagaccatactatgaccaagtatcaggagtaggagcattcgatatatggggacaaggaacaagagtaacagtaagctca

SEQ ID NO: 47227 - RNA, 390 nt, synthetic construct
  misc_feature 1..390: note = derived and/or modified sequence opt6 from anti-HIV_V2_HeavyChain
  source 1..390: mol_type = other RNA
caagtacaactagtacaatcaggagcagaagtaaaaaaaccaggaagctcagtaaaagtatcatgcgaagcatcaggagtaacatcaagctcatacacaatatcatgggtaagactagcaccaggacaaggactagaatggatgggaagaataacaccaatattcgacataacaaattacgcacaaaaattccaaggaagagtaacattaacagcagacaaatcaacaggaacaacatacatggaattaagctcactaagaagcgacgacacagcagtatactactgcgcaagagacaaatcagacgtagtagtagtaacaagcataagaccagcatattactacggaatggacgtatggggacaaggaacaacagtaacagtatcaagc

SEQ ID NO: 47228 - RNA, 366 nt, synthetic construct
  misc_feature 1..366: note = derived and/or modified sequence opt6 from anti-HIV_V2_HeavyChain
  source 1..366: mol_type = other RNA
caagtacaattagtacaaagtggagcagaagtaaaaaaaccaggaagtagtgtaaaagtaagttgtaaagcaagcggaggaacatttagaagttatgcaataagttgggtaagacaagcaccaggacaaggattagaatggatgggaggaataataccaatatttggaacagcagattatgcacaaaaatttcaaggaaaagtaacaataacagcagatgaaagtacaagtacagcatatatggaattaagtagtttaacaagtgaagatacagcaatgtattattgtgcaagaagtagagatcatttttttgatacaagagtatttcaaggatggggacaaggaacattagtaacagtaagttca

SEQ ID NO: 47229 - RNA, 363 nt, synthetic construct
  misc_feature 1..363: note = derived and/or modified sequence opt6 from anti-HIV_V2_HeavyChain
  source 1..363: mol_type = other RNA
caagtacaattagtacaatcaggagcagaagtaaaaaaaccaggaagctcagtaaaagtatcatgcaaagcatcaggaggaaactttaacacatacacaatatcatgggtaagacaagcaccaggacaaggattagaatggatgggaagaataataccaatattcggaatagtaaatccagcacaaaaattcccaggaagagtaacaataaatgtagataaatcaacaaatacagcatacatggaattaagttcactaagaagcgaagacacagcagtatactattgcgcaacatcaggagtaggattacactttggatatttcgattactggggacaaggaacacaagtaacagtaagcagc

SEQ ID NO: 47230 - RNA, 378 nt, synthetic construct
  misc_feature 1..378: note = derived and/or modified sequence opt6 from anti-HIV_V2_HeavyChain
  source 1..378: mol_type = other RNA
caagtacaattacaacaatggggaccaggactattaaaaccaagcgaaacattaagcctaacatgtgcagtatacggaggatcattcggaagatattactggagctggataagacaatcatcaggagaaggattagaatggctaggacaaatagatcacacaggatcaacaacatacaatccatcactaaaaggaagagtaacaatatcaatagatagctcaacaaatcaatttagtttaaaagtaacatcagtaatagcagcagacacagcagtatactattgcgcaagagcaccatcaggatatccaggagtatcactatatcaatattacggactagatgtatggggacaaggaacaacagtaacagtaagccca

SEQ ID NO: 47231 - RNA, 366 nt, synthetic construct
  misc_feature 1..366: note = derived and/or modified sequence opt6 from anti-HIV_V2_HeavyChain
  source 1..366: mol_type = other RNA
caagtacaattagtacaaagcggagcagaagtaaaaaaaccaggatcaagtgtaaaagtaagctgtaaagcaagcggaggaacattctcaaattatgcaataagctgggtaagacaagcaccaggacaaggactagaatggatgggaggaataataccaatattcggaacaacagactatgcacaaaaatttcaaggaagagtaacaataacagcagatgcaagcacaagtacagcatatatggaattatcaagtttaagatcagacgatacagcagtatattactgtgcaagaagtagaggacattattttgacacaagagtattcgaaggatggggacaaggaacattagtaacagtaagttca

SEQ ID NO: 47232 - RNA, 372 nt, synthetic construct
  misc_feature 1..372: note = derived and/or modified sequence opt6 from anti-HIV_V2_HeavyChain
  source 1..372: mol_type = other RNA
caagtacacttagtacaaagcggaacagaagtaaaaaaaccaggagcaagtgtaacagtaagctgtaaagcaagcggatactcattcacaggatattacttacactgggtaagacaagcaccaggacaaggactagaatggatgggatggataaatccaaatagcggaggaacatactatgcacaaaactttcaagcaagagtaacaatgacaagagacacaagcataagcacagtatatatggatctatcaagattaagatcagacgatacagcagtctattactgtgtaagaagagcagtattaacagcactaccaccaagatactatttcgatttctggggacaaggaacactagtaacagtaagctca

SEQ ID NO: 47233 - RNA, 318 nt, synthetic construct
  misc_feature 1..318: note = derived and/or modified sequence opt6 from anti-HIV_V3_LightChain
  source 1..318: mol_type = other RNA
tcactagaactaacacaaccaccatcagtatcagtatcaccaggacaaacagtatcaataacatgctcaggaaacctactaggagacaaagacgcatcatggtaccaactaaaaccaggacaatcaccaatactagtaatatacctagacacagaaagaccatcaggaataccagaaagattcagcggatcaaaatcaggaaacacagcaacactaacaatatcaggaacacaagcaatggacgaagcagaatacttctgccaagcatgggacacaacaacagtactattcggaggaggaacaagactaacagtacta

SEQ ID NO: 47234 - RNA, 324 nt, synthetic construct
  misc_feature 1..324: note = derived and/or modified sequence opt6 from anti-HIV_V3_LightChain
  source 1..324: mol_type = other RNA
agcgatgaattaacacaaccaccaagtgtaagcgtaagcccaggacaaacagcaagaataacatgtagcggagacgcactaccagaaaaatacgcatactggtaccaacaaaaatcaggacaagcaccagtattagtaatagatgaagataacaaaagaccattcggaacaccagaaagattcagcggatcaagatcaggaacaatggcaacactaacaataacaggagcacaaatggaagacgaagcagattactattgctcaagtacagactcaagaggaacatattgggtattcggaggaggaacaaaactaacagtatta

SEQ ID NO: 47235 - RNA, 336 nt, synthetic construct
  misc_feature 1..336: note = derived and/or modified sequence opt6 from anti-HIV_V3_LightChain
  source 1..336: mol_type = other RNA
caatcagtactaacacaaccaccatcagtatcagcagcaccaggacaaaaagtaacaatatcatgctcagccggaaactcaaaaataggagacaactacatatcatggtaccaacacgtaccaggagcagcaccaaaactactaatatacgaaaacgacaaaagaccatcaggaataccagacagattctcaggatcaaaatcaggaacatcagcatcactaggaataacaggactacaaacaggagacgaagcagactactactgcgcagcatgggacaactcactatcatcagcactatacgtattcggaacaggaacaaaagtaacagtacta

SEQ ID NO: 47236 - RNA, 339 nt, synthetic construct
  misc_feature 1..339: note = derived and/or modified sequence opt6 from anti-HIV_V3_LightChain
  source 1..339: mol_type = other RNA
gacatagtaatgacacaatcaccagactcactagcagtatcactaggagaaagagcaacaataaactgcaaatcatcacaaaacgtattctactcatcaaacaacagaaactacctagcatggtaccaacaaagaccaggacaaccaccaaaactactattctactgggcatcaacaagagaatcaggagtaccagacagattctcaggatcaggatcaggaacagacttcacactaacaatatcatcattacaaacagaagacgtagcaatatactactgccaacaatactacaacacaccaccaacattcggaccaggaacaaaagtagaaataaaa

SEQ ID NO: 47237 - RNA, 318 nt, synthetic construct
  misc_feature 1..318: note = derived and/or modified sequence opt6 from anti-HIV_V3_LightChain
  source 1..318: mol_type = other RNA
tcatacgaactaacacaaccaccatcagtatcagtatcaccaggacaaacagcaacaataacatgctcaggagacctactaggagacaaatacgcatcatggtacagacaaaaaccaggacaatcaccagtattagtaatatacgaagacacaaaaagaccatcaggactaccagaaagattctcaggatcaaactcaggaaacacagcaacactaacaatatcagaaacacaagcaatggacgaagcagactactactgccaagcatgggacacaagaacagtagtattcggaggaggaacaaaactaacagtacta

SEQ ID NO: 47238 - RNA, 327 nt, synthetic construct
  misc_feature 1..327: note = derived and/or modified sequence opt6 from anti-HIV_V3_LightChain
  source 1..327: mol_type = other RNA
caatcagtactaacacaaccaccaagcgtaagcgcagcaccaggacaaaaagtaacaataagctgtagcggaagatcaagcgatatagaaaacaaattcgtaagctggtaccaacaattaccaggaacagcaccaaaactattaatatatgaagataacaaaagaccaagcggaataccagacagattctcaggatcaaaatcaggaacaagcgcaacattaggaataacaggactacaaacaggagacgaagcagattactattgcggaacatgggacaataacttaagagcaggatttggaggaggaacacacttaacagtacta

SEQ ID NO: 47239 - RNA, 324 nt, synthetic construct
  misc_feature 1..324: note = derived and/or modified sequence opt6 from anti-HIV_V3_LightChain
  source 1..324: mol_type = other RNA
tcatacgaactaacacaaccaccatcagtatcagtatcaccaggacaaacagcaagaataacatgctcaggagacgcactaccaaacaaatacgcattctggtaccaacaaaaatcaggacaagcaccagtactagtaatattcgacgacaacagaagaccagcaggaataccagaaagattctcaggatcaagaagcggaacactagcaacactaacaatatcaggagcacaagtagaagacgaagcagactactactgctactcaacagacaacgacggaaaatacttcgtattcggaagcggaacaatggtaacagtacta

SEQ ID NO: 47240 - RNA, 318 nt, synthetic construct
  misc_feature 1..318: note = derived and/or modified sequence opt6 from anti-HIV_V3_LightChain
  source 1..318: mol_type = other RNA
tcatacgaactaacacaaccaccatcagtatcagtatcaccaggacaaacagcatcaataacatgctcaggacacaaactaggagacaaatacgcatcatggtaccaacacaaaccaggacaatcaccagtattagtaatatacgaagacacacaaagaccatcaggaataccagaaagaatatcaggatcaaaatcaggaaacacagcaacactaacaatatcaggaacacaagcaatggacgaagcagactactactgccaagcatgggactcaagagcagcagtattcggaggaggaacaagactaacagtacta

SEQ ID NO: 47241 - RNA, 327 nt, synthetic construct
  misc_feature 1..327: note = derived and/or modified sequence opt6 from anti-HIV_V3_LightChain
  source 1..327: mol_type = other RNA
caatcagcactaacacaaccagcatcagtatcaggatcaccaggacaatcaataacaatatcatgcacaggaatatcatcagacataggaacagacaactacgtatcatggtaccaacaacacccaggaaaagcaccaaaactaataatatacgaagtatcaaacagaccatcaggaatatcacacagattctcaggatcaaaatcaggaaacacagcatcactaataatatcaggactacaagtagaagacgaagcacactactactgcaactcatacagatcagacacattagtattcggaggaggaacaaaagtaacagtacta

SEQ ID NO: 47242 - RNA, 333 nt, synthetic construct
  misc_feature 1..333: note = derived and/or modified sequence opt6 from anti-HIV_V3_LightChain
  source 1..333: mol_type = other RNA
caatcagtactaacacaaccaccatcagcatcaggaacaccaggacaaagagtaacaatatcctgttcaggatcatcatcaaacataggatcaaatacagtaaactggtaccaacacctaccaggaacagcaccaaaactactaatatactcaaacgaccaaagaccatcaggagtaccagacagattctcaggatcatcatcaggaacatcagcatcattagcaatatcaggattacaatccgaagacgaagcagactactactgcgcagcatgggacgactcattaaacggaccattcgtattcggaacaggaacaaaagtaacagtacta

SEQ ID NO: 47243 - RNA, 318 nt, synthetic construct
  misc_feature 1..318: note = derived and/or modified sequence opt6 from anti-HIV_V3_LightChain
  source 1..318: mol_type = other RNA
gacatacaaatgacacaatcaccatcatcactatcagcatcagtaggagacagaataacaataacatgcagaacatcacaatcaatagacaaccacctaaactggtaccaacacaaaccaggaaaagcaccaaaactactaatatcagcagcatccagactacaatcaggagtaccatcaagattcacaggatcaggatcaggaacagaattcacactaacaatatcatcactacaaccagaagacttcgcagtatactactgccaacaatcatacataacaataacattcggaccaggaacaaaagtagacataaaa

SEQ ID NO: 47244 - RNA, 321 nt, synthetic construct
  misc_feature 1..321: note = derived and/or modified sequence opt6 from anti-HIV_V3_LightChain
  source 1..321: mol_type = other RNA
gaaatagtaatgacacaatcaccagcaacactatcagtatcaccaggagaaggagtaacattatcatgcagagcatcacaatcagtatcatcaaacatactatggtaccaacaaagaccaggacaagcaccaagactactattatacggagcaagcacaagagcaacaggaataccagcaagattctcaggatcaggatcaggaacagaattcacattaacaataaactcaatgcaaagcgaagacttcgcaatatactactgccaacaatatcacgactggctatggacactaggacaaggaacacaagtagaaataaaa

SEQ ID NO: 47245 - RNA, 327 nt, synthetic construct
  misc_feature 1..327: note = derived and/or modified sequence opt6 from anti-HIV_V3_LightChain
  source 1..327: mol_type = other RNA
tcatacgaactaacacaaccaccatcagtatcagtatcaccaggacaaacagcatcaataacatgctcaggagacaaaatgggagaaagatatacatcatggtaccaacaaaaaccaggacaaagcccagtattagtaatgagcgaaaacataaaaagaccagcaggaatacccgaaagattcagcggaagctcaagcggaaacacagcaatactaacaatatcaggaacacaagcagtagacgaagcagactattactgccaagtatgggacacaacaacaacaagctacgtaatattcggaggaggaacaaaactaacagtacta

SEQ ID NO: 47246 - RNA, 321 nt, synthetic construct
  misc_feature 1..321: note = derived and/or modified sequence opt6 from anti-HIV_V3_LightChain
  source 1..321: mol_type = other RNA
gacatacaaatgacacaatcaccatcatcactatcagcatcagtaggagacagagtaacaataacatgccaagcatcacaagacataggaaactacctaaactggtaccaccaaaaaccaggaaaagcaccaaaactactaatatacgacgcatcaaacgtagaaacaggagtagcatcaagattctcaggatcaggatcaggaacagacttcacactaacaatatcatcactacaaccagaagacataggaacatacttctgccaacaatacgaatcactaccatgggcattcggaggaggaacaaaagtagaaataaga

SEQ ID NO: 47247 - RNA, 333 nt, synthetic construct
  misc_feature 1..333: note = derived and/or modified sequence opt6 from anti-HIV_V3_LightChain
  source 1..333: mol_type = other RNA
aacttcaaactaacacaaccacactcagtatcagaatcaccaggaaaaacagtaacaatatcatgcacaagaacatcaggaacaatagcaacaaactacgtacaatggttccaacaaagaccaggatcatcaccaacaaccatgatatacgaaaacgacaaaagaccatcaggagtaccagacagattctcaggatcaatagacacatcatcaaactcagcatcactaacaatatcaggactaaaaaccgaagacgaagcagactactactgccaatcatacaactcaacagacatagtagtattcggaggaggaacaaaactaacagtacta

SEQ ID NO: 47248 - RNA, 327 nt, synthetic construct
  misc_feature 1..327: note = derived and/or modified sequence opt6 from anti-HIV_V3_LightChain
  source 1..327: mol_type = other RNA
caatcagtactaacacaaccaccatcagtatcagcagcaccaggacaaaaagtaacaatatcatgctcaggatcatcatcaaatataggaaacaatatggtatcatggtaccaacaacacccaggaacagcaccaaaactattaatatacgaaaattcaaaaagaccaagcggaataccagacagattctcaggatcaagatcaggaacatcagcaacattaggaataataggactacaaacaggagacgaagcagaatactactgcgcaacatgggacggatcattaagaacagtattcggaggaggaacaaaattaacagtacta

SEQ ID NO: 47249 - RNA, 324 nt, synthetic construct
  misc_feature 1..324: note = derived and/or modified sequence opt6 from anti-HIV_V3_LightChain
  source 1..324: mol_type = other RNA
agttatgaattaacacaaccaccaagcgtaagcgtaagcccaggacaaacagcaagaataacatgtagcggagacgcactaccaaaccaatacggatactggtaccaacaaaaaccaggacaagcaccagtattagtaatatttaaagatagcgaaagaccaagcggaataccagaaagattctcaggatcaagctcaggaacaacagtaacactaacaataagcggagtacaagcagaagacgaagcagattactattgccaaagcgcagactcaagcggaaactatgaagtattcggaggaggaacaaaactaacagtatta

SEQ ID NO: 47250 - RNA, 330 nt, synthetic construct
  misc_feature 1..330: note = derived and/or modified sequence opt6 from anti-HIV_V3_LightChain
  source 1..330: mol_type = other RNA
caatcagtactaacacaaccaccatcagtatcagaagcaccaagacaaagagtaacaatatcatgctcaggatcatcatcaaacataggaaacaacgcagtaaactggtaccaacaagtaccaggaaaagcaccaaaactactaatatactacgacgacctactaccatcaggagtatcagacagattctcaggatcaaaatcaggatcatcagcatcactagcaatatccggactacaatcagaagacgaagcagactactactgcgcagcatgggacgactcactaaaagtatacgtattcggaacaggaacatcagtaacagtacta

SEQ ID NO: 47251 - RNA, 333 nt, synthetic construct
  misc_feature 1..333: note = derived and/or modified sequence opt6 from anti-HIV_V3_LightChain
  source 1..333: mol_type = other RNA
gatatagtaatgaatcaatcaccaccatcattagcagtaacaccaggagaaccagcaagcataagctgtagagcaagccaatcattactatatagcgatggacataactatctagattggtatctacaaaaaccaggacaagcaccacaattactaatatacctaggaagcacaagagcaagcggagtaccagatagatttagcggaagcggaagcggaacagatttcacactaaaaatatcaagagtagaagcagaagatgtaggagtatattactgtatgcaaccattacaatcatacacattcggacaaggaacaaaactagaaataaaa

SEQ ID NO: 47252 - RNA, 321 nt, synthetic construct
  misc_feature 1..321: note = derived and/or modified sequence opt6 from anti-HIV_V3_LightChain
  source 1..321: mol_type = other RNA
gcatatgaattaacacaaccaccatcagtatcagtatcaccaggacaaacagcaagaataacatgtagcggagacgcactaccaaaccaatacgcatactggtaccatcaaagaccaggacaagcaccagtattagtaatacataaagatacagaaagaccaagcggaataccagcaagattctcaggatcaagctcaggaacaacagtaacactaacaataagcgaagtacaagcagaagacgaaggagattactattgccaaagcgcagacacaagcgcatacgtagtatttggaggaggaacaaaattaacagtacta

SEQ ID NO: 47253 - RNA, 330 nt, synthetic construct
  misc_feature 1..330: note = derived and/or modified sequence opt6 from anti-HIV_V3_LightChain
  source 1..330: mol_type = other RNA
caaagcgtactaacacaagcaccatcaagctcaggaacaccaggacaatcagtaacaatatcatgctcaggatcaagctcaaacatggaaataaactatgtatattggtatagacaattcccaggaacagcaccacaattactaatatacaatgacaatcaaagaccatcaggagtaccagatagatttagcgcaagcaaaagcggaacatcagcatcactagcaataggaggattaagatcagaagatgaagcagactatttctgtgcagtatggcatggagatagaggaggaccagtatttggaggaggaacaaaattaacagtacta

SEQ ID NO: 47254 - RNA, 327 nt, synthetic construct
  misc_feature 1..327: note = derived and/or modified sequence opt6 from anti-HIV_V3_LightChain
  source 1..327: mol_type = other RNA
tcatatgaattaaaacaaccaagatcagtatcagtatcaccaggacaaacagcaagaataacatgttcaggagacgcaatgccaaaccaatacgcatactggtaccaacaaagaccaggcagagcaccagtactattaatatttaaagacaacgaaagagcatcaggaataccagaaagaatatcaggatcatcatcaggaacaacagcaacactaacaataaacagagtacaagcagaagacgaagcagattacttatgccaaagcgcagactcatcaggagcatttccatgggtatttggaggaggaacaacattaacagtacta

SEQ ID NO: 47255 - RNA, 324 nt, synthetic construct
  misc_feature 1..324: note = derived and/or modified sequence opt6 from anti-HIV_V3_LightChain
  source 1..324: mol_type = other RNA
agctatgaattaacacaaccaccaagcgtaagcgtaagtccaggacaaacagcaagaataacatgtagtggagacgcactaccaaaagaatacgcatactggtaccaacaaaaaagtggacaagcaccagtactagtaatatatgaagatacaagaagaccaagcggaataccagaaagattctcaggatcaagctcaggaacaatggcaacattaacagtaagcggagcacatgtagatgacgaagcagattactattgctatagcagagacacaagcgcaaaccaatgggtattcggaggaggaacaaaactaacagtatta

SEQ ID NO: 47256 - RNA, 318 nt, synthetic construct
  misc_feature 1..318: note = derived and/or modified sequence opt6 from anti-HIV_V3_LightChain
  source 1..318: mol_type = other RNA
gaaatagtactaacacaatcaccagcaacactatcattatcaccaggagaaagagcaacactatcatgcagagcatcacaatcaatatcaacatacctaggatggtaccaacaaaaaccaggacaagcaccaagactactaatatacgacgcatcaaacagagcaacaggaataccagcaagattctcaggatcaggatcaggaacagacttcacactaacaatatcatcactagaaccagaagacttcgcagtatactactgccaacaaagatacacatggataacattcggacaaggaacaagactagaaataaaa

SEQ ID NO: 47257 - RNA, 327 nt, synthetic construct
  misc_feature 1..327: note = derived and/or modified sequence opt6 from anti-HIV_V3_LightChain
  source 1..327: mol_type = other RNA
tcatatgaattaacacaaccaccatcagtatcagtatcaccaggacaaacagcaagaataacatgctcaggagacgcactaccaaaccaatacgtatactggtaccaacaaagaccaggacaagcaccagtagtagtactatataaagacacagaaagaccatcaggaataccagaaagattctcaggatcatcatcaggaacaacagtaacattaacaatatcaggagtacaagcagaagacgaagcagattactactgccaatcagcagacaattcaggagcatacccattattcttcggaggaggaacaaaattaacagtacta

SEQ ID NO: 47258 - RNA, 333 nt, synthetic construct
  misc_feature 1..333: note = derived and/or modified sequence opt6 from anti-HIV_V3_LightChain
  source 1..333: mol_type = other RNA
caatcagtattaacacaaccaccatcagtatcagcagcaccaggacaaaaagtaacaatatcatgttcaggatcatcatcaaatataggaaacaattacgtactatggtaccaacaatttccaggaacagcaccaaaactattaatatacggaaataacaaaagaccatcaggaataccagacagattctcaggatcaaaatcaggaacatcagcaacattaggaataacaggactacaaacaggagacgaagcagactacttttgcgcaacatgggactcaggattaagcgcagactgggtattcggaggaggaacaaaattaacagtacta

SEQ ID NO: 47259 - RNA, 321 nt, synthetic construct
  misc_feature 1..321: note = derived and/or modified sequence opt6 from anti-HIV_V3_LightChain
  source 1..321: mol_type = other RNA
gacatacaaatgacacaatccccatcatcactatcagcatcagtaggagacagagtaacaataacatgcagagcatcacaagaaatagacaactacctagcatggtaccaacaaagaccaggaaaagcaccaaaatcactaatatacgcagcatcatcactacaaggaggagtaccaccaaaattctcaggatcaggatcaggaacagaattcacactaacaatatcatcactacaagcagaagacttcgcaacatactactgccaacaatacaacgcatacccactaacattcggacaaggaacaagactagacataaac

SEQ ID NO: 47260 - RNA, 324 nt, synthetic construct
  misc_feature 1..324: note = derived and/or modified sequence opt6 from anti-HIV_V3_LightChain
  source 1..324: mol_type = other RNA
tcatacgaactaacacaaccaccatcactatcagtatcaccaggacaaacagcatcaataacatgctcaggagacggactaccaaaacaatacggatactggtaccaacaaaaaccaggacaagcaccactattagtaatactaaaagacacagaaagaccatcaggaataccagaaagattctcaggatcatcatcaggaacaacagtaacactaacaatatcaggagtacaagcagaagacgaagcagactactactgccaatcagtagactcaacaggatcatactacgtattcggaccaggaacaaaagtaacagtacta

SEQ ID NO: 47261 - RNA, 324 nt, synthetic construct
  misc_feature 1..324: note = derived and/or modified sequence opt6 from anti-HIV_V3_LightChain
  source 1..324: mol_type = other RNA
tcatacgaactaacacaaccaccatcagtatcagtatcaccaggacaaacagcaagaataacatgctcaggagacgtattaccaaaaaaatacgcatactggtaccaacaaaaatcaggactagcaccagtactagtaatatacgaagacaacagaagaccatcaggaataccagaaagattctcaggatcatcatcaggaacaatggcaacactaacaatatcaggagcacaagtagaagacgaaggagactactactgcagctcaacagactcatcaggagaccactacgtattcggaacaggaacaaaagtaacagtacta

SEQ ID NO: 47262 - RNA, 321 nt, synthetic construct
  misc_feature 1..321: note = derived and/or modified sequence opt6 from anti-HIV_V3_LightChain
  source 1..321: mol_type = other RNA
gcatacgaactaacacaaccaccatcagtatcagtatcaccaggacaaacagcaagaataacatgctcagcagaagcactatcaaaccaatacgcatactggtacagacaaagaccaggacaagcaccactactaataatatacaaagacacaaaaagaccatcaggaataccagaaagattctcaggatcaacatcaggaacaacagtaacactaacaatatcaggagtacaagcagaagacgaagcagactactactgccaatcagcagactcatcaggagactacgtattcggaggaggaacaaaagtaacagtacta

SEQ ID NO: 47263 - RNA, 333 nt, synthetic construct
  misc_feature 1..333: note = derived and/or modified sequence opt6 from anti-HIV_CD4bs_LightChain
  source 1..333: mol_type = other RNA
caaccagtattaacacaaagttcaagtgcaagcgcaagcctaggatcaagcgtaaaattaacatgtacattaggatcaggacatagcggaagcataatagcatggcatcaacaacaaccaggaaaagcaccaagatatctaatgaaagtacaatcaagcggaagctataacaaaggatcaggagtaccagatagatttagcggaagctcaagcggagcagatagatatctaacaatatcaaacttacaatttgaagatgaaggagactattactgtgaaacatgggatacaaataaatatgtatttggaacaggaacaaaagtaacagtacta

SEQ ID NO: 47264 - RNA, 324 nt, synthetic construct
  misc_feature 1..324: note = derived and/or modified sequence opt6 from anti-HIV_CD4bs_LightChain
  source 1..324: mol_type = other RNA
gaactcgtactaacacaatcaccaggaacattatcattatcacccggagaaagagcaacattatcatgcagagcatcacaatcagtagcatcatactacctagcatggtatcaacaaaaaccaggacaagcaccaagactactaatatacggagcatcatcaagagcaacaggaataccagacagattctcaggatcagtatcaggaacagacttcacactaacaatatcaagattagaaccagaagacttcgcactatattactgtcaacaatacggatcatcaccattatcattcggaggaggaacaaaagtagaaataaga

SEQ ID NO: 47265 - RNA, 333 nt, synthetic construct
  misc_feature 1..333: note = derived and/or modified sequence opt6 from anti-HIV_CD4bs_LightChain
  source 1..333: mol_type = other RNA
caatcagcactaacacaaccaccatcaatgtcaggatcaccaggacaatcaataacaatatcatgcacaggatcaggatcagacgtaggatcacacaacttcgtatcatggtaccaacaacacccagcaagagtaccaaaactactaatatacgcagtaggaaacagaccatcaggagtatcagaaagattctcaggatcaaaatcaggaaacacagcatacctaacaatatcaggactacaagcagacgacgaagcagactactactgctcaagccacacaacaggaacaacactagaagtattcggaggaggaacaagactaacagtacta

SEQ ID NO: 47266 - RNA, 333 nt, synthetic construct
  misc_feature 1..333: note = derived and/or modified sequence opt6 from anti-HIV_CD4bs_LightChain
  source 1..333: mol_type = other RNA
gatatagtaatgacacaatcaccattatcattaccagtaacaccaggagaaccagcaagcattagctgtagaagcagcgaatcattactacatagcaatggatttatatatctagattggtatctacaaaaaccaggacaaagcccacaattactaatatacttaggatcaaaaagagcatcaggagtaagcgatagatttagcggaagcggaagcggaacagcattcacactaaaaatatcaagagtagaagcagaagatgtaggagtatattactgtatgcaagcattagaatcaagaacattcggacaaggaacaaaactagaaataaaa

SEQ ID NO: 47267 - RNA, 327 nt, synthetic construct
  misc_feature 1..327: note = derived and/or modified sequence opt6 from anti-HIV_CD4bs_LightChain
  source 1..327: mol_type = other RNA
gaaatagtactaacacaatcaccaggaacactatcactatcaccaggagaaagagcaacactatcatgcagagcatcacaatcagtatcatcatcatacctagcatggtaccaacaaaaaccaggacaatcaccaagactactaatatacggagcatcatcaagagcaacaggaataccagacagattctcaggatcaggatcaggaacagacttcacactaacaatatcaagactagaaccagaagacttcgcagtatactactgccaacactacggatcatcatcaatattcacattcggaccaggaacaaaagtagacataaga

SEQ ID NO: 47268 - RNA, 330 nt, synthetic construct
  misc_feature 1..330: note = derived and/or modified sequence opt6 from anti-HIV_CD4bs_LightChain
  source 1..330: mol_type = other RNA
aacttcatgctaacacaaccacactcagtatcaggatcaccaggaaaaacagtaacaatatcatgcacaagatcatcaggatcaatagcaggaaactacgtacaatggtaccaacaaagaccaggaacatcaccaacaacagtaatatacgaaaacgaccaaagatcatcaggagtaccagacagattctcaggatcaatagactcatcatcaaactcagcatcactaacaatatcaggattaaaaacagaagacgaagcagactactactgccactcatacgacgcaacaaaccaagtattcggaggaggaacaaaactaacagtacta

SEQ ID NO: 47269 - RNA, 333 nt, synthetic construct
  misc_feature 1..333: note = derived and/or modified sequence opt6 from anti-HIV_CD4bs_LightChain
  source 1..333: mol_type = other RNA
gacgtagtagtaacacaatcaccactatcactaccagtaacactaggacaaccagcatcaatatcatgcagatcatcacaatcattagtatactcagacggaacaacacacctaaactggtaccaccaaagaccaggacaaccaccaagaagactaatatacagagtatcaaacagagactcaggagtaccagacagattctcaggatcaggatcaggaacagacttcacactaagaatatcaagagtagaagcagaagacgtaggactatactactgcatgctagcaacacacccattcacattcggaccaggaacaaaagtagaaataaaa

SEQ ID NO: 47270 - RNA, 336 nt, synthetic construct
  misc_feature 1..336: note = derived and/or modified sequence opt6 from anti-HIV_CD4bs_LightChain
  source 1..336: mol_type = other RNA
caaagcgtactaacacaaccaccatcagtatcaggagcaccaggacaaacagtaacaatatcatgcacaggatcaagctcaaacataggaccaagctatgacgtacaatggtaccaacaatttccaggaagagcaccaaaactattaatatcaggaaataacaatagagcaagcggagtaccagacagattctcaggatcaaaatcaggaacaagcgcaagcttagcaataacaggactacaaagcgaagacgaagcagattactattgtcaaacatatgactcaagcttaagcggacacgtagtatttggaggaggaacaagattaacagtacta

SEQ ID NO: 47271 - RNA, 321 nt, synthetic construct
  misc_feature 1..321: note = derived and/or modified sequence opt6 from anti-HIV_CD4bs_LightChain
  source 1..321: mol_type = other RNA
gacatacaaatgacacaatcaccatcaacactatcagcatcagtaggagacagagtaacaataacatgcagagcatcagcatcaatatacacatggctagcatggtaccaacaaagaccaggaaaagcaccagaagtactaatatacaaagcatcaacactaaaatcaggagtaccatcaagattctcaggatcaggatcaggaacagaattcacactaacaatatcatcactacaaccaggagacttcgcaacatactactgccaacaatacacaacatacccactaacattcggaggaggaacaacagtagaaataaaa

SEQ ID NO: 47272 - RNA, 330 nt, synthetic construct
  misc_feature 1..330: note = derived and/or modified sequence opt6 from anti-HIV_CD4bs_LightChain
  source 1..330: mol_type = other RNA
caatcagcattaacacaaccagcaagcgtatcaggatcaccaggacaatcaataacaatatcatgcacaggaacatcaaacgacataggaacatacaacctagtatcatggtaccaacaccacccaaacaaagcaccaaaagtagtagtatacgaaaacaacaaaagaccatcaggaatatcaaacagattctcaggatcaaaatcaggaaacacagcatcactaacaatatcaggactacaagcagaagacgaagcagactactactgctgctcatacgcaggatcatcaacatgggtattcggaggaggaacaaaattaacagtacta

SEQ ID NO: 47273 - RNA, 321 nt, synthetic construct
  misc_feature 1..321: note = derived and/or modified sequence opt6 from anti-HIV_V2_LightChain
  source 1..321: mol_type = other RNA
gacatacaaatgacacaatcaccatcaacactatcagcatcagtaggagacagagtaacaataacatgcagagcatcacaaacaatatcatcatggctagcatggtaccaacaaaaatcaggaacagcaccaaaattattaatatacaaagcatcatcaatagtatcaggagtaccatcaagattctcaggatcaggatcaggaacagaattcacactaacaataacatcactacaaccagacgacttcgcaacatactactgccaacaatacaactcatcaccagaaacattcggacaaggaacaaaagtagaaataaaa

SEQ ID NO: 47274 - RNA, 318 nt, synthetic construct
  misc_feature 1..318: note = derived and/or modified sequence opt6 from anti-HIV_V2_LightChain
  source 1..318: mol_type = other RNA
gaaatagtactaacacaatcaccaggaacactatcactatcaccaggagaaagagcaacactatcatgcagagcatcacaatcagtatcatcatacctagcatggtaccaacaaaaaccaggacaagcaccaagactactaatatacgacgcatcatcaagagcaacaggaataccagacagattctcaggatcaggatcaggaacagacttcacattaacaatatcaagactagaaccagaagacttcgcagtatactactgccaacactacgcaggatcaagaacattcggacaaggaacaaaagtagaaataaaa

SEQ ID NO: 47275 - RNA, 333 nt, synthetic construct
  misc_feature 1..333: note = derived and/or modified sequence opt6 from anti-HIV_V2_LightChain
  source 1..333: mol_type = other RNA
caatcagtactaacacaaccaccatcagtatcaggagcaccaggacaaagagtaacaatatcatgcacaggatcatcatcaaacataggagcacactacgacgtacactggtaccaacaactaccaggaacagcaccaaaattactaatatacggaaactcaaacagaccatcaggagtaccagacagattctcaggatcaaaatcaggaacatcagcatcactagcaataacaggactacaagcagaagacgaagcagactactactgccaatcatacgactcatcactatcaggatacgtattcggaacaggaacaaaagtaacagtacta

SEQ ID NO: 47276 - RNA, 324 nt, synthetic construct
  misc_feature 1..324: note = derived and/or modified sequence opt6 from anti-HIV_V2_LightChain
  source 1..324: mol_type = other RNA
gacacagtaatgacacaatcaccagcaacactatcagtatcaccaggagaacgagtaacactatcatgcagagcatcacaaataataaacacaaacctagcatggtaccaaaaaagaccaggacaagcaccaagactactaatatacgcagcatcagcaagagcaacaggaataccagcaagattctcaggatcaggatcaggaacagaattcacactaacaatatcaggactacaatcagaagactcagcagtatactactgccaacaatacaaacattggccaccatacacattcggaagaggaacaaaactagaaataaga

SEQ ID NO: 47277 - RNA, 321 nt, synthetic construct
  misc_feature 1..321: note = derived and/or modified sequence opt6 from anti-HIV_V2_LightChain
  source 1..321: mol_type = other RNA
gaaatagtgctaacacaatcaccaggaacattaagtttaagcccaggagaaagagcaacattaagctgtagagcaagccaaagcgtaagttcaagctatctagcatggtatcaacaaaaaccaggacaagcaccaagattactaatatacggagcatcaagcagagcaacaggaataccagatagatttagcggaagcggaagcggaacagatttcacactaacaatatcaagattagaaccagaagatttcgcagtatattactgtcaacaatacggaagctcaagaacattcggacaaggaacaaaagtagaaataaaa

SEQ ID NO: 47278 - RNA, 321 nt, synthetic construct
  misc_feature 1..321: note = derived and/or modified sequence opt6 from anti-HIV_V2_LightChain
  source 1..321: mol_type = other RNA
gacatacaaatgacacaatcaccatcatcactatcagcatcagtaggagacagagtaacaataacatgcagagcatcacaatcaatatcaggaaacctaaactggtaccaacaaaaaccaggaaaagcaccaaacctactaatatacggagcatcatcactacaatcaggagtaccatcaagattctcaggatcaggatcaggaacagacttcacactaacaatatcatcactacaaccagaagacttcgcaacataccactgccaacaatcacactcaacatcatggacattcggacaaggaacaaaagtagtaataaaa

SEQ ID NO: 47279 - RNA, 327 nt, synthetic construct
  misc_feature 1..327: note = derived and/or modified sequence opt6 from anti-HIV_10E8
  source 1..327: mol_type = other RNA
gcaagcgaactaacacaagatccaacagtatcagtagcactaggacaaacagtaacaataacatgcagaggagacagcttaagaaatcactatacatcatggtatcaacaaaaaacaggacaagcaccagtattactaatatacccaaaacataacagaagcccaggaataagcgacagatttagcgcaagctcaagcggaaacacagcatcactaacaataacaggagcacaaacagaagatgaaggagactattactgcagttcaagagataaatcaggatcaagattagtaacattcggaggaggaacagaagtaacaggatta

SEQ ID NO: 47280 - RNA, 327 nt, synthetic construct
  misc_feature 1..327: note = derived and/or modified sequence opt6 from anti-HIV_10E8
  source 1..327: mol_type = other RNA
gcatcagaactaacacaagacccaacagtatcagtagcactaggacaaacagtaacaataacatgcagaggagactcattaagaaaccactacacatcatggtaccaacaaaaaacaggacaagcaccagtactattaatatacccaaaacacaacagatcaccaggaatatcagacagattctcagcatcatcatcaggaaacacagcatcactaacaataacaggagcacaaacagaagacgaaggagactactactgctcatcaagagacaaatcaggatcaagactagtaacattcggaggaggaacaaaagtaacagtagta

SEQ ID NO: 47281 - RNA, 327 nt, synthetic construct
  misc_feature 1..327: note = derived and/or modified sequence opt6 from anti-HIV_10E8
  source 1..327: mol_type = other RNA
gcatcagaactaacacaagacccaacagtatcagtagcactaggacaaacagtaacaataacatgcagaggagacagcttaagaaactactacacatcatggtaccaacaaaaaccaggacaagcaccagtactattaatatacccaaaacacaacagaccaccaggaatatcagacagattcagcgcaagctcatcaggaaacacagcatcactaacaataacaggagcacaaacagaagacgaaggagactactactgctcatcaagagacaaatcaggatcaagattagtaacattcggaggaggaacaaaagtaacaggacta

SEQ ID NO: 47282 - RNA, 327 nt, synthetic construct
  misc_feature 1..327: note = derived and/or modified sequence opt6 from anti-HIV_10E8
  source 1..327: mol_type = other RNA
gcatcagaactaacacaagacccaacagtatcagtagcactaggacaaacagtaacaataacatgcagaggagactcactaagaaactactacacatcatggtaccaacaaaaaccaggacaagcaccagtactactaatatacccaaaacacaacagaccaccaggaatatcagacagattctcagcatcatcatcaggaaacacagcatcactaacaataacaggagcacaaacagaagacgaaggagactactactgcagctcaagagacaaatcaggatcaagactagtaacattcggaagaggaacaaaactaacagtagta

SEQ ID NO: 47283 - RNA, 327 nt, synthetic construct
  misc_feature 1..327: note = derived and/or modified sequence opt6 from anti-HIV_10E8
  source 1..327: mol_type = other RNA
gcatcagaactaacacaagacccaacagtatcagtagcactaggacaaacagtaacaataacatgcagaggagactcactaagaaaccactacacatcatggtaccaacaaaaaacaggacaagcaccagtattactaatatacccaaaacacaacagatcaccaggaatatcagacagattctcagcatcatcatcaggaaatacagcatcattaacaataacaggagcacaaacagaagacgaaggagactactactgctcatcaagagacaaatcaggatcaagactagtaacattcggaggaggaacaaaagtaacagtacta

SEQ ID NO: 47284 - RNA, 327 nt, synthetic construct
  misc_feature 1..327: note = derived and/or modified sequence opt6 from anti-HIV_10E8
  source 1..327: mol_type = other RNA
gcatcagaactaacacaagacccaacagtatcagtagcactaggacaaacagtaacaataacatgcagaggagactcactaagaaactactacacatcatggtaccaacaaaaaccaagacaagcaccagtactactaatatacccaaaacacaacagaccaccaggaatatcagacagattctcagcatcatcaagcggaaacacagcatcactaacaataacaggagcacaaacagaagacgaaggagactactactgctcatcaagagacaaatcaggatcaagattagtaacattcggaggaggaacaaaactaacagtacta

SEQ ID NO: 47285 - RNA, 327 nt, synthetic construct
  misc_feature 1..327: note = derived and/or modified sequence opt6 from anti-HIV_10E8
  source 1..327: mol_type = other RNA
gcatcagaactaacacaagatccaacagtatcagtagcactaggacaaacagtaacaataacatgcagaggagactcactaagaaactactacacatcatggtaccaacaaaaaccaggacaagcaccagtactactaatatacccaaaacacaacagaccaccaggaatatcagacagattctcagcatcatcatcaggaaacacagcatcactaacaataacaggagcacaaacagaagacgaaggagactactactgctcatcaagagacaaatcaggatcaagattagtaacattcggaggaggaacaaaactaacagtacta

SEQ ID NO: 47286 - RNA, 327 nt, synthetic construct
  misc_feature 1..327: note = derived and/or modified sequence opt6 from anti-HIV_10E8
  source 1..327: mol_type = other RNA
gcatcagaactaacacaagacccaacagtatcagtagcactaggacaaacagtaacaataacatgcagaggagactcactaagaaaccactacacatcatggtaccaacaaaaaacaggacaagcaccaatactactaatatacccaaaacacaacagaccaccaggaatatcagacagattctcagcatcatcatcaggaaacacagcatcactaacaataacaggagcacaaacagaagacgaaggagactactactgctcatcaagagacaaatcaggatcaagactagtaacattcggaggaggaacaaaactaacagtacta

SEQ ID NO: 47287 - RNA, 327 nt, synthetic construct
  misc_feature 1..327: note = derived and/or modified sequence opt6 from anti-HIV_10E8
  source 1..327: mol_type = other RNA
tcaagtgatctaacacaagatccagcagtatcagtagcactaggacaaacagtaagaataacatgccaaggagatagcttaagaagatactatgcaggatggtatcaacaaaaaccaggacaagcaccagtattagtagtatacggaagagataacagaccatcaggaataccagatagatttagcggaagcacaagcggaaacacagcatcactaacaatagcaggagcacaagcagaagatgacgcagactattactgtagttcaagagataaatcaggatcaagattaagcgtattcggaggaggaacaaaactaacagtatta

SEQ ID NO: 47288 - RNA, 327 nt, synthetic construct
  misc_feature 1..327: note = derived and/or modified sequence opt6 from anti-HIV_10E8
  source 1..327: mol_type = other RNA
gcaagcgaactaacacaagatccagcagtatcagtagcattcgaaaaaacagtaacaataacatgccaaggagatagcttaagatcacactatgtatcatggtatcaaaaaagaccaggacaagcaccagtattagtattttacggaaaaaataacagaccatcaggaataccagacagatttagcggaagcacaagcggaaacacagcatcactaacaatagcaggagcacaagcagaagatgacgcagactattactgtagctcaagagataaatcaggatcaagattaagcgtattcggaggaggaacaaaactaacagtacca

SEQ ID NO: 47289 - RNA, 327 nt, synthetic construct
  misc_feature 1..327: note = derived and/or modified sequence opt6 from anti-HIV_10E8
  source 1..327: mol_type = other RNA
gcaagcgaattaacacaagatccagcagtatcagtagcactaaaacaaacagtaacaataacatgcagaggagatagcttaagatcacactatgtatcatggtatcaacaaaaaccaggacaagcaccagtattagtattttacggaaaaaataacagaccatcaggaataccagatagatttagtggaagctcaagcggaaacacagcatcactaacaatagcaggagcacaagcagaagatgacgcagactattactgtagttcaagagataaatcaggatcaagattaagcgtattcggaggaggaacaaaactaacagtatta

SEQ ID NO: 47290 - RNA, 327 nt, synthetic construct
  misc_feature 1..327: note = derived and/or modified sequence opt6 from anti-HIV_10E8
  source 1..327: mol_type = other RNA
tcaagcgaactaacacaagatccaggagtatcagtagcactaaaacaaacagtaacaataacatgcaggggagatagcttaagatcacactatgtatcatggtatcaaaaaaaaccaggacaagcaccagtattagtattttacggaaaaaatataggaccatcaggaataccagatagatttagtggaagcacaagcggaaacacagcatcactaacaatagcaggagcacaagcagaagatgacgcagactattactgtagctcaagagataaatcaggatcaagattaagcgtattcggaggaggaacaaaactaacagtatta

SEQ ID NO: 47291 - RNA, 327 nt, synthetic construct
  misc_feature 1..327: note = derived and/or modified sequence opt6 from anti-HIV_10E8
  source 1..327: mol_type = other RNA
gcaagcgaactaacacaagatccagcagtatcagtagcactaaaacaaacagtaacaataacatgcagaggagatagcttaagatcacactatgtatcatggtatcaaaaaaaaccaggacaagcaccagtattagtattttacggaaaaaataacagaccatcaggaataccagatagatttagcggaagctcaagcggaaacacagcatcactaacaatagcaggagcacaagcagaagatgacgcagactattactgtagctcaagagataaatcaggatcaagattaagcgtattcggaggaggaacaaaactaacagtatta

SEQ ID NO: 47292 - RNA, 327 nt, synthetic construct
  misc_feature 1..327: note = derived and/or modified sequence opt6 from anti-HIV_10E8
  source 1..327: mol_type = other RNA
gcaagcgaattaacacaagatccaggagtatcagtagcactaaaacaaacagtaacaataacatgcagaggagatagcttaagatcacactatgtatcatggtatcaaaaaagaccaggacaagcaccagtattagtattttacggaaaaaataacagaccatcaggaataccagatagatttagcggaagcacaagcggaaacacagcatcactaacaatagcaggagcacaagcagaagatgacgcagactattactgtagctcaagagataaatcaggatcaagattaagcgtattcggaggaggaacaaaactaacagtatta

SEQ ID NO: 47293 - RNA, 327 nt, synthetic construct
  misc_feature 1..327: note = derived and/or modified sequence opt6 from anti-HIV_10E8
  source 1..327: mol_type = other RNA
gcaagcgaactaacacaagatccaggagtatcagtagcactagaacaaacagtaacaataacatgcagaggagatagcttaagatcacactatgtatcatggtatcaaaaaaaaccaggacaagcaccagtattagtattttacggaaaaaataacagaccatcaggaataccagatagatttagcggaagtacaagcggaaacacagcatcattaacaatagcaggagcacaagcagaagatgacgcagactattactgtagctcaagagataaatcaggatcaagattaagcgtattcggaggaggaacaaaactaacagtatta

SEQ ID NO: 47294 - RNA, 327 nt, synthetic construct
  misc_feature 1..327: note = derived and/or modified sequence opt6 from anti-HIV_10E8
  source 1..327: mol_type = other RNA
gcaagtgaactaacacaagatccaggagtatcagtagcactaaaacaaacagtaacaataacatgcagaggagatagcttaagatcacactatgtatcatggtatcaaaaaaaaccaggacaagcaccagtattagtattttacggaaaaaataacagaccatcaggaataccagatagatttagcggaagcacaagcggaaacacagcatcactaacaatagcaggagcacaagcagaagatgacgcagactattactgtagctcacgagataaatcaggatcaagattaagcgtattcggaggaggaacaaaattaacagtatta

SEQ ID NO: 47295 - RNA, 327 nt, synthetic construct
  misc_feature 1..327: note = derived and/or modified sequence opt6 from anti-HIV_10E8
  source 1..327: mol_type = other RNA
tcaagcgaactaacacaagatccaggagtatcggtagcactaaaacaaacagtaacaataacatgcagaggagatagcttaagatcacactatgtatcatggtatcaaaaaaaaccaggacaagcaccagtattagtattttacggaaaaaataacaggccatcaggaataccagatagatttagcggaagcacaagcggaaacacagcatcactaacaatagcaggagcacaagcagaagatgacgcagactattactgtagctcaagagataaatcaggatctagactaagcgtattcggaggaggaacaaaactaacagtacta

SEQ ID NO: 47296 - RNA, 327 nt, synthetic construct
  misc_feature 1..327: note = derived and/or modified sequence opt6 from anti-HIV_10E8
  source 1..327: mol_type = other RNA
tcgagcgaactaacacaagaaacaggagtatcagtagcactaggaagaacagtaacaataacatgcagaggagatagtttaagatcacactatgcatcatggtatcaagaaaaaccaggacaagcaccaaaattactattttacggaaaaaataacagaccatcaggaataccagatagatttagcggaagtgcaagcggaaacagagcatcactaacaatatcaggagcacaagcagaagatgacgcagaatattactgtagctcaagagataaatcaggatcaagattaagtgtattcggaggaggaacaaaactagcagtatta

SEQ ID NO: 47297 - RNA, 327 nt, synthetic construct
  misc_feature 1..327: note = derived and/or modified sequence opt6 from anti-HIV_10E8
  source 1..327: mol_type = other RNA
tcaagtgaactaacacaagaaacaggagtatcagtagcgctaggaagaacagtaacaataacatgcagaggagatagcttaagatcacactatgcatcatggtatcaaaaaaaaccaggacaagcaccaaaattactattttacggaaaaaataacagaccatcaggaataccagatagatttagcggattcgcaagcggaaacagagcatcactaacaatatcaggagcacaagcagaagatgacgcagaatattactgtagctcaagagataaatcaggatcaagattaagcgtattcggaggaggaacaaaactaacagtatta

SEQ ID NO: 47298 - RNA, 327 nt, synthetic construct
  misc_feature 1..327: note = derived and/or modified sequence opt6 from anti-HIV_10E8
  source 1..327: mol_type = other RNA
tcaagcgaactaacacaagaaacaggagtatcagtagcactaggaagaacagtaacaataacatgcagaggagatagcttaagatcacactatgcatcatggtatcaaaaaaaaccaggacaagcaccaaaattactattttacggaaaaaataacagaccatcaggaataccagatagatttagcggaagcgcaagcggaaacagagcatcactaacaatatcaggagcacaagcagaagatgacgcagaatatatatgtagttcaagagataaatcaggatcaagactaagcgtattcggaggaggaacaaaactaacagtatta

SEQ ID NO: 47299 - RNA, 327 nt, synthetic construct
  misc_feature 1..327: note = derived and/or modified sequence opt6 from anti-HIV_10E8
  source 1..327: mol_type = other RNA
tcaagtgaactaacacaagaaacaggagtatcagtagcactaggaagaacagtaacaataacatgcagaggagatagcttaagatcacactatgcatcatggtatcaaaaaaaaccaggacaagcaccaaaattactattttacggaaaaaataacagaccatcaggaataccagatagatttagcggaagcgcaagcggaaacagagcatcactaacaatatcaggagcacaagcagaagatgacgcagaatattactgtagctcaagagataaatcaggatcaagattaagtgtattcggaggaggaacaaaactaacagtatta

SEQ ID NO: 47300 - RNA, 327 nt, synthetic construct
  misc_feature 1..327: note = derived and/or modified sequence opt6 from anti-HIV_10E8
  source 1..327: mol_type = other RNA
tcaagcgaactaacacaagaaacaggagtatcagtagcactaggaagaacagtaacaataacatgcagaggagatagcttaagatcacactatgcatcatggtatcaaaaaaaaccaggacaagcaccaatattactattttacggaaaaaataacagaccatcaggaatacacgatagatttagcggaagcgcaagcggaaacagagcatcactaacaatatcaggagcacaagcagaagatgacgcagaatattactgtagctcaagagataaatcaggatcaagattaagtgtattcggaggaggaacaaaactaacagtatta

SEQ ID NO: 47301 - RNA, 393 nt, synthetic construct
  misc_feature 1..393: note = derived and/or modified sequence opt6 from anti-HIV_10E8
  source 1..393: mol_type = other RNA
gaagtacaattagtagaaagtggaggagatttagtaaaaccaggaggaagtttaagattaagctgtagtgcaagtggatttagttttaaaaatacatggatgacatgggtaagacaagcaccaggaaaaggattagaatgggtaggaagaataacaggaccaggagaaggatggacaagtgattatgcagcaacagtacaaggaagatttacaataagtagaaataatatgatagatatgttatatttagaaatgaatagattaagaacagatgatacaggattatattattgtgtacatacagaaaaatattataatttttggggaggatatccaccaggagaagaatattttcaacattggggaagaggaacattagtaatagtaagtagt

SEQ ID NO: 47302 - RNA, 393 nt, synthetic construct
  misc_feature 1..393: note = derived and/or modified sequence opt6 from anti-HIV_10E8
  source 1..393: mol_type = other RNA
gaaataagattagtagaaagtggaggaggattagtaaaaccaggaggaagcctaagattaagttgtagcgcaagcggattcaatttcgatagcgcatggatgacatgggtaagacaaccaccaggaaaaggactagaatgggtaggaagaataacaggaccaggagaaggatggagcgtaggatatgcagaaagcgtaaaaggaagatttataataagcagaataaatagcataaactttctatatttagaaatgaataatttaagaccagaagatacaggaagttatttctgtgcacatacaggaaaacattacgatttctggagaggatacccaccaggagaagaatactttcaagattggggacaaggaacacaagtaatagtaagtagt

SEQ ID NO: 47303 - RNA, 393 nt, synthetic construct
  misc_feature 1..393: note = derived and/or modified sequence opt6 from anti-HIV_10E8
  source 1..393: mol_type = other RNA
gaaataagattagtagaaagtggaggaggattagtaaaaccaggaggaagtctaagattaagctgtagcgcgagcggattcaatttcgatagcgcatggatgacatgggtaagacaaccaccaggaaaaggactagaatgggtaggaagaataacaggaccaggagaaggatggagcgtagactatgcagaaagcgtaaaaggaagatttataataagcagaataaatagtataaattttctatatctagaaatgaataacttaagaccagaagatacaggaagttatttctgtgcacatacaggaaaacattacgatttctggagaggatacccaccaggagaagaatactttcaagattggggacaaggaacacaagtaatagtaagtagc

SEQ ID NO: 47304 - RNA, 393 nt, synthetic construct
  misc_feature 1..393: note = derived and/or modified sequence opt6 from anti-HIV_10E8
  source 1..393: mol_type = other RNA
gaagtaagattagtagaaagtggaggaagattagtaagaccaggaggaagtttaagattaagttgtagcgcaagtggatttaattttgataatgcatggatgacatgggtaagacaaccaccaggaaaaggattagaatgggtaggaagaataacaggaccaggagaaggatggagtgtagattatgcagcaagtgtaaaaggaagatttacaataagtagaatgaatagtataaattttttttatttagaaatgaataatttaaaaatagaagatacagggttatatttttgtgcaagaacaggaaaacattatgcattttggggaggatatccaccaggagaagaatatttagaagattggggacaaggaacattagtaatagtaagtagc

SEQ ID NO: 47305 - RNA, 393 nt, synthetic construct
  misc_feature 1..393: note = derived and/or modified sequence opt6 from anti-HIV_10E8
  source 1..393: mol_type = other RNA
gaagtaagattagtagaaagtggaggaggattagtaaaaccaggaggaagtttaagattaagttgtagtgcaagtggatttaattttgatgatgcatggatgacatgggtaagacaaccaccaggaaaaggactagaatgggtaggaagaataagtggaccaggagaaggatggagtgtagattatgcagaaagcgtaaaaggaagatttacaataagtagattaaatagtataaattttctatatttagaaatgaataatgtaagaacagaagatacaggatattatttttgtgcaagaacaggaaaacattatgatttttggagtggatatccaccaggagaagaatattttcaagattggggacaaggaacattagtaatagtaagtagt

SEQ ID NO: 47306 - RNA, 393 nt, synthetic construct
  misc_feature 1..393: note = derived and/or modified sequence opt6 from anti-HIV_10E8
  source 1..393: mol_type = other RNA
gaagtaagattagcagaaagcggaggaggattagtaaaaccaggaggaagtttaagattaagttgtagtgcaagtggatttgattttgataatgcatggatgacatgggtaagacaaccaccaggaaaaggattagaatgggtaggaagaataacaggaccaggagaaggatggagtgtagattatgcagcaccagtggaaggaagatttacaataagtagattaaatagtataaattttttatatttagaaatgaataatttaagaatggaagatagtggattatatttttgtgcaagaacaggaaaatattatgatttttggagtggatatccaccaggagaagaatattttcaagattggggacagggaacattagtaatagtaccaagt

SEQ ID NO: 47307 - RNA, 393 nt, synthetic construct
  misc_feature 1..393: note = derived and/or modified sequence opt6 from anti-HIV_10E8
  source 1..393: mol_type = other RNA
gaagtaagattagtagaaagcggaggaggattagtaaaaccaggaggaagtttaagattaagttgtagtgcaagtggatttgattttgataatgcatggatgacatgggtaagacaaccaccaggaaaaggattagaatgggtaggaagaataacgggaccaggagaaggatggagtgtagattatgcagcaccagtagaaggaagatttacgataagtagattaaatagtataaattttttatatttagaaatgaataatttaagaatggaagatagtggattatatttttgtgcaagaacaggaaaatattatgatttttggagtggatatccaccaggagaagaatattttcaagattggggacaaggaacattagtaatagtaccaagt

SEQ ID NO: 47308 - RNA, 393 nt, synthetic construct
  misc_feature 1..393: note = derived and/or modified sequence opt6 from anti-HIV_10E8
  source 1..393: mol_type = other RNA
gaagtaagattagtagaaagtggaggaggattagtaaaaccaggaggaagtttaagattaagttgtagtgcaagtggatttgattttgataatgcatggatgacatgggtaagacaaccaccaggaaaaggattagaatgggtaggaagaataacaggaccaggagaaggatggagtgtagattatgcagcaccagtagaaggaagatttacaataagtagattaaatagtataaattttttatatttagaaatgaataatttaagaatggaagatagtggattatatttttgtgcaaggacaggaaaatattatgatttttggagtggatatccaccaggagaagaatattttcaagattggggacaaggaacattagtaatagtaagtagc

SEQ ID NO: 47309 - RNA, 393 nt, synthetic construct
  misc_feature 1..393: note = derived and/or modified sequence opt6 from anti-HIV_10E8
  source 1..393: mol_type = other RNA
gaagtaagattagcagaaagtggaggaggattagtaaaaccaggaggaagtttaagattgagttgtagtgcaagtggatttgattttgataatgcatggatgacatgggtaagacaaccaccaggaaaaggactagaatgggtaggaaggataacaggaccaggagaaggatggagtgtagattatgcagcaccagtagaaggaagatttacaataagtagactaaatagtataaattttttatatttagaaatgaataatttaagaatggaagatagtggattatatttttgtgcaagaacaggaaaatattatgatttttggagtggatatccaccaggagaagaatattttcaagattggggaagaggaacattagtaatagtatcaagc

SEQ ID NO: 47310 - RNA, 393 nt, synthetic construct
  misc_feature 1..393: note = derived and/or modified sequence opt6 from anti-HIV_10E8
  source 1..393: mol_type = other RNA
gaagtaagattagtagaaagtggaggaggattagtaaaaccaggaggaagtttgagattaagttgtagtgcaagtggatttgattttgataatgcatggatgacatgggtaagacaaccaccaggaaaaggattagaatgggtaggaagaataacaggaccaggagaaggatggagtgtagattatgcggcaccagtagaaggaagatttacaataagtagattaaatagtataaattttttatatttagaaatgaataatttgagaatggaagatagtggattatatttttgtgcaagaacaggaaaatattatgatttttggagtggatatccaccaggagaagaatattttcaagattggggaagaggaacattagtaatagtaagtagt

SEQ ID NO: 47311 - RNA, 333 nt, synthetic construct
  misc_feature 1..333: note = derived and/or modified sequence opt6 from anti-HIV-1_LightChain
  source 1..333: mol_type = other RNA
caatcagtattaacacaaccaccaagcgtaagtgcagcaccaggacaaaaagtaacaataagctgtagcggaagatcaagcaatataggaaacaataatgtattctggtaccaacaattaccaggaacagcaccaaaactattaatatatgacaatgacaaaagaccaagcggaataccagacagattctcaggatcaaaatcaggaacaagcgcaacattaggaataacaggactacaaacaggagacgaagcagattactattgcggaacatgggacagctcattaagcgcaggaggagtatttggaacaggaacaaaagtaacagtacta

SEQ ID NO: 47312 - RNA, 336 nt, synthetic construct
  misc_feature 1..336: note = derived and/or modified sequence opt6 from anti-HIV-1_LightChain
  source 1..336: mol_type = other RNA
caaagcgtactaacacaaccagcatcagtatcaggatcaccaggacaatcaataacaataagctgcacaggaacaaaatcagacataggaggatacaaatacgtaagctggtaccaacaacacccaggaaaagcaccaaaaatactaatatatgacgtaaacaaaagaccaagcggaataccagacagattctcaggatcaaaatcaggaacaagtgcaacactaggaataacaggattacaaacaggagacgaagcagactactactgcggaacatgggacaacagcctaagcacaggaggagtattcggaacaggaacaaaagtaacagtacta

SEQ ID NO: 47313 - RNA, 321 nt, synthetic construct
  misc_feature 1..321: note = derived and/or modified sequence opt6 from anti-HIV-1_LightChain
  source 1..321: mol_type = other RNA
caatcagtattaacacaaccaccaagcgtatcagcagcaccaggacaaagagtaacaataagctgtttcggatcaagattcagttcagtatcatggtaccaacaattaccaggaacagcaccaaaactattaatatatgaaaatacaaaaagaccatcaggaataccagacagattctcaggatcaaaatcaggaacatcagcaacattaggaataacaggactacaaacaggagacgaagcagactactattgcggaacatgggacagatcattatcagcaggaggagtatttggaacaggaacaaaagtaacagtacta

SEQ ID NO: 47314 - RNA, 333 nt, synthetic construct
  misc_feature 1..333: note = derived and/or modified sequence opt6 from anti-HIV-1_LightChain
  source 1..333: mol_type = other RNA
caatcagtactaacacaaccaccatcagcatcaggaacaccaggacaaacaataacaatatcatgctcaggatcaagctcaaacataggatcaaacgacgtatactggtaccaacacctaccaggaacaacacccaaagtagtaatatacaaaaacaacagaagaccatcaggaataccagacagattcagcggatcaaaatcaggaacatcagcaacactaggaataacaggactacaaacaggagacgaagcagactactactgcggaacatgggatagatcactatcagcaggaggagtattcggaacaggaacaaaagtaacagtacta

SEQ ID NO: 47315 - RNA, 327 nt, synthetic construct
  misc_feature 1..327: note = derived and/or modified sequence opt6 from anti-HIV-1_LightChain
  source 1..327: mol_type = other RNA
caatcagtactaacacaaccaccatcaatgtcagcagcaccaggacaaaaagtaacaatatcatgctcaggatcaacatcaataataggaaacaactacatatcatggtaccaacaactaccaggaacagcaccaaaactactaatatacgaagacaacaaaagaccatcaggaataccagacagattctcaggatcaaaatcaggaacatcagcaacactaggaataacaggattacaaacaggagacgaagcagactactactgcggaacatggcactcatcactatcagcaggaggagtattcggaacaggaacaaaagtaaca

SEQ ID NO: 47316 - RNA, 333 nt, synthetic construct
  misc_feature 1..333: note = derived and/or modified sequence opt6 from anti-HIV-1_LightChain
  source 1..333: mol_type = other RNA
caatcagtattaacacaaccaccatcagtatcagcagcaccaggattaaaagtaacaatatcatgctcaggaaacacatcaaatgtaggagacaacttcgtaagctggtacagatacctaccaggaacagcaccaaaactactatcatacgaagacgacaaaagaccatcaggaataccagacagattctcaggatcaaaatcaggaacatcagcaacactaggaataacaggactacaaacaggagacgaagcagactactactgcggaacatgggactcatcactatcagcaggaggagtattcggaacaggaacaaaagtaacagtacta

SEQ ID NO: 47317 - RNA, 333 nt, synthetic construct
  misc_feature 1..333: note = derived and/or modified sequence opt6 from anti-HIV-1_LightChain
  source 1..333: mol_type = other RNA
caatcagtattaacacaaccaccaagcgcatcaggaacaccaggacaaagagtaacaatatcatgttcaggatcatcaagcaatataggatcaaatacagtaaactggtaccaacaatttccaggaacagcaccaaaactattaatatatgaaaataacagaagaccatcaggagtaccagcaagattctcaggatcaaaatcaggaacatcagcaacattagcaataacaggactacaaacaggagacgaagcagactactattgcgcaacatgggactcatcattatcagcaggaggagtatttggaacaggaacaaaagtaacagtacta

SEQ ID NO: 47318 - RNA, 318 nt, synthetic construct
  misc_feature 1..318: note = derived and/or modified sequence opt6 from anti-HIV-1_LightChain
  source 1..318: mol_type = other RNA
caatcagtactaacacaaccaccatcagtatcagcagcaccaggacaaaaagtaacaatatcatgctcaggatcatcaagcaacataggaaacaactacgtatcatggtaccaacaactaccaggaacagcaccaaaactactaatatacgaaaacaacaaaagaccatcaggaataccagacagattctcaggatcaaaatcaggaacatcagcaacactaggaataacaggactacaaacaggagacgaagcagactactactgcggaacatgggacaactcactatcaacaggaggagtattcggaacaggaaca

SEQ ID NO: 47319 - RNA, 288 nt, synthetic construct
  misc_feature 1..288: note = derived and/or modified sequence opt6 from anti-HIV-1_LightChain
  source 1..288: mol_type = other RNA
ggattatcaccatcactatgttcaggaagctcaagcaatataggaaacaattacgtaagctggtaccaacaattaccaggaacagcaccaaaactattaatatatgaaaatacaaaaagaccaagcggaataccagacagattctcaggatcaaaatcaggaacaagcgcaacattaggaataacaggactacaaacaggagacgaaggagattactattgcggaacatgggacagaagtttaagcgcaggaggagtatttggaacaggaacaaaagtaacagtacta

SEQ ID NO: 47320 - RNA, 333 nt, synthetic construct
  misc_feature 1..333: note = derived and/or modified sequence opt6 from anti-HIV-1_LightChain
  source 1..333: mol_type = other RNA
caatttgtattaacacaaccaccaagcgtaagcgcagcaccaggacaaagagtaacagtaagctgtagcggaacaacaagcgatataggagaaaattacgtaagctggtaccaaaaatttagcgaagcagcaccaaaactactactatatgacaatgacaaaagaccaagcggaataccagacagattctcaggatcaaaatcaggaacaagcgcaacactaggaataacaggactacaaacaggagacgaagcagattactattgcggaacatgggacagctcattaagcgcaggaggagtatttggaacaggaacaaaagtaacagtacta

SEQ ID NO: 47321 - RNA, 327 nt, synthetic construct
  misc_feature 1..327: note = derived and/or modified sequence opt6 from anti-HIV-1_LightChain
  source 1..327: mol_type = other RNA
caatcagtattaacacaaccaccaagcgtaagcgcagcaccaggacaaaaagtaacaataagctgtagcggaggatcaagcaatataggaaactattacgtaagctggtacttacaattaccaggaacagcaccaaaactattaatatatgaaaataacaaaagaccaagcggaataccagacagattctcaggatcaaaatcaggaacaagcgcaacattaggaataacaggattacaaacaggagacgaagcagattactattgcggaacatggcacagctcattaagcgcaggaggagtctttggaacaggaacaaaagtaaca

SEQ ID NO: 47322 - RNA, 333 nt, synthetic construct
  misc_feature 1..333: note = derived and/or modified sequence opt6 from anti-HIV-1_LightChain
  source 1..333: mol_type = other RNA
caatcagtactaacacaaccaccatcagtatcagcagcaccaggacaaaaagtaacaatatcatgctcaggaaacatgtcaaacataggagacaacgcagtatcatggtacagacaagtaccagaagcaccaccacaactactaatattcggaaacgacaaaagaccatcaggagtaacagacagattctcaggatcaaaatcaggaacatcagcaacactaggaataacaggactacaaacaggagacgaagcagactactactgcggaacatgggacagatcactatcagcaggaggagtattcggaacaggaacaaaagtaacagtacta

SEQ ID NO: 47323 - RNA, 336 nt, synthetic construct
  misc_feature 1..336: note = derived and/or modified sequence opt6 from anti-HIV-1_LightChain
  source 1..336: mol_type = other RNA
caatcagtactaacacaaccaccatcagtatcaggagcaccaggacaaagagtaacaatatcatgtacaggatcatcatcaaatataggagcaggatacgacgtacactggtacctacaactaccaggaacagcaccaagactactaatatacgacaacgataaaagaccatcaggaataccagacagattctcaggatcaaaatcaggaacatcagcaacactaggaataacaggactacaaacaggagacgaagcagactattactgcggaacatggcactcatcactatcagcaggaggagtattcggaacaggaacaaaagtaacagtacta

SEQ ID NO: 47324 - RNA, 333 nt, synthetic construct
  misc_feature 1..333: note = derived and/or modified sequence opt6 from anti-HIV-1_LightChain
  source 1..333: mol_type = other RNA
caatcagtactaacacaaccaccatcagtatcagcagcaccaggacaaaaagtaacaatatcatgctcaggatcaacatcaaacataggaaacaacttcgtatcatggtaccaacaactaccaggaacagcaccaaaactactattctacgacaactacaaaagaccatcaggaataccagacagattctcaggatcaaaatcaggaacatcagcaacactagcaataacaggattacaaacaggagacgaagcagactactactgcgcaacatgggactcatcactatcagcaggaggagtattcggaacaggaacaaaagtaacagtacta

SEQ ID NO: 47325 - RNA, 336 nt, synthetic construct
  misc_feature 1..336: note = derived and/or modified sequence opt6 from anti-HIV-1_LightChain
  source 1..336: mol_type = other RNA
caaagtgtattaacacaaccaccatcagtatcaggagcaccaggacaaagagtaacaatatcatgcacaggaggaagctcaaatataggagcaggatatgatgtacactggtaccaacacttaccaggaacagcaccacaactattaatatatgaaaatacaaaaagaccaagcggaataccagacagattttcaggatcaaaatcaggaacaagcgcaacattaggaataacaggattacaaacaggagacgaagcagattattattgcggaacatgggacagaagtttaagcgcaggaggagtatttggaacaggaacaaaagtaacagtacta

SEQ ID NO: 47326 - RNA, 333 nt, synthetic construct
  misc_feature 1..333: note = derived and/or modified sequence opt6 from anti-HIV-1_LightChain
  source 1..333: mol_type = other RNA
caatcagtattaacacaaccaccatcattaagcgcagcaccaggacaaagagtaacagtaagctgtagcggaagcagcagtaatataggagacaattacgtaagctggtaccaacaattaccaggagcagcaccaagactattaatatatgaaaataacaaaagaccaagcggaataccagacagattctcaggaagtaaatcaggaacaagcgcaacattaggaataacaggactacaaacaggagacgaagcagattactattgcggaacatgggacaatagcttaagcacaggaggagtatttggaacaggaacaaaagtaacagtacta

SEQ ID NO: 47327 - RNA, 333 nt, synthetic construct
  misc_feature 1..333: note = derived and/or modified sequence opt6 from anti-HIV-1_LightChain
  source 1..333: mol_type = other RNA
caaagcgtattaacacaaccaccaagcgtaagcgcagcaccaggacaaaaagtaacaataagctgtagcggaagatcaagcaatataggaaactatttcgtaagctggtaccaacaatttccaggaacagcaccaaaactattaatatatgacaataacaaaagaccaagcggaataccagacagattctcaggatcaaaatcaggaacaagcgcaacattaggaataacaggactacaaacaggagacgaagcagattactattgcggaacatgggacagatcattaagcgcaggaggagtatttggaacaggaacaaaagtaacagtacta

SEQ ID NO: 47328 - RNA, 333 nt, synthetic construct
  misc_feature 1..333: note = derived and/or modified sequence opt6 from anti-HIV-1_LightChain
  source 1..333: mol_type = other RNA
caatcagtactaacacaaccaccatcagcatcaggaacaccaggacaaagagtaacaatatcatgctcaggatcatcatcaaacataggatcaaacgcagtacactggttcagacaactaccaggaacagcaccaaaactactaatatacgaaaacaacaaaagaccatcaggaataccagacagattctcaggatcaaaatcaggaacatcagcaacattaggaataacaggactacaaacaggagatgaagcagactactactgcgcaacatgggactcatcactatcagcaggaggagtattcggaacaggaacaaaagtaacagtacta

SEQ ID NO: 47329 - RNA, 333 nt, synthetic construct
  misc_feature 1..333: note = derived and/or modified sequence opt6 from anti-HIV-1_LightChain
  source 1..333: mol_type = other RNA
caatcagtattaacacaaccaccatcagtatcagcagcatcaggacaaaaagtaacaatatcatgctcaggatcatcatcaaacataggaaacaactacgtaagctggtaccaccaactaccaggaacagcaccaaaactactaatatacgacacaaacaaaagaccatcaggaataccagacagattctcaggatcaacatcaggaacatcagcaacactaggaataacaggactacaaacaggagacgaagcagactactactgcggaacatgggacaactcactatcaacaggaggagtattcggaacaggaacaaaagtaacagtacta

SEQ ID NO: 47330 - RNA, 333 nt, synthetic construct
  misc_feature 1..333: note = derived and/or modified sequence opt6 from anti-HIV-1_LightChain
  source 1..333: mol_type = other RNA
caaccagtactaacacaaccaccatcagtatcagcagcaccaggacaaacagtaacaatatcatgttcaggatcattctcaaatatagaaacaaattacgtatcatggtaccaacaactaccaggaacagcaccaaaactattaatatacgacaataacatgagaccatcaggaataccagacagattctcaggatcaaaatcaggaacatcagcaacactaggaataacaggactacaaacaggagacgaagcagactactactgcggaacatgggacacaagcctatcagcaggaggagtattcggaacaggaacaaaagtaacagtacta

SEQ ID NO: 47331 - RNA, 336 nt, synthetic construct
  misc_feature 1..336: note = derived and/or modified sequence opt6 from anti-HIV-1_LightChain
  source 1..336: mol_type = other RNA
caaccagtattaacacaaccaccatcagtatcaggagcaccaggacaaagagtaacaatatcatgcacaggatcatcatcaaacataggagcaggatacgacgtacactggtaccaacaactaccaggaaccgcaccaaaactactaatatacgaaaacaacaaaagaccatcaggaataccagacagattctcaggatcaaaatcaggaacatcagcaacactaggaataacaggactacaaaccggagacgaagcagactactactgcggaacatgggacaattcactatcaacaggaggagtattcggaacaggaacaaaagtaacagtacta

SEQ ID NO: 47332 - RNA, 333 nt, synthetic construct
  misc_feature 1..333: note = derived and/or modified sequence opt6 from anti-HIV-1_LightChain
  source 1..333: mol_type = other RNA
caatcagtactaacacaaccaccatcactatcagcagcaccaggacaaagaataacaatatcatgctcaggatcatcatcaaacataggaaacaactacgtatcatggtaccaacaattcccaggaacagcaccaaaactactaatatacgaaaacaacaaaagaccatcaggaataccagacagattctcagcatcaaaatcaggaacatcagcaacattaggaataacaggactacaaacaggagacgaagcaaactactactgcggaacatggcactcatcactatcagcaggaggagtattcggaacaggaacaaaagtaacagtacta

SEQ ID NO: 47333 - RNA, 333 nt, synthetic construct
  misc_feature 1..333: note = derived and/or modified sequence opt6 from anti-HIV-1_LightChain
  source 1..333: mol_type = other RNA
caatcagtattaacacaaccaccatcagtatcagcagcaccaggacaaagagtaacaatatcatgtttcggatcaagattcaatgtaggaacatcatcagtatcatggtaccaacaattaccaggaacagcaccaaaactattaatagatgcaaatggagaaagaccatcaggaataccagacagattctcaggatcaaaatcaggaacatcagcaacattaggaataacaggactacaaacaggagacgaagcagattactattgcggaacatgggactcatcactatcagcaggcggagtatttggaacaggaacaaaagtaacagtacta

SEQ ID NO: 47334 - RNA, 333 nt, synthetic construct
  misc_feature 1..333: note = derived and/or modified sequence opt6 from anti-HIV-1_LightChain
  source 1..333: mol_type = other RNA
caatcagtattaacacaaccaccaagcgtaagcgcaacaccaggacaaaaagtaacaataagctgtagcggaagcagaagcaatataggaagccattacgtaagctggtaccaacaatttccaggaacagcaccaaaactattaatatatgacaataacaaaagaccaagcggaataccagacagattctcaggatcaaaatcaggaacaagcgcaacactaggaataacaggactacaaacaggagacgaagcagattactattgcggaacatggcacagctcattaagcgcaggaggagtatttggaacaggaacaaaagtaacagtacta

SEQ ID NO: 47335 - RNA, 333 nt, synthetic construct
  misc_feature 1..333: note = derived and/or modified sequence opt6 from anti-HIV-1_LightChain
  source 1..333: mol_type = other RNA
caatcagtattaacacaaccaccaagcgcaagtggaacaccaggacaaagagtaacaataagctgtagcggaagctcaagcaatataggaagcaatcacgtatactggtaccaacaattaccaggaaaaacaccaaaactattaatatatagaaataaccaaagaccaagcggaataccagacagattctcaggatcaaaatcaggaacaagcgcaacattaggaataacaggactacaaacaggagacgaagcagattactattgcggaacatgggactcaagtttaagcacaggaggagtatttggaacaggaacaaaagtaacagtacta

SEQ ID NO: 47336 - RNA, 333 nt, synthetic construct
  misc_feature 1..333: note = derived and/or modified sequence opt6 from anti-HIV-1_LightChain
  source 1..333: mol_type = other RNA
caatcagtattaacacaaccaccatcagtatcagcagcaccaggacaaaaagtaacaatatcatgctcaggatcatcagcaaacataggaaacaactacgtatcatggtaccaacaattcccaggaacaggaccaagactaataatatacgaatcaaacaaaagaccaagcggaatatcagacagattctcaggatcacaatcagacgcagcagcaacactagacataacaggactacaaacaggagacgaagcagactactactgcggaacatgggactcatcactatcagcaggaggagtattcggaacaggaacaagagtaacagtacta

SEQ ID NO: 47337 - RNA, 336 nt, synthetic construct
  misc_feature 1..336: note = derived and/or modified sequence opt6 from anti-HIV-1_LightChain
  source 1..336: mol_type = other RNA
caaagtgtactaacacaaccaccatcagtatcaggagcaccaggacaaacagtaacaatatcatgcacaggagatacatcaaacataggagcagactatagagtacactggtaccaacaattaccaggaacagcaccaaaactattaatatatgaaaataacaaaagaccaagcggaataccagacagattctcaggatcaaaatcaggaacaagcgcaacattaggaataacaggactacaaacaggagacgaagcagattactattgcggaacatgggacaatagcttaagcacaggaggagtatttggaacaggaacaaaagtaacagtacta

SEQ ID NO: 47338 - RNA, 333 nt, synthetic construct
  misc_feature 1..333: note = derived and/or modified sequence opt6 from anti-HIV-1_LightChain
  source 1..333: mol_type = other RNA
caatcagtattaacacaaccaccatcattaagcgcagcaccaggacaaagagtaacagtaagctgtagcggaagctcaagcaatataggaaacaattacgtaagctggtaccaacaattaccaggagcagcaccaaaactattaatatataacaataacataagaccaagcggaataccagaaagattctcaggatcaaaatcaggaacatcagcaacattaggaataacaggactacaaacaggagacgaaggagattactattgcggaacatgggacagaagtttaagcgcaggaggagtatttggaacaggaacaaaagtaacagtacta

SEQ ID NO: 47339 - RNA, 333 nt, synthetic construct
  misc_feature 1..333: note = derived and/or modified sequence opt6 from anti-HIV-1_LightChain
  source 1..333: mol_type = other RNA
caatcagtactaacacaaccaccatcagcatcaggaacaccaggacaaagagtaacaatatcatgctcaggatcatcatcaaatataggaggcaactacgtatcatggtaccaacaactaccaggaacagcaccaaaactactaatatcagaaaacaacaaaagaccatcaggaataccagacagattctcaggatcaaaatcaggaacatcagcaacactaggaataacaggactacaaacaggagacgaagcagactactactgcggaacatgggactcatcactatcagcaggaggagtattcggaacaggaacaaaagtaacagtacta

SEQ ID NO: 47340 - RNA, 333 nt, synthetic construct
  misc_feature 1..333: note = derived and/or modified sequence opt6 from anti-HIV-1_LightChain
  source 1..333: mol_type = other RNA
caaagtctactaacacaaccaccatcagtatcagcagcaccaggacaaaaagtaacaatatcatgcagcggatcatcatcaaatataggaaacaacttcgtatcatggtaccaacaactaccaggaacagcaccaaaactattaatatacgaaaataacatgagaccatcaggaataccagacagattctcaggatcaaaatcaggaacatcagcaacactaggaataacaggactacaaacaggagacgaagcagactactactgcggaacatgggactcatcactatcagcaggaggagtattcggaacaggaacaaaagtaacagtacta

SEQ ID NO: 47341 - RNA, 333 nt, synthetic construct
  misc_feature 1..333: note = derived and/or modified sequence opt6 from anti-HIV-1_LightChain
  source 1..333: mol_type = other RNA
caatcagtactaacacaaccaccatcagtatcagcagcaccaggacaaaaagtaacaatatcatgctcaggaacatcatcaaacatagcaaactactacgtatcatggtacagacaactaccaggaacagcaccaaaattactaatatacgaaaacaacaaaagaccatcaggaataccagacagattcagcggatcaaaatcaggaacatcagcaacattaggaataacaggactccaaacaggagacgaagcagactactactgcggaacatgggactcatcactatcagcaggaggagtattcggaacaggaacaaaagtaacagtacta

SEQ ID NO: 47342 - RNA, 333 nt, synthetic construct
  misc_feature 1..333: note = derived and/or modified sequence opt6 from anti-HIV-1_LightChain
  source 1..333: mol_type = other RNA
caaccagtattaacacaaccaccaagcgtaagcggagcaccaggacaaagagtaacaataagctgtagcggaagcagcagcaatataggaaacaatgacgtaagctggtaccaacaagtaccaggaacagcaccaaaattattaatatatgaaaataacaaaagaccaagcggaataccagacagattctcaggatcaaaatcaggaacaagcgcaacattaggaataacaggactacaaacaggagacgaagcagattactattgcggaacatgggacacatcattaagcgcaggaggagtatttggaacaggaacaaaagtaacagtacta

SEQ ID NO: 47343 - RNA, 333 nt, synthetic construct
  misc_feature 1..333: note = derived and/or modified sequence opt6 from anti-HIV-1_LightChain
  source 1..333: mol_type = other RNA
caattagtattaacacaaccaccatcagtatcagcagcaccaggacaaagagtaacaatatcatgtttcggatcaagattcaatgtaggaacatcatcagtatcatggtaccaacaattaccaggaacagcaccaaaactattaatagatgcaaatggagaaagaccatcaggaataccagacagattctttggatcagaatcaggaacatcagcaacattaggaataacaggactacaaacaggagacgaagcagattactattgcggaacatggcactcatcattatcagcaggaggagtatttggaacaggaacaaaagtaacagtacta

SEQ ID NO: 47344 - RNA, 333 nt, synthetic construct
  misc_feature 1..333: note = derived and/or modified sequence opt6 from anti-HIV-1_LightChain
  source 1..333: mol_type = other RNA
tcatacgaactaacacaaccaccatcagtatcagcagcaccaggacaaaaagtaacaatatcatgctcaggatcatcatcaaacataggaaacaactacgtatcatggtaccaacaactaccaggaacagcaccaaaactactaatatacgaaaacaacaaaagaccatcaggaataccagacagattctcaggatcaaaatcaggaacatcagcaacactaggaataacaggactacaaacaggagacgaagcagactactactgcggaacatgggacacatcactatcagcaggaggagtattcggaacaggaacaaaagtaacagtacta

SEQ ID NO: 47345 - RNA, 333 nt, synthetic construct
  misc_feature 1..333: note = derived and/or modified sequence opt6 from anti-HIV-1_LightChain
  source 1..333: mol_type = other RNA
caatcagtattaacacaaccaccatcagcatcaggaacaccaggacaaagagtaacaatatcatgtagcggatcaacatcaaatataggaacatattacgtatcatggtaccaacaattaccaggaacagcaccaaaactattaatatatgaaaatacaaaaagaccatcaggaataccagacagattctcaggatcaaaatcaggaacatcagcaacattaggaataaccggactacaaacaggagacgaaggagactactattgcggaacatgggacagatcattatcagcaggaggagtatttggaacaggaacaaaagtaacagtacta

SEQ ID NO: 47346 - RNA, 336 nt, synthetic construct
  misc_feature 1..336: note = derived and/or modified sequence opt6 from anti-HIV-1_LightChain
  source 1..336: mol_type = other RNA
caatcagcactaacacaaccagcatcagtatcagcatcaccaggacaatcaatagcaatatcatgcacaggaacatcatcagacgtaggctcatacaactacgtatcatggtaccaacaattaccaggaacagcacccaaactactaatatacgaaaacacaaaaagaccaagtggaataccagacagattctcaggatcaaaatcaggaacatcagcaacactaggaataacaggactacaaacaggagacgaagcagactactactgcggaacatgggacagatcactatcagcaggaggagtattcggaacaggaacaaaagtaacagtacta

SEQ ID NO: 47347 - RNA, 330 nt, synthetic construct
  misc_feature 1..330: note = derived and/or modified sequence opt6 from anti-HIV-1_LightChain
  source 1..330: mol_type = other RNA
caatcagtattaacacaaccaccatcagtatcagcagcaccaggacaaagagtaacaatatcatgctcaggaggatcatcaaatataggaaacaatcacgtatcatggtaccaacacctaccaggaagagcaccacaactactaatatatgacacaacacaaagaccatcaggaataccagacagattctcaggatcaaaatcaggaacatcagcaacattaggaataacaggactacaaacaggagacgaagcagactactactgcggaacatgggactcatcactatcaacaggaggagtattcggaacaggaacaaaagtaacagta

SEQ ID NO: 47348 - RNA, 333 nt, synthetic construct
  misc_feature 1..333: note = derived and/or modified sequence opt6 from anti-HIV-1_LightChain
  source 1..333: mol_type = other RNA
caatcagtattaacacaaccaccaagcgcaagcggaacaccaggacaaagagtaacaataagctgtagcggaagctcaagcaatataggaagcaaatacgtatgctggtaccaacaattaccaggaacagcaccaaaactattaatatatagaaataaccaaagaccaagcggaataccagacagattctcaggatcaaaatcaggaacaagcgcaacattaggaataacaggactacaaacaggagacgaagcagattactattgcggaacatggcacagctcattaagcgcaggaggagtatttggaacaggaacaaaagtaacagtacta

SEQ ID NO: 47349 - RNA, 333 nt, synthetic construct
  misc_feature 1..333: note = derived and/or modified sequence opt6 from anti-HIV-1_LightChain
  source 1..333: mol_type = other RNA
caatcagtattaacacaaccaccaagcgtaagcgcagcaccaggacaaaaagtaacaataagctgtagcggagactcaagcacattcgaaaacgattacgtatgctggtaccaacaattaccaggaacagcaccaaaactattaatatatgacaataacaaaagaccaagcggaataccagacagattctcaggatcaaaatcaggaacaagtgcaacattaggaataacaggactacaaacaggagacgaagcagattactactgcggaacatggcacagctcattaagcgcaggaggagtatttggaacaggaacaaaagtaacagtacta

SEQ ID NO: 47350 - RNA, 333 nt, synthetic construct
  misc_feature 1..333: note = derived and/or modified sequence opt6 from anti-HIV-1_LightChain
  source 1..333: mol_type = other RNA
caatcagtactaacacaaccaccatcagtatcagcagcaccaggacaaaaagtaacaatatcatgctcaggatcatcatcaaacataggaaacaactacgtatcatggtaccaacaactaccaggaacagcaccaaaactattaatatacggaaactcaaacagaccatcaggagtaccagacagattctcaggatcaaaatcaggaacatcagcatcactagcaataacaggactacaagcagaagacgaagcagactactactgcggaacatgggactcatcactatcagcaggaggagtattcggaacaggaacaaaagtaacagtacta

SEQ ID NO: 47351 - RNA, 333 nt, synthetic construct
  misc_feature 1..333: note = derived and/or modified sequence opt6 from anti-HIV-1_LightChain
  source 1..333: mol_type = other RNA
caatcagtattaacacaaccaccaagcgtaagcgcagcaccaggacaaacagtaacaataagctgtagcggaagctcaagtaatataggaagcaatacagtaaactggtaccaacaattaccaggaacagcaccaaaactattaatatatgaaaataacaaaagaccaagcggaataccagacagattctcaggatcaaaatcaggaacaagcgcaacattaggaataacaggactacaaacaggtgacgaagcagattactattgcggaacatgggacaatagcttaagcacaggaggagtatttggaacaggaacaaaagtaacagtacta

SEQ ID NO: 47352 - RNA, 336 nt, synthetic construct
  misc_feature 1..336: note = derived and/or modified sequence opt6 from anti-HIV-1_LightChain
  source 1..336: mol_type = other RNA
caaagcgtactaacacaaccaccatcagtatcaggagcaccaggacaaagagtaacaatattttgcacaggatcaagttcaaacgtaggaggaggatatgacgtacactggtaccaacaattaccaggaacagcaccaaaactactaatatatgaaaataacaaaagaccaagcggaataccagacagattctcaggatcaaaatcaggaacaagcgcaacattaggaataacaggactacaaacaggagacgaagcagattactattgcggaacatgggacagctcattaagcgcaggaggagtatttggaacaggaacaaaagtaacagtacta

SEQ ID NO: 47353 - RNA, 333 nt, synthetic construct
  misc_feature 1..333: note = derived and/or modified sequence opt6 from anti-HIV-1_LightChain
  source 1..333: mol_type = other RNA
caatcagtactaacacaaccaccatcagtatcagcagcaccaggacaaaaagtaacattatcatgttcaggatcatcatcaaacataggaaacaattcagtatcatggtaccaacaattcccaggaacagcaccaaaactattaatatacgactcagacaaaagaccatcaggaataccagacagattctcaggatcaaaatcaggaacatcagcaacactaggaataacaggactacaaacaggagacgaaggagactactactgcggaacatgggacagatcactatcagcaggaggagtattcggaacaggaacaaaagtaacagtacta

SEQ ID NO: 47354 - RNA, 333 nt, synthetic construct
  misc_feature 1..333: note = derived and/or modified sequence opt6 from anti-HIV-1_LightChain
  source 1..333: mol_type = other RNA
caaagtgtactaacacaaccaccatcagcatcaggaacaccaggacaaaaagtaacaatatcatgctcaggatcatcatcacaaataggatcaaactcagtatactggtaccaacaactaccaggaacaacaccaaaattactaatatacggaaacaaccaaagaccatcaggaataccagacagattctcaggatcaaaatcaggaacatcagcaacactaggaataacaggactacaaacaggagacgaagccgactactactgcggaacatgggactcatcactatcagcaggaggagtattcggaacaggaacaaaagtaacagtacta

SEQ ID NO: 47355 - RNA, 336 nt, synthetic construct
  misc_feature 1..336: note = derived and/or modified sequence opt6 from anti-HIV-1_LightChain
  source 1..336: mol_type = other RNA
caaagcgcactaacacaaccagcatcagtatcaggatcaccaggacaatcaataacaatatcatgcacaggaacaggatcagacgtaggaggatacaatcacgtaagctggtaccaacaacatccaggaaaagcaccaaaactattaatatatgacaataacaaaagaccaagcggaataccagacagattctcaggatcaaaatcaggaacaagcgcaacattaggaataacaggactacaaacaggagacgaagcagattactattgcggaacatggcacagctcattaagcgcaggaggagtatttggaacaggaacaaaagtaacagtacta

SEQ ID NO: 47356 - RNA, 333 nt, synthetic construct
  misc_feature 1..333: note = derived and/or modified sequence opt6 from anti-HIV-1_LightChain
  source 1..333: mol_type = other RNA
caatcagtactaacacaaccaccatcagtatcagcagcaccaggacaaagagtaacaatatcatgttcaggatcaggatcaaatataggagacagattcgtatcatggtaccaacacttaccaggaacagtaccaaaactattaatatacgacaatgaacatagaccatcaggaataccagacagattctcaggatcaaaatcaggaacatcagcaacactaggaataacaggactacaaacaggagacgaagcagattactactgcggaacatgggactcatcactatcagcaggaggagtattcggaacaggaacaaaagtaacagtacta

SEQ ID NO: 47357 - RNA, 333 nt, synthetic construct
  misc_feature 1..333: note = derived and/or modified sequence opt6 from anti-HIV-1_LightChain
  source 1..333: mol_type = other RNA
caatcagtactaacacaaccaccatcagtatcagcagcaccaggacaaaaaataacaatatcatgctcaggatcatcatcaaacataggaaaatcagtagtatcatggtacagacaattcccaggaacagcaccaaaactactaatatacgacacatacaaaagaccatcaggaataccagacagattctcaggatcaaaatcaggaacatcagcaacactaggaataacaggactacaaacaggagacgaagcagactactactgcggaacatggcactcatcactatcagcaggaggagtattcggaacaggaacaaaagtaacagtacta

SEQ ID NO: 47358 - RNA, 333 nt, synthetic construct
  misc_feature 1..333: note = derived and/or modified sequence opt6 from anti-HIV-1_LightChain
  source 1..333: mol_type = other RNA
caaccagtattaacacaaccaccatcagcatcaggaacaccaggacaaagagtaacaatatcatgttcaggatcatcatcaaatataggaggaaatacagtaaactggtaccaacaatttccaggagcagcaccaagactattaatatatgaagataacaaaagaccatcaggaataccagacagattctcaggaagtaaatcaggaacaagcgcaacattaggaataacaggactacaaacaggagacgaagcagattactattgcggaacatgggactcatcattatcagcaggaggagtatttggaacaggaacaaaagtaacagtacta

SEQ ID NO: 47359 - RNA, 333 nt, synthetic construct
  misc_feature 1..333: note = derived and/or modified sequence opt6 from anti-HIV-1_LightChain
  source 1..333: mol_type = other RNA
aacttcatgctaacacaaccacactcagtatcagaatcaccaggaaaaacagtaacaatatcatgcacaagatcatcaggatcagtagcatcaaactacgtacaatggtaccaacaactaccaggaacagcaccaaaactactaatatacgaaaacaacaaaagaccatcaggaataccagacagattctcaggatcaaaatcaggaacatcagcaacattaggaataacaggactacaaacaggagacgaagcagactactactgcggaacatggcactcatcactatcagcaggaggagtattcggaacaggaacaaaagtaacagtacta

SEQ ID NO: 47360 - RNA, 333 nt, synthetic construct
  misc_feature 1..333: note = derived and/or modified sequence opt6 from anti-HIV-1_LightChain
  source 1..333: mol_type = other RNA
caatcaatgttaacacaaccaccatcagtatcagcagcaccaggacaaagagtaacagtatcatgttcaggatcatcatcaaatataggatcacatttcgtatcatggtaccaacaattaccaggaacagcaccaaaactattaatatatgacaattcaaatagaccatcagcaataccagacagattctcaggatcaaaatcaggaacatcagcaacattaggaatatcaggactacatacaggagacgaagcagattactattgcgcaacatgggacaattcattatcaacaggaggagtatttggaacaggaacaaaagtaacagtacta

SEQ ID NO: 47361 - RNA, 333 nt, synthetic construct
  misc_feature 1..333: note = derived and/or modified sequence opt6 from anti-HIV-1_LightChain
  source 1..333: mol_type = other RNA
caatcagtattaacacaaccaccaagcgtaagtgcagcaccaggacaaaaagtaataataagttgtagtggaggatcaagcaatataggaaacaatttcgtaagctggtaccatcaattaccaggaacagcaccaaaactattaatatatgaaaatacaaaaagaccaagcaaaataccagcaagattctcaggatcaaaatcaggaacaagcgcaacattaggaataacaggactacaaacaggagacgaagcagattactattgcggaacatgggacagtagcttaagtgcaggaggagtatttggaacaggcacaaaagtaacagtatta

SEQ ID NO: 47362 - RNA, 315 nt, synthetic construct
  misc_feature 1..315: note = derived and/or modified sequence opt6 from anti-HIV-1_LightChain
  source 1..315: mol_type = other RNA
caatcactactaacacaaccaccatcagtatcagcagcaccaggacaaaaagtaacaatatcatgctcaggatcatcatcaaacataggaaacaactacgtatcatggtaccaacaactaccaggaacagcaccaaaactattaatatacgaaaacaacaaaagaccatcaggaataccagacagattctcaggatcaaaatcaggaacatcagcaacactaggaataacaggactacaaacaggagacgaagcagactactactgcggaacatgggactcatcactatcagcaggaggagtattcggaacagga

SEQ ID NO: 47363 - RNA, 336 nt, synthetic construct
  misc_feature 1..336: note = derived and/or modified sequence opt6 from anti-HIV-1_LightChain
  source 1..336: mol_type = other RNA
caaagcgcactaacacaaccagcaagcgtatcaggatcaccaggacaatcaataacaatatcatgcacaggaacaagctcagacataggatcatactcattcgtaagctggtaccaacaacatccaggaaaagcaccaaaactaataatatatgacgtaaacaaaagaccaagcggaataccagacagattctcaggatcaaaatcaggaacaagcgcaacattaggaataacaggattacaaacaggagacgaagcagactactattgcggaacatgggacagatcattaagcgcaggaggagtatttggaacaggaacaaaagtaacagtacta

SEQ ID NO: 47364 - RNA, 336 nt, synthetic construct
  misc_feature 1..336: note = derived and/or modified sequence opt6 from anti-HIV-1_LightChain
  source 1..336: mol_type = other RNA
caaagtgtactaacacaaccaccatcagtatcaggagcaccaggacaaagagtaacaatatcatgtacaggaaatagttcaaatataggagcaggatttgacgtacactggtacagacatctaccaggaacagcaccaaaactattaatatatgaaaatacaaaaagaccaagtggaataccagacagattctcaggatcaaaatcaggaacaagtgcaacattaggaataacaggattacaaacaggagacgaagcagattactattgcggaacatgggacagaagcctaagtgcaggaggagtatttggaacaggaacaaaagtaacagtacta

SEQ ID NO: 47365 - RNA, 333 nt, synthetic construct
  misc_feature 1..333: note = derived and/or modified sequence opt6 from anti-HIV-1_LightChain
  source 1..333: mol_type = other RNA
caatcagtattaacacaaccaccatcagtatcagcagcaccaggacaaaaagtaacaatatcatgctcaggaggatcatcaaacataggaaactactacgtatcatggtacctacaactaccaggagcagcaccaaaactactaatatacgacacagacaaaagaccatcaggaataccagacagattctcaggatcaaaatcaggaacatcagcaacactaggaataacaggactacaaacaggagacgaagcagactactactgcggaacatgggacagatcactatcagcaggaggagtattcggaacaggaacaaaagtaacagtacta

SEQ ID NO: 47366 - RNA, 333 nt, synthetic construct
  misc_feature 1..333: note = derived and/or modified sequence opt6 from anti-HIV-1_LightChain
  source 1..333: mol_type = other RNA
caatcagtactaacaagaccaccatcagtatcagcagcaccaggacaaaaagtaacaatatcatgctcaggaagatcatcaaatataggaaacaactacgtatcatggtaccaacaactaccaggagcagcaccaaaactactaatatacgaaaacaacaaaagaccatcaggaataccagacagattctcaggatcaaaatcaggaacatcagcaacactaggaataacaggactacaaacaggagacgaagcagactactactgcggaacatgggactcatcactatcagcaggaggagtattcggaacaggaacaaaagtaacagtacta

SEQ ID NO: 47367 - RNA, 333 nt, synthetic construct
  misc_feature 1..333: note = derived and/or modified sequence opt6 from anti-HIV-1_LightChain
  source 1..333: mol_type = other RNA
caatcagtactaacacaaccaccatcagtatcagcagcaccaggacaaaaagtaacaatatcatgctcaggaacaatatcaaacataggagcaaacttagtatcatggtacagacaactaccaggaacagtaccaacagtactaatacacgaaaacaacaaaagaccatcaggaataccagacagattcagcggatcaaaatcaggaacatcagcaacactaggaataacaggactacaaacaggagacgaagcagactactactgcggaacatggcactcatcattatcagcaggaggagtattcggaacaggaacaaaagtaacagtacta

SEQ ID NO: 47368 - RNA, 327 nt, synthetic construct
  misc_feature 1..327: note = derived and/or modified sequence opt6 from anti-HIV-1_LightChain
  source 1..327: mol_type = other RNA
caatcagtactaacacaaccaccatcagtatcagcagcaccaggacaaaaagtaacaatatcatgctcaggatcatcatcaaacataggaaacaacttcgtatcatggtaccaacaactaccaggaacagcaccaaaactactaatatacgaaaacacaaaaagaccatcaggaataccagacagattctcaggatcaaaaagcggaacatcagcaacactaggaataacaggactacaaacaggagacgaagcagactactactgcggaacatgggacagatcactatcagcaggaggagtattcggaacaggaacaaaagtaaca

SEQ ID NO: 47369 - RNA, 333 nt, synthetic construct
  misc_feature 1..333: note = derived and/or modified sequence opt6 from anti-HIV-1_LightChain
  source 1..333: mol_type = other RNA
caatcagtattaacacaaagcccaagcgtaagtgcagcaccaggacaaagagtaacaatatcatgtagcggaggatcaagcaatataggaagcaatgcagtaagctggtaccaacaattaccaggaacagcaccaaaactattaatatatggagatacaatgagaccaagcggaataccagacagattctcaggatcaaaatcaggaacaagcgcaacattaggaataacaggactacaaacaggagacgaagcagattactattgcggaacatgggacagaagtttaagcgcaggaggagtatttggaacaggaacaaaagtaacagtacta

SEQ ID NO: 47370 - RNA, 333 nt, synthetic construct
  misc_feature 1..333: note = derived and/or modified sequence opt6 from anti-HIV-1_LightChain
  source 1..333: mol_type = other RNA
caatcagtactaacacaaccaccatcagtatcagcagcaccaggacaacaagtaacaatatcatgctcaggaacaacatcaaacataggaacaaactacgtatcatggtaccaacaaatgccaccagcagcaccaaaactactaatatacgacaacaaaaaaagaccatcagacataccagacagattctcaggatcaaaatcaggaacatcagcaacactaggaataacaggactacaaacaggagacgaagcagactactactgcggaacatgggacagatcactatcagcaggaggagtattcggaacaggaacaaaagtaacagtccta

SEQ ID NO: 47371 - RNA, 333 nt, synthetic construct
  misc_feature 1..333: note = derived and/or modified sequence opt6 from anti-HIV-1_LightChain
  source 1..333: mol_type = other RNA
caatcagtagtaacacaaagcccaagcgcaagcggaacaccaggacaaagagtaataataagctgtagcggaagctcaagcaatataggaaacatatacgtaagctggtaccaacaattaccaggaacagcaccaaaactattaatatatgaaaataacaaaagaccaagcggaataccagacagattctcaggatcaaaatcaggaacatcagcaacattaggaataacaggactacaaacaggagacgaagcagattactattgcggaacatggcacagctcattaagcgcaggaggagtatttggaacaggaacaaaagtaacagtacta

SEQ ID NO: 47372 - RNA, 333 nt, synthetic construct
  misc_feature 1..333: note = derived and/or modified sequence opt6 from anti-HIV-1_LightChain
  source 1..333: mol_type = other RNA
caaagcgtattaacacaaccaccaagcatgagcgcagcaccaggacaaaaagtaacaataagctgtagcggaagcacaagcataataggaaacaattacataagctggtaccaacaattaccaggaacagcaccaaaactattaatatatgaagataacaaaagaccaagcggaataccagacagattctcaggatcaaaatcaggaacaagcgcaacattaggaataacaggactacaaacaggagacgaagcagattactattgcggaacatgggacagatcattaagcgcaggaggagtatttggaacaggaacaaaagtaacagtacta

SEQ ID NO: 47373 - RNA, 336 nt, synthetic construct
  misc_feature 1..336: note = derived and/or modified sequence opt6 from anti-HIV-1_LightChain
  source 1..336: mol_type = other RNA
caaagcgcactaacacaaccaccatcagcatcaggatcaagaggacaatcagtaataatatcatgcacaggaacaagctcagacgtaggagtatacaatctagtaagctggtaccaacaattaccaggaacagcaccaaaactattaatatatgaaaataacaaaagaccaagcggaataccagacagattctcaggatcaaaatcaggaacaagcgcaacattaggaataacaggattacaaacaggagacgaagcagattactattgcggaacatggcactcaagtttaagcgcaggaggagtatttggaacaggaacaaaagtaacagtactc

SEQ ID NO: 47374 - RNA, 333 nt, synthetic construct
  misc_feature 1..333: note = derived and/or modified sequence opt6 from anti-HIV-1_LightChain
  source 1..333: mol_type = other RNA
caatcagtattaacacaaccaccaagtatgagcgcagcaccaggacaaagcgtaagtataagctgtagcggaagctcagacaatatagaaagaaatcaagtaatatggctaagacaagtaccaggagcagcaccaacagtattaataatattcaataacagaagaccaagcggagtaccagacagattctcaggatcaagatcaggaacaagcgcaacattaggaataacagggctacaaacaggagacgaagcagattactattgcggaacatgggacagaagtttaagcgcaggaggagtatttggaacaggaacaaaagtaacagtacta

SEQ ID NO: 47375 - RNA, 333 nt, synthetic construct
  misc_feature 1..333: note = derived and/or modified sequence opt6 from anti-HIV-1_LightChain
  source 1..333: mol_type = other RNA
caatcagtactaacacaaccaccatcagtatcagcagcaccaggacaaacagtaacaatatcatgctcaggatcattctcaaacatagaaacaaactacgtatcatggtaccaacaactaccaggaaccgcaccaaaactattaatatacgaaaacacaaaaagaccatcaggaataccagacagattctcaggatcaaaatcaggaacatcagcaacactaggaataacaggactacaaacaggagacgaagcagactactactgcggaacatgggacagatcactatcagcaggaggagtattcggaacaggaacaaaagtaacagtacta

SEQ ID NO: 47376 - RNA, 333 nt, synthetic construct
  misc_feature 1..333: note = derived and/or modified sequence opt6 from anti-HIV-1_LightChain
  source 1..333: mol_type = other RNA
caatcattactaacacaaccaccatcagtatcagcagcaccaggacaaaaagtaacaataagttgctcaggatcatcatcaaacataggatcaaaatacgtatgctggtaccaacaattaccaggaacagcaccaaaactactaatatacgaaaacacaaaaagaccatcaggaataccagacagattctcaggatcaaaatcaggaacatcagcaacattaggaataacaggactacaaacaggagacgaagcagactactactgcggaacatgggacagatcactatcagcaggaggagtattcggaacaggaacaaaagtaacagtacta

SEQ ID NO: 47377 - RNA, 336 nt, synthetic construct
  misc_feature 1..336: note = derived and/or modified sequence opt6 from anti-HIV-1_LightChain
  source 1..336: mol_type = other RNA
caaagcgcactaacacaaccaagatcagtatcaggatcaccaggacaatcagtaacaatatcatgcacaggaacaacatcagacgtaggaggatacaattacgtaagctggtaccaacaattaccaggaacagcaccaaaactattaatatatgaaaataacaaaagaccaagcggaataccagacagattctcaggatcaaaatcaggaacaagcgcaacattaggaataacaggactacaaacaggagacgaagcagattactattgcggaacatgggacaatagcttaagcacaggaggagtatttggaacaggaacaaaagtaacagtacta

SEQ ID NO: 47378 - RNA, 333 nt, synthetic construct
  misc_feature 1..333: note = derived and/or modified sequence opt6 from anti-HIV-1_LightChain
  source 1..333: mol_type = other RNA
caatcagtattaacacaaccaccaagcgtaagcgcagcaccaggacaaagagtaacaataagctgtacaggattcacaagcaatataggattaaattacgtaagctggtaccaacaagtaccaggaacaacaccaaaattagtaatatttgaaaatgacagaagatttctaggaataccagacagattctcaggatcaaaatcaggagcaagcgcaacactaggaataacaggactacaaacaggagacgaagcagattactattgcggaacatgggactcaagcctaagcgcaggaggagtatttggaacaggaacaaaagtaacagtatta

SEQ ID NO: 47379 - RNA, 333 nt, synthetic construct
  misc_feature 1..333: note = derived and/or modified sequence opt6 from anti-HIV-1_LightChain
  source 1..333: mol_type = other RNA
caatcagtactagcacaaccaccatcagtatcagcagcaccaggacaaaaagtaacaatatcatgctcaggaagaacatcaaacataggaaacaactacgtatcatggtaccaacaactaccaggaacagcaccaaaactactaatatacgaaaacaacaaaagaccatcaggaataccagacagattctcaggatcaaaatcaggaacatcagcaacactaggaataacaggactacaaacaggagacgaagcagactactactgcggaacatgggacacaagcctatcagcaggaggagtattcggaacaggaacaaaagtaacagtacta

SEQ ID NO: 47380 - RNA, 333 nt, synthetic construct
  misc_feature 1..333: note = derived and/or modified sequence opt6 from anti-HIV-1_LightChain
  source 1..333: mol_type = other RNA
caatcagtactaacacaaccaacatcagtatcagcagcaccaggaagatgggtaacagtatcatgctcaggaacaagatcaaatataggagaccacagcgtatcatggttccaacacctaccaggagcagcaccaaaattactaatatacgaaaacaacaaaagaccatcaggaataccagacagattctcaggatcaaaatcaggaacatcagcaacactaggaataacaggactacaaacaggagacgaagcagactactactgcggaacatgggactcatcactatcaacaggaggagtattcggaacaggaacaaaagtaacagtatta

SEQ ID NO: 47381 - RNA, 333 nt, synthetic construct
  misc_feature 1..333: note = derived and/or modified sequence opt6 from anti-HIV-1_LightChain
  source 1..333: mol_type = other RNA
caatcagtactaacacaaccaccatcagtatcagcagcaccaggacaaaaagtaacaatatcatgctcaggatcatcatcaaacataggagacaactacgtatcatggtaccaacaattcccaggaacagcaccaaaactactaatatcagaaaacaacaaaagaccatcaggaataccagacagattctcaggatcaaaatcaggaacatcagcaacactaggaataacaggactacaaacaggagacgaagcagactactactgcggaacatgggactcatcactatcagcaggaggagtattcggaacaggaacaaaagtaacagtacta

SEQ ID NO: 47382 - RNA, 333 nt, synthetic construct
  misc_feature 1..333: note = derived and/or modified sequence opt6 from anti-HIV-1_LightChain
  source 1..333: mol_type = other RNA
caagcactactaacacaaccaccatcagtatcagcagcaccaggacaaaaagtaacaatatcatgctcaggatcatcatcaaacataggaaacaactatgtatcatggtaccaacaactaccaggaacagcaccaaaactattaatatcagaaaacaacaaaagaccatcaggaataccagacagattctcaggatcaaaatcaggaacatcagcaacactaggaataacaggactacaaacaggagacgaagcagactactactgcggaacatgggacacatcactatcagcaggaggagtattcggaacaggaacaaaagtaacagtacta

SEQ ID NO: 47383 - RNA, 333 nt, synthetic construct
  misc_feature 1..333: note = derived and/or modified sequence opt6 from anti-HIV-1_LightChain
  source 1..333: mol_type = other RNA
caactagtactaacacaaccaccatcagcatcaggaacaccaggacaaagagtaacaatatcatgctcaggatcaacatcaaacataggaacatactacgtatactggtaccaactactaccaggaacaacaccaaaagtactaatatacgcaaacgaccaaaggccatcaggaataccagacagattctcaggatcaaaatcaggaacaagcgcaacactaggaataaccggactacaaacaggagacgaagcagactactactgcggaacatgggactcatcactatcaacaggaggagtattcggaacaggaacaaaagtaacagtacta

SEQ ID NO: 47384 - RNA, 333 nt, synthetic construct
  misc_feature 1..333: note = derived and/or modified sequence opt6 from anti-HIV-1_LightChain
  source 1..333: mol_type = other RNA
caaagcgtattaacacaaccaccaagcgtaagcgcagcaccaggacaaaaagtaacaataagttgtagcggaacatcaagcaatataggaaacaatttcgtaagctggtaccaaagattaccaggaacagcaccaaaactattaatatttgaaaatgacaaaagaccaagcggaataccagacagattctcaggatcaaaatcaggaacaagtgcaacattaggaataacaggactacaaacaggagacgaagcagattactattgcggaacatgggacagatcattaagcgcaggaggagtatttggaacaggaacaaaagtaacagtacta

SEQ ID NO: 47385 - RNA, 333 nt, synthetic construct
  misc_feature 1..333: note = derived and/or modified sequence opt6 from anti-HIV-1_LightChain
  source 1..333: mol_type = other RNA
caatcagtattaacacaaagcccaagcgtaagtgcaacaccaggacaaagagtaacaataagctgtagcggaaacacaagcaatataggaaaaaatttcgtaagctggtaccaacaatttccaggaacagcaccaaaattattaatatatgacaatgacaaaagaccaagcggaataccagacagattctcaggatcaaaatcaggaacaagtgcaacattaggaataacaggactacaaacaggagacgaagcagattactattgcggaacatgggactcaagcttaagcgcaggaggagtatttggaacaggaacaaaagtaacagtacta

SEQ ID NO: 47386 - RNA, 333 nt, synthetic construct
  misc_feature 1..333: note = derived and/or modified sequence opt6 from anti-HIV-1_LightChain
  source 1..333: mol_type = other RNA
caatcagtattaacacaaccaccatcagtatcagcagcaccaggaagagaagtaataatatcatgctcaggatcatcatcaaacataggaaacaaccacgtatcatggtaccaacaactaccaggaacagcaccaaaagtactaatatacgaatcaaacaaaagacactcaggaataccagacagattctcaggatcaaaatcaggaacatcagcaacactagcaataacaggactacaaacaggagacgaagcagactactactgcggagcatgggactcatcactaagcgcaggaggagtattcggcacaggaacaaaagtaacagtacta

SEQ ID NO: 47387 - RNA, 333 nt, synthetic construct
  misc_feature 1..333: note = derived and/or modified sequence opt6 from anti-HIV-1_LightChain
  source 1..333: mol_type = other RNA
caaagcgtactaacacaaccaccatcagcaagcggaacaccaggacaaagagtaacaataagctgtagcggaagctcaagtaatataggagactcaacagtaaactggtaccaacaattaccaggaacagcacccaaactattaatatatgaaaatacaaaaagaccaagcggaataccagacagattctcaggatcaaaatcaggaacaagcgcaacattaggaataacaggactacaaacaggagacgaagcagattactattgcggaacatgggacagatcattaagcgcaggaggagtatttggaacaggaacaaaagtaacagtacta

SEQ ID NO: 47388 - RNA, 333 nt, synthetic construct
  misc_feature 1..333: note = derived and/or modified sequence opt6 from anti-HIV-1_LightChain
  source 1..333: mol_type = other RNA
caatcagtactaacacaaccaccatcagtatcagcagcaccaggacaaaaagtaacaatatcatgctcaggatcaacatcaaacataggaaacaactacgtatcatggtaccaacaactaccaggaacagcaccaaaactactaatatacgaaaacaacagacaaccatcaggaataccagacagattctcaggatcaaaatcaggaacatcagcaacactaggaataacaggactacaaacaggagacgaaggagactactactgcggaacatgggacagatcactatcagcaggaggagtattcggaacaggaacaaaagtaacagtacta

SEQ ID NO: 47389 - RNA, 333 nt, synthetic construct
  misc_feature 1..333: note = derived and/or modified sequence opt6 from anti-HIV-1_LightChain
  source 1..333: mol_type = other RNA
caatcagtattaacacaaccaccatcagtatcagcagcaccaggacaaaaagtaacaatatcatgctcaggatcatcatcaaatataggatcaaactacgtatcatggtaccaacaactaccaggaacagcaccaaaactattaatatatgaaaacaacaaaagaccatcaggaataccagacagattctcaggatcaaaatcaggaacatcagcaacactaggaataacaggactacaaacaggagacgaagcagtatactactgcggaacatgggactcatcactaacagcaggaggagtattcggatcaggaacaaaagtaacagtacta

SEQ ID NO: 47390 - RNA, 336 nt, synthetic construct
  misc_feature 1..336: note = derived and/or modified sequence opt6 from anti-HIV-1_LightChain
  source 1..336: mol_type = other RNA
caaagtgtactaacacaaccaccatcagtatcaggagcaccaggacaaagagtaacaatatcatgcataggatcaagctcaaacataggagcagactatagagtacactggtaccaacaattaccaggaacagcaccaaaactattaatatatgaaaataacaaaagaccaagtggaataccagatagattctcaggatcaaaatcaggaacaagcgcaacattaggaataacaggactacaaacaggagacgaagcagattactattgcggaacatgggacagctcattaagcacaggaggagtatttggaacaggaacaaaagtaacagtacta

SEQ ID NO: 47391 - RNA, 336 nt, synthetic construct
  misc_feature 1..336: note = derived and/or modified sequence opt6 from anti-HIV-1_LightChain
  source 1..336: mol_type = other RNA
caaagcgtactaacacaaccaccaagcgtatcaggagcaccaggacaaagaataacagtatcatgcacaggaacaagctcaaacataggagcaccatatgacgtaaactggtaccaacaattaccaggaacagcaccaaaactattaatatatgaaaatacaaaaagaccaagcggaataccagacagattctcaggatcaaaatcaggaacaagcgcaacattaggaataacaggactacaaacaggagacgaagcagattactattgcggaacatgggacagatcattaagcgcaggaggagtatttggaacaggaacaaaagtaacagtacta

SEQ ID NO: 47392 - RNA, 333 nt, synthetic construct
  misc_feature 1..333: note = derived and/or modified sequence opt6 from anti-HIV-1_LightChain
  source 1..333: mol_type = other RNA
caatcagtactaacacaaccaccagcaatgagtgcagcaccaggacaaagcgtaacaatatcatgtagcggaagcgcattcaatatagaaagacatcaagtaacatggctaagacacttaccaggaacagcaccaacaagtgtaataataatgaataaccaaagaccaagcggagtaccagacagattctcaggatcacgatcaggaacaagcgcaacattaggaataacaggactacaaacaggagacgaaggagattactattgcggaacatgggacagaagtttaagcgcaggaggagtatttggaacaggaacaaaagtaacagtacta

SEQ ID NO: 47393 - RNA, 333 nt, synthetic construct
  misc_feature 1..333: note = derived and/or modified sequence opt6 from anti-HIV-1_LightChain
  source 1..333: mol_type = other RNA
caaagcgtattagcacaaccaccaagcgcaagcggaacaccaggacaaagagtaacaataagctgtagcggaagcgcaagtaatataggattcaatagcgtaacatggtaccaacaattaccaggaacagcaccaacagtattaatatatggaaatgacttaagaccaagcggaataccagacagattctcaggatcaaaatcaggaacaagcgcaacattaggaataacaggactacaaacaggagacgaaggagattactattgcggaacatgggacagatcattaagcgcaggaggagtatttggaacaggaacaaaagtaacagtatta

SEQ ID NO: 47394 - RNA, 336 nt, synthetic construct
  misc_feature 1..336: note = derived and/or modified sequence opt6 from anti-HIV-1_LightChain
  source 1..336: mol_type = other RNA
caaagtgcactaacacaaccagcatcagtatcaggatcaccaggtgaatcaataacaatatcatgcacaggaacaagatctgacataggaaattacgcatacgtaagctggtaccaacaattaccaggaacagcaccaaaactattaatatcagaaaataacaaaagaccaagtggaataccagacagattctcaggatcaaaatcaggaacaagcgcaacattaggaataacaggactacaaacaggagacgaagcagattactattgcggaacatgggacagctcattaagcgcaggaggagtatttggaacaggaacaaaagtaacagtacta

SEQ ID NO: 47395 - RNA, 333 nt, synthetic construct
  misc_feature 1..333: note = derived and/or modified sequence opt6 from anti-HIV-1_LightChain
  source 1..333: mol_type = other RNA
caatcagtactaacacaaccaccatcagtatcagcaccaccaggacaaaaagtaacaatatcatgctcaggaacaacatcaaacataggatcaaactacgtagcatggtaccaacaactaccaggaacagcaccaaaactactaatatacgacaacgacaaaagaccatcaggaataccagacagattctcaggatcaaaatcaggaacatcagcaacactaggaataacaggattacaaacaggagacgaagcagactactactgcggaacatgggacagatcactatcagcaggaggagtattcggaacaggaacaaaagtaacagtacta

SEQ ID NO: 47396 - RNA, 333 nt, synthetic construct
  misc_feature 1..333: note = derived and/or modified sequence opt6 from anti-HIV-1_LightChain
  source 1..333: mol_type = other RNA
caaagcgtattaacacaaagcccaagcgtaagcggaacaccaggacaaagagtaacaatattctgtagcggaagcgatagcgatataggaataaatagcgtaagctggtaccaacaattaccaggaacagcaccaaaactattaatatatgacaataacaaaagaccaagcggaataccagacagattctcaggatcaaaatcaggaacaagtgcaacattaggaataacaggattacaaacaggagacgaagcagattactattgcggaacatgggacagatcattaagcgcaggaggagtatttggaacaggaacaaaagtaacagtacta

SEQ ID NO: 47397 - RNA, 333 nt, synthetic construct
  misc_feature 1..333: note = derived and/or modified sequence opt6 from anti-HIV-1_LightChain
  source 1..333: mol_type = other RNA
caatcagtactaacacaaccaccatcagtatcagcagcaccaggacaaaaagtaacaatatcatgctcaggaaactcatcaaacataggaaacaactacgtctcatggtaccaacacctaccaggaacagcaccaaaactactaatatacgaaaacacaaaaagaccatcaggaataccagacagattctcaggatcaaaatcaggaacatcagcaacactaggaataacaggactacaaacaggagacgaagcagactactactgcggaacatgggacagatcactatcagcaggaggagtattcggaacaggaacaaaagtaacagtacta

SEQ ID NO: 47398 - RNA, 333 nt, synthetic construct
  misc_feature 1..333: note = derived and/or modified sequence opt6 from anti-HIV-1_LightChain
  source 1..333: mol_type = other RNA
caatcactattaacacaaccaccaagcgtaagcgcagcaccaggacaaaaagtaacaataagctgtagcggaggaaatagcgatataggaaaaaatttcgtaagctggtaccaacaattaccaggaacagcaccaaaactattaatatatgaaaataacaaaagaccaagcggaataccagacagattctcaggatcaaaatcaggaacaagcgcaacattaggaataacaggattacaaacaggagacgaagcagattactattgcggaacatgggacaatagcttaagcacaggaggagtatttggaacaggaacaaaagtaacagtacta

SEQ ID NO: 47399 - RNA, 333 nt, synthetic construct
  misc_feature 1..333: note = derived and/or modified sequence opt6 from anti-HIV-1_LightChain
  source 1..333: mol_type = other RNA
caatcagtactaacacaaccaccatcagtatcagcagcaccaggacaaaaagtaataatatcatgctcaggatcatcatcaaacataggaaaaaactacgtagcatggtaccaacaactaccaggaacagcaccaaaactactagtatacgaaaacacaaacagaccctcaggaataccagacagattctcaggatcaaaatcaggaacatcagcaacactaggaataacaggactacaaacaggagacgaagcagactactactgcggaacatgggactcatcattatcagcaggaggagtattcggaacaggaacaaaagtaacagtacta

SEQ ID NO: 47400 - RNA, 333 nt, synthetic construct
  misc_feature 1..333: note = derived and/or modified sequence opt6 from anti-HIV-1_LightChain
  source 1..333: mol_type = other RNA
caatcagtattaacacaaccaccatcagtatcagcagcaccaggacaaaaagtaacaatatcatgttcaggatcaatgtcagatataggactaaacccagtatcatggtacagacaattaccagaagcaccaccacatctattaatatttgacaatgacgaaagaccatcaggaacagcaggaagattctcagcatcaaaatcaggaacatcagcaacattagacataacaggactacaaacaggagacgaagcagattactattgcggaacatgggactcatcattatcagcaggaggagtatttggaacaggaacaaaagtaacagtacta

SEQ ID NO: 47401 - RNA, 336 nt, synthetic construct
  misc_feature 1..336: note = derived and/or modified sequence opt6 from anti-HIV-1_LightChain
  source 1..336: mol_type = other RNA
caatcagcactaacacaaccagcatcagtatcaggatcaccaggacaatcaataacaatatcatgcacaggaacatcatcagacgtaggatcatacaacctagtatcatggtaccaacaatacccaggaagagcaccaaaactactaatatacgaaaacaacaaaagaccatcaggaataccagacagattctcaggatcaaaatcaggaacatcagcaacactaggaataacaggactacaaacaggagacgaagcagactactactgcggaacatgggacaactcactatcaacaggaggagtattcggaacaggaacaaaagtaacagtacta

SEQ ID NO: 47402 - RNA, 333 nt, synthetic construct
  misc_feature 1..333: note = derived and/or modified sequence opt6 from anti-HIV-1_LightChain
  source 1..333: mol_type = other RNA
caatcactactaacacaaccaccaagcgtatcagcatcaccaggacaaaaagtaacaatatcatgctcaggaacatcatcaaacataggaaacaactacgtatcatggtaccaacaattcccaggaacagcaccaaaactactaatatacgaaaacaacaaaagatcatcaggaataccagacagattctcaggatcaaaatcagacacatcagcaacactaggaataacaggattacaaacaggagacgaagcagactactactgcggaacatgggacagatcactatcagcaggaggagtattcggaacaggaacaaaagtaacagtacta

SEQ ID NO: 47403 - RNA, 336 nt, synthetic construct
  misc_feature 1..336: note = derived and/or modified sequence opt6 from anti-HIV-1_LightChain
  source 1..336: mol_type = other RNA
caaagcgtactaacacaaccaccatcagtatcaggagcaccaggacaaagagtaacaataagctgtacaggaagaagaagtaatataggagcaggatatgacgtacactggtaccaacaattaccaggaacagcaccaaaattattaatatatgaaaataataaaagaccaagcggaataccagacagattctcaggatcaaaatcaggaacaagcgcaacattaggaataacaggattacaaacaggagacgaagcagattactattgcggaacatgggacacaagtttaagcgcaggaggagtatttggaacaggaacaaaagtaacagtacta

SEQ ID NO: 47404 - RNA, 333 nt, synthetic construct
  misc_feature 1..333: note = derived and/or modified sequence opt6 from anti-HIV-1_LightChain
  source 1..333: mol_type = other RNA
caatcagtattaacacaaccaccaagcgtaagtgcagcaccaggacaaagagtaacaataagctgtagcggaagctcaagcaatataggaaacaatttcgtaagctggtaccaattctttccaggaacagcaccaaaattagtaatatatgaaaatgacaaaagaccaagcggaacaccagacagattctcaggatcaaaatcaggaacaagcgcaacactagcaataataggactacaaacaggagacgaaggagattactattgcggaacatgggacaatagcttaagcacaggaggagtatttggaacaggaacaaaagtaacagtacta

SEQ ID NO: 47405 - RNA, 333 nt, synthetic construct
  misc_feature 1..333: note = derived and/or modified sequence opt6 from anti-HIV-1_LightChain
  source 1..333: mol_type = other RNA
caatcagtattaacacaaccaccaagcgtaagcgcagcaccaggacaaagagtaacaataagctgtagcggaggatcaagcaatataggaaacaatcacgtaagctggtaccaacaattaccaggaacagcaccaaaactattaatatcagaaaataacaaaagaccaagcggaataccagacagattctcaggatcaaaatcaggaacaagcgcaacattaggaataacaggactacaaacaggagacgaagcagattactattgcggaacatgggacagctcattaagcgcaggaggagtatttggaacaggaacaaaagtaacagtacta

SEQ ID NO: 47406 - RNA, 333 nt, synthetic construct
  misc_feature 1..333: note = derived and/or modified sequence opt6 from anti-HIV-1_LightChain
  source 1..333: mol_type = other RNA
caatcagtattaacacaaccaccaagcgtaagtgcagcaccaggacaaaaagtaacaataagctgtagcggaagctcaagtaatataggaagagatttcgtaagttggtaccaacaagtaccaggaacagcaccaaaactattaatatatgacaatgacaaaagaccaagcggaataccagacagattctcaggatcaaaatcaggaacaagcgcaacattaggaataacaggactacaaacaggagacgaagcagattactattgcggaacatgggacagctcattaagcgcaggaggagtatttggaacaggaacaaaagtaacagtacta

SEQ ID NO: 47407 - RNA, 336 nt, synthetic construct
  misc_feature 1..336: note = derived and/or modified sequence opt6 from anti-HIV-1_LightChain
  source 1..336: mol_type = other RNA
caaacagtagtaacacaaccaccatcagtatcaggagcaccaggacaaacagcaacaatatcatgtacaggaagctcatcaaatataggagcagactacgacgtacactggtaccaacaactaccaggaacagcaccaaaactactaatatacgacaacaataaaagaccatcaggaataccagacagattttcaggatcaaaatcaggaacatcagcaacactaggaataacaggactacaaacaggagacgaagcagactactactgcggaacatgggacagatcactaagtgcaggaggagtattcggaacaggaacaaaagtaacagtatta

SEQ ID NO: 47408 - RNA, 333 nt, synthetic construct
  misc_feature 1..333: note = derived and/or modified sequence opt6 from anti-HIV-1_LightChain
  source 1..333: mol_type = other RNA
aactttatgttaacacaaccaccaagcgcaagcggaacaccaggacaaagagtaacaataagctgtagcggaagctcaagcaatataggaagcaattacgtatactggtaccaacaattaccaggaacaacaccaaaactattaatatatcgaaataaccaaagaccaagcggaataccagacagattctcaggatcaaaatcaggaacaagtgcaacattaggaataacaggactacaaacaggagacgaagcagattactattgcggaacatgggacagctcattaagcgcaggaggagtatttggaacaggaacaaaagtaacagtacta

SEQ ID NO: 47409 - RNA, 333 nt, synthetic construct
  misc_feature 1..333: note = derived and/or modified sequence opt6 from anti-HIV-1_LightChain
  source 1..333: mol_type = other RNA
caatcagtactaacacaaccaccatcagtatcagcagcaccaggacaaaaagtaacaatatcatgctcaggatcatcaccaaacataggaaacaacttcctatcatggtaccaacaattaccaggaacagcaccaaaactactaatatacgaaaacacaaaaagaccatcaggaataccagacagattctcaggatcaaaatcaggaacatcagcaacactaggaataacaggactacaaacaggagacgaagcagactactactgcggaacatgggacagatcactatcagcaggaggagtattcggaacaggaacaaaagtaacagtacta

SEQ ID NO: 47410 - RNA, 333 nt, synthetic construct
  misc_feature 1..333: note = derived and/or modified sequence opt6 from anti-HIV-1_LightChain
  source 1..333: mol_type = other RNA
caatcagtattaacacaaagcccaagcgtaagcgcagcaccaggacaaaaagtaacaataagctgtagcggaagctcaagcgatataggaaacaatttcgtaagctggtaccaacaactaccaggaacagcaccaaaactattaatatatgaaaataacaaaagaccaagcggaataccagacagattctcaggatcaaaatcaggaacaagtgcaacattaggaataacaggactacaaacaggagacgaagcagattactattgcggaacatgggacagctcattaagcgcaggaggagtatttggaacaggaacaaaagtaacagtacta

SEQ ID NO: 47411 - RNA, 333 nt, synthetic construct
  misc_feature 1..333: note = derived and/or modified sequence opt6 from anti-HIV-1_LightChain
  source 1..333: mol_type = other RNA
caatttttcttaacacaaccaccatcattatcagcaacaccaggacaaagagtatcaatatcatgttcaggaggaggatcaaatatagcaaacaatgacgtattctggttccaacaatttccaggagcaggaccaagactattaatatatgacaatttaaaaagacattacggaacaccagacagattctcaggaagtaaatcaggaacatcagcaacattaggaataacaggactacaaacaggagacgaagcagattactattgcggaacatgggacaatagcctatcaacaggaggagtattcggaacaggaacaaaagtaacagtacta

SEQ ID NO: 47412 - RNA, 333 nt, synthetic construct
  misc_feature 1..333: note = derived and/or modified sequence opt6 from anti-HIV-1_LightChain
  source 1..333: mol_type = other RNA
caatcagtactaacacaaccaccatcagtatcagcagcaccaggacaaaaagtaacaatatcatgctcaggatcaggaccaaacataggatcaaactcagtatcatggtaccaacacttcccaggaacagcaccaaaactactaatatacgacaacaacaaaagaccatcaggaataccagacagattctcaggatcaaaatcaggaacatcagcaacattaggaataacaggactacaaacaggagacgaagcagactactactgcggaacatgggacagatcactatcagcaggaggagtattcggaacaggaacaaaagtaacagtatta

SEQ ID NO: 47413 - RNA, 333 nt, synthetic construct
  misc_feature 1..333: note = derived and/or modified sequence opt6 from anti-HIV-1_LightChain
  source 1..333: mol_type = other RNA
caatcagtattaacacaatcaccatcagcatcaggaacaccaggacaaagagtaacaataagctgttcaggatcatcatcaaatataggaagcaatacagtatcatggttccaacacttaccaggaacagcaccaaaactattaatatatgaaaataacaaaagaccatcaggaataccagacagattctcaggaagtaaaagtggaacatcagcaacactaggaataacaggactacaaacaggagacgaagcagattactattgcggaacatggcactcatcattatcagcaggaggagtatttggaacaggaacaaaagtaacagtacta

SEQ ID NO: 47414 - RNA, 333 nt, synthetic construct
  misc_feature 1..333: note = derived and/or modified sequence opt6 from anti-HIV-1_LightChain
  source 1..333: mol_type = other RNA
caatcagtactaacacaaccaccatcagtatcaggagcaccaggacaaaacgtaataatatcatgctcaggatcatcatcaaacataggaaaaaactacgtagcatggtaccaacaattaccaggaacagcaccaaaaatagtaatatacgaaacaacaaacagaccatcaggaataccagcaagattctcaggatcaaaatcaggaacatcagcaacactaggaataacaggactacaagcaggagacgaagcagactactactgcggaacatgggactcatcactaaacgcaggaggagtattcggaacaggaacaaaagtaacagtacta

SEQ ID NO: 47415 - RNA, 333 nt, synthetic construct
  misc_feature 1..333: note = derived and/or modified sequence opt6 from anti-HIV-1_LightChain
  source 1..333: mol_type = other RNA
caatcagtactaacacaaccaccatcagtatcagcagcaccaggacaaaaagtaacaatatcatgctcaggatcatcatcaaacataggaaacaacttcctatcatggtaccaacacctaccaggaacagcaccaagactactaatatacgacaacgaccaaagaccatcaggaataccagacagattctcaggatcaaaatcaggaacatcagcaacactaggaataacaggactacaaacaggagacgaagcagactactactgcggaacatggcactcatcactatcagcaggaggagtattcggaacaggaacaaaagtaacagtacta

SEQ ID NO: 47416 - RNA, 333 nt, synthetic construct
  misc_feature 1..333: note = derived and/or modified sequence opt6 from anti-HIV-1_LightChain
  source 1..333: mol_type = other RNA
caaagcgtactaacacaaccaccatcagcatcaggaacaccaggacaaaaagtaacaatatcatgctcaggatcatcatcaaacataggaaacaactacgtatcatggtaccaacaactaccaggaacagcaccaaaactactaatatacgaaaacaacaaaagaccatcaggaataccagacagattctcaggatcaaaatcaggaacatcagcaacactaggaataacaggactacaaacaggagacgaagcagactactactgcggaacatgggactcatcactatcaacaggaggagtattcggaacaggcacaaaagtaacagtacta

SEQ ID NO: 47417 - RNA, 333 nt, synthetic construct
  misc_feature 1..333: note = derived and/or modified sequence opt6 from anti-HIV-1_LightChain
  source 1..333: mol_type = other RNA
caatcagtactaacacaaccaccatcagtatcagcagcaccaggacaaaaagtaacaatatcatgctcaggaacaacatcaaacataggaaaccactacgtatcatggtaccaacaattcccaggaacagcaccaaaactaataatatacgaaacagacagaagaccatcaggaataccagcaagattcagcggaagcaaatcaggaacatcagcaacactagcaatagcaggactacaaacaggagacgaagcagactactactgcggaacatgggactcatcactaagcacaggaggagtattcggaacaggaacaaaagtaacagtacta

SEQ ID NO: 47418 - RNA, 333 nt, synthetic construct
  misc_feature 1..333: note = derived and/or modified sequence opt6 from anti-HIV-1_LightChain
  source 1..333: mol_type = other RNA
caactagtactaacacaaccaccaagcgtatcagcagcaccaggacaaaaagtaacaatatcatgctcaggatcatcatcaaacataggaaacaactacgtatcatggtaccaacaactaccaggaacagcaccaaaactactaatatacgaaaacaacaaaagaccatcaggaataccagacagattctcaggatcaaaatcaggaacatcagcaacactaggaataacaggactacaaacaggagacgaagcagactactactgcggaacatgggactcatcactatcaacaggaggagtattcggaacaggaacaaaagtaacagtacta

SEQ ID NO: 47419 - RNA, 333 nt, synthetic construct
  misc_feature 1..333: note = derived and/or modified sequence opt6 from anti-HIV-1_LightChain
  source 1..333: mol_type = other RNA
caatcagtattaacacaaccaccaagcgtatcagcagcaccaggacaaagagtaacaatatcatgcagcggaggatcatcaaatataggaaacaatcacgtatcatggtaccaacacttaccaggaagagcaccacaattactaatatacgacacaacacaaagaccatcaagaataccagacagattctcaggatcaaaatcaggaacatcagcaacactaggaataacaggactacaaacaggagacgaagcagactactattgcggaacatgggacaattcattatcaacaggaggagtattcggaacaggaacaaaagtaacagtacta

SEQ ID NO: 47420 - RNA, 333 nt, synthetic construct
  misc_feature 1..333: note = derived and/or modified sequence opt6 from anti-HIV-1_LightChain
  source 1..333: mol_type = other RNA
caatcagtactaacacaaccaccatcagtatcagcagcaccaggacaaaaaataacaatatcatgctcaggatcaagatcaaacataggaaacaactacgtatcatggtaccaacaattcccaggaacagcaccaaaactactaatatacgacaacaaccaaagaccatcaagaataccagacagattctcaggatcaaaatcaggaacatcagcaacactaggaataacaggactacaaacaggagacgaagcagactactactgcggaacatgggactcatcactatcagcaggaggagtattcggaacaggaacaaaagtaacagtacta

SEQ ID NO: 47421 - RNA, 321 nt, synthetic construct
  misc_feature 1..321: note = derived and/or modified sequence opt6 from anti-HIV-1_LightChain
  source 1..321: mol_type = other RNA
caatcagtattaacacaacccccatcagtatcagcagcaccaggacaaagagtaacaatatcatgtttcggatcaagattctcatcagtatcatggtaccaacaattaccaggaacagcaccaaaactattaatatatccaaatggagaaagaccatcaggaataccagacagattctttggatcagaatcaggaacatcagcaacattaggaataacaggactacaaacaggagacgaagcagattactattgcgcaacatgggactcatcattatcagcaggaggagtatttggaacaggaacaaaattaacagtatta

SEQ ID NO: 47422 - RNA, 333 nt, synthetic construct
  misc_feature 1..333: note = derived and/or modified sequence opt6 from anti-HIV-1_LightChain
  source 1..333: mol_type = other RNA
caatcagtattaacacaaccaccatcattaagcgcagcaccaggacaaaaagtaacaataagttgtagtggaagctcactaaatataggaaaccattacgtaagctggtaccaacaagtaccaggaacagcaccaaaactattaatatatgaagataacaaaagaccaagcggaataccagacagattctcaggatcaaaatcaggaacaagcgcaacattaggaataacaggactacaaacaggagacgaagcagattactattgcggaacatggcacagcagcttaagcgcaggaggagtatttggaacaggaacaaaagtaacagtacta

SEQ ID NO: 47423 - RNA, 333 nt, synthetic construct
  misc_feature 1..333: note = derived and/or modified sequence opt6 from anti-HIV-1_LightChain
  source 1..333: mol_type = other RNA
caatttgtattaacacaaccaccatcagtatcagcagcaccaggacaaaaagtaacagtatcatgttcaggaacaacatcagatataggagaaaattacgtatcatggtaccaaaaatttccagaagcagcaccaaaactattaatatacgacaatgacaaaagaccatcaggaataccagacagattctcaggatcaaaatcaggaacatcagcaacactaggaataacaggactacaaacaggagacgaagcagactactactgcggaacatgggacagatcattatcagcaggaggagtattcggaacaggaacaaaagtaacagtacta

SEQ ID NO: 47424 - RNA, 333 nt, synthetic construct
  misc_feature 1..333: note = derived and/or modified sequence opt6 from anti-HIV-1_LightChain
  source 1..333: mol_type = other RNA
ttatcagtactaacacaaccaccatcagtatcagcagcaccaggacaacaagtaacaatatcatgctcaggaacaacatcaaacataggcacaaactacgtatcatggtaccaacaaatgccaccaacagcaccaaaactactaatatacgaaaacaacaaaagaccatcaggaataccagacagattctcaggatcaaaatcaggaacatcagcaacactaggaataacaggactacaaacaggagacgaagcagactactactgcggaacatgggactcatcactatcagcaggaggagtattcggaacaggaacaaaagtaacagtacta

SEQ ID NO: 47425 - RNA, 336 nt, synthetic construct
  misc_feature 1..336: note = derived and/or modified sequence opt6 from anti-HIV-1_LightChain
  source 1..336: mol_type = other RNA
caaagcatgctaacacaaccaccatcagtatcaggagcaccaggacaaagagtaacaatatcatgcacaggatcaagatcaaacataggagcaggatatgacgtacactggtacttacaattaccaggaacagcaccaaaactattaatatatgaaaataacaaaagaccaagtggaataccagacagattctcaggatcaaaatcaggaacaagcgcaacattaggaataacaggactacaaacaggagacgaagcagattactattgcggaacatgggacaatagtttaagcacaggaggagtatttggaacaggaacaaaagtaacagtacta

SEQ ID NO: 47426 - RNA, 333 nt, synthetic construct
  misc_feature 1..333: note = derived and/or modified sequence opt6 from anti-HIV-1_LightChain
  source 1..333: mol_type = other RNA
caatcagtattaacacaaccaccatcagtatcagcaacaccaggacaaaaagtaacaatatcatgttcaggatcaagatcaaatataggatcacattacgtaagctggtaccaacaatttccagaatcagcaccaacactattaatatatgaaaatgtagaaagaccatcaggaataccagacagattctcaggatcaaaatcaggaacatcagcaacattaggaataacaggactacaaacaggagacgaagcagactactattgcggaacatgggactcatcattatcagcaggaggagtatttggaacaggaacaaaagtaacagtacta

SEQ ID NO: 47427 - RNA, 333 nt, synthetic construct
  misc_feature 1..333: note = derived and/or modified sequence opt6 from anti-HIV-1_LightChain
  source 1..333: mol_type = other RNA
caatttttcttaacacaaccaccatcattatcagcaacaccaggacaaagagtatcaatatcatgttcaggaggaggatcaaatatagcaaacaatgacgtattctggttccaacaatttccaggagcaggaccaagactattaatatatgacaatctaaaaagacattacggaacaccagacagattctcaggatcaaaatcaggagcaacaggaacattagaaataacagaagtacaaacagcagacgaagcagattactattgcggaacatgggactcatcattatcagcaggaggagtattcggaacaggaacaaaagtaacagtacta

SEQ ID NO: 47428 - RNA, 333 nt, synthetic construct
  misc_feature 1..333: note = derived and/or modified sequence opt6 from anti-HIV-1_LightChain
  source 1..333: mol_type = other RNA
caatcagtactaacacaaccaccatcagtatcagcagcaccaggacaaaaagtaacaatatcatgctcaggaggatcatcaaacataggagacaactcagtatcatggtaccaacaattaccaggaacagcaccaaaactactaatatacgaaaacaacaaaagaccatcaggaataccagacagattctcaggatcaaaaagtggaacatcagcaacactaggaataacaggactacaaacaggagacgaagcagactactactgcggaacatgggacagctcactatcaacaggaggagtattcggaacaggaacaaaagtaacagtacta

SEQ ID NO: 47429 - RNA, 333 nt, synthetic construct
  misc_feature 1..333: note = derived and/or modified sequence opt6 from anti-HIV-1_LightChain
  source 1..333: mol_type = other RNA
caatcagtattaacacaaccaccatcagtaagcgcagcaccaggacaaacagtaacaatatcatgttcaggatcagcatcaaatataggaagaaattcagtatcatggtaccaatacgtaccaggagcagcaccaaaaagattaatatatgaaaataacaaaagaccatcaggaataccagacagattctcaggatcaaaatcaggaacatcagcaacattaggaataacaggactacaaacaggagacgaagcagattactattgcggaacatgggacacatcattatcagcaggaggagtatttggaacaggaacaaaagtaacagtacta

SEQ ID NO: 47430 - RNA, 333 nt, synthetic construct
  misc_feature 1..333: note = derived and/or modified sequence opt6 from anti-HIV-1_LightChain
  source 1..333: mol_type = other RNA
caatcagtactagcacaaccaccatcagtatcagcagcaccaggacaaaaagtaacaatatcatgctcaggaagaacatcaaatataggaaactacttcgtatcatggtaccaacaattcccaggaacagcaccaagactactaatatacgacaatgaccaaagaccatcaggaataccagacagattctcaggaagcaaatcaggaacatcagcaacactaggaataacaggactacaaacaggagacgaagcagactactattgcggaacatgggactcatcactatcagcaggaggagtattcggaacaggaacaaaagtaacagtacta

SEQ ID NO: 47431 - RNA, 333 nt, synthetic construct
  misc_feature 1..333: note = derived and/or modified sequence opt6 from anti-HIV-1_LightChain
  source 1..333: mol_type = other RNA
caatcagcactaacacaaccagcatcagtatcagcagcaccaggacaaaaagtaaccatatcatgctcaggatcatcatcaaacataggaaacatatacgtatcatggtaccaacaactaccaggaacagcaccaaaactactaatatacgaaaataacaaaagaccatcaggaataccagacagattctcaggatcaaaatcaggaacatcagcaacactaggaataacaggactacaaacaggagacgaagcagactactactgcggaacatggcactcatcactatcagcaggaggagtattcggaacaggaacaaaagtaacagtatta

SEQ ID NO: 47432 - RNA, 333 nt, synthetic construct
  misc_feature 1..333: note = derived and/or modified sequence opt6 from anti-HIV-1_LightChain
  source 1..333: mol_type = other RNA
caatcagtattaacacaaccaccatcagtaagcgcaacaccaggacaaagagtaacagtaagctgtagcggatcatcatcaaatataggaaaccattacgtaagctggtaccaacaagtaccaggaacagcaccaaaactattaatatatgacaatagcaatagaccaagcggaataccagacagattctcaggatcaaaatcaggaacatcagcaacattaggaataacaggattacaaacaggagacgaagcagattactattgcggaacatgggactcatcattatcagcaggaggagtatttggaacaggaacaaaagtaacagtacta

SEQ ID NO: 47433 - RNA, 333 nt, synthetic construct
  misc_feature 1..333: note = derived and/or modified sequence opt6 from anti-HIV-1_LightChain
  source 1..333: mol_type = other RNA
caatcagtactaacacaaccaccatcattatcagcagcaccaggacaaagagtaacagtatcatgctcaggatcatcatcaaatataggagacaactacgtatcatggtaccaacaattaccaggagcagcaccaagactattaatatacgacaactcaataagaccatcagcaataccagcaagattctcaggatcaaaatcaggaacatcagcaacactagcaataacaggactacaaacaggagacgaagcagactactactgcggaacatgggactcatcactatcagcaggaggagtattcggaacaggaacaaaagtaacagtccta

SEQ ID NO: 47434 - RNA, 336 nt, synthetic construct
  misc_feature 1..336: note = derived and/or modified sequence opt6 from anti-HIV-1_LightChain
  source 1..336: mol_type = other RNA
caaagcgcactaacacaaccagcatcagtatcaggatcaccaggacaatcaataacaatatcatgcacaggaacaagttcagacgtaggaggatacgattacgtaagctggtacctacaattaccaggaacagcaccaaaactattaatatatgaaaataacaaaagaccaagcggaataccagacagattctcaggatcaaaatcaggaacaagcgcaacattaggaataacaggattacaaacaggagacgaagcagattactattgcggaacatgggacagctcattaagcgcaggaggagtatttggaacaggaacaaaagtaacagtacta

SEQ ID NO: 47435 - RNA, 333 nt, synthetic construct
  misc_feature 1..333: note = derived and/or modified sequence opt6 from anti-HIV-1_LightChain
  source 1..333: mol_type = other RNA
caatcagtattaacacaaccaccaagcgtaagcgcagcaccaggacaaagagtaacagtaagctgtagcggaagctcaagtaatataggaaacaattacgtaagctggtaccaacaatttccaggaacagcaccaaaattagtaatatatgacacagacaaaagaccaagcggaataccagacagattctcaggatcaaaatcaggaacaagcgcaacattaggaataacaggactacaaacaggagacgaagcagattactattgcgcaacatgggactcaagcctaagcgcaggaggagtatttggaacaggaacaaaagtaacagtatta

SEQ ID NO: 47436 - RNA, 336 nt, synthetic construct
  misc_feature 1..336: note = derived and/or modified sequence opt6 from anti-HIV-1_LightChain
  source 1..336: mol_type = other RNA
caatcagtactaacacaaccaccatcagtatcaggagcaccaggacaaagagtaacaatatcatgcacaggaaactcatcaaacataggagcaggatacgacgtacactggtaccaacaactaccaggaacagcaccaaaactactaatatcagaaaacaacaaaagaccatcaggaataccagacagattctcaggatcaaaatcaggaacatcagcaacactaggaataacaggactacaaacaggagacgaagcagactactactgcggaacatgggactcatcactatcagcaggaggagtattcggaacaggaacaaaagtaacagtacta

SEQ ID NO: 47437 - RNA, 333 nt, synthetic construct
  misc_feature 1..333: note = derived and/or modified sequence opt6 from anti-HIV-1_LightChain
  source 1..333: mol_type = other RNA
caatcagtactaacacaaccaccatcagcatcaggaacaccaggacaaagagtaacaatatcatgctcaggatcatcatcaaacataggatcaaactacgtagactggtaccaacaactaccaggaacagcaccaaaactactaatatacgaaaacaacaaaagaccatcaggaataccagacagattctcaggatcaaaatcaggaacatcagcaacactaggaataacaggactacaaacaggagacgaagcagactactactgcggaacatggcactcatcactatcagcaggaggagtattcggaacaggaacaaaagtaacagtacta

SEQ ID NO: 47438 - RNA, 333 nt, synthetic construct
  misc_feature 1..333: note = derived and/or modified sequence opt6 from anti-HIV-1_LightChain
  source 1..333: mol_type = other RNA
caatcagtactaacacaaccaccatcagtatcagcaacaccaggacaaacagtaacaatatcatgctcaggatcatcatcaaacataggaaacaactacctatcatggtacagacaattaccaagaacagcaccaaaactactaatatacgaaaacaacagaagaccatcaggagtaccagcaagattctcaggaagcaaatcaggaacatcagcaacactagcaataacaggactacaaacaggagacgaagcagactactactgcggaacatgggactcatccctatcagcaggaggagtattcggaacaggaacaaaagtaacagtacta

SEQ ID NO: 47439 - RNA, 321 nt, synthetic construct
  misc_feature 1..321: note = derived and/or modified sequence opt6 from anti-HIV-1_LightChain
  source 1..321: mol_type = other RNA
caatcagtattaacacaaccaccatcagtatcagcagcaccaggacaaagagtaacaatatcatgtttcggatcaagattctcatcagtatcatggtaccaacaattaccaggaacagcaccaaaactattaatatatccaaatggagaaagaccatcaggaataccagacagattctttggatcagaatcaggaacatcagcaacattaggaataacagcagtacaaacaggagacgaagcagattactattgcggaacatgggacgatagcttatcaacaggaggagtatttggaacaggaacaaaagtaacagtacta

SEQ ID NO: 47440 - RNA, 333 nt, synthetic construct
  misc_feature 1..333: note = derived and/or modified sequence opt6 from anti-HIV-1_LightChain
  source 1..333: mol_type = other RNA
caatcagtactaacacaaccaccatcagtatcagcagcaccaggacaaaaagtaacattatcatgctcaggaacatcatcaaacataggaaacaactacgtatcatggtaccaacaagtaccaggagcagcaccaaaagtattaatatacgaaaacgacaaaagaccatcaggaataccagacagattctcaggatcaaaatcaggaacatcagcaacactaggaataacaggactacaaacaggagacgaagcagactactactgcggaacatgggacagatcactatcagcaggaggagtattcggaacaggaacaaaagtaacagtacta

SEQ ID NO: 47441 - RNA, 333 nt, synthetic construct
  misc_feature 1..333: note = derived and/or modified sequence opt6 from anti-HIV-1_LightChain
  source 1..333: mol_type = other RNA
caatcagtactaacacaaccaccatcagtatcagcagcaccaggacaaaaagtaacaatatcctgctcaggatcaaactcaaacataggaaacaactacgtatcatggtaccaacaattaccaggaacagcaacaaaactactaatatacgaaaacgacaaacgaccaagcggaataccagacagattctcaggatcaaaatcaggaacatcagcaacactaggaataacaggactacaaacaggagacgaagcagactactactgcggaacatggcactcatcactatcagcaggaggagtattcggaacaggaacaaaagtaacagtacta

SEQ ID NO: 47442 - RNA, 333 nt, synthetic construct
  misc_feature 1..333: note = derived and/or modified sequence opt6 from anti-HIV-1_LightChain
  source 1..333: mol_type = other RNA
caatcagtactaacacaaccaccatcactatcagcagcaccaggacaacaagtatcaataagctgtctaggaagatcatcaaatataggaacaaattacgtatcatggtaccaacaatttccaggaacagcaccaaaactattaatatacgaaaataaaaaaagaccatcagaaataccagacagattctcaggatcaaaatcaggaacatcagcaacactaggaataacaggactacaaccaggagacgaagcagactactactgcggaacatgggactcatcactatcagcaggaggagtattcggaacaggaacaaaagtaacagtacta

SEQ ID NO: 47443 - RNA, 336 nt, synthetic construct
  misc_feature 1..336: note = derived and/or modified sequence opt6 from anti-HIV-1_LightChain
  source 1..336: mol_type = other RNA
caatcagcactaacacaaccaccatcagcatcaggatcaccaggacaatcagtaacaatatcatgcacaggaacatcatcagacgtaggcgcatacaactcagtatcatggtaccaacaactaccaggaacagcaccaaaactactaatatcagaaaacaacaaaagaccatcaggaataccagacagattctcaggatcaaaatcaggaacatcagcaacactaggaataacaggactacaaacaggagacgaagcagactactactgcggaacatgggactcatcactatcagcaggaggagtattcggaacaggaacaaaagtaacagtatta

SEQ ID NO: 47444 - RNA, 333 nt, synthetic construct
  misc_feature 1..333: note = derived and/or modified sequence opt6 from anti-HIV-1_LightChain
  source 1..333: mol_type = other RNA
caatcagcattaacacaaccaccaagcgcaagcggatcaccaggacaaagcgtaacaataagctgtagcggaggatcaagcaatataggaaacaatcacgtaagctggtaccaacacttaccaggaagagcaccacaactattaatatatgacacaacacaaagaccaagcagaataccagacagattctcaggatcaagatcaggaacaagcgcaacattagcaataacaggactacaaacaggagacgaagcagtatactattgcggaacatgggacaatagcttaagcacaggaggagtatttggaacaggaacaaaagtaacagtacta

SEQ ID NO: 47445 - RNA, 333 nt, synthetic construct
  misc_feature 1..333: note = derived and/or modified sequence opt6 from anti-HIV-1_LightChain
  source 1..333: mol_type = other RNA
caatcagtattaacacaaccaccaagcgtaagcgcagcaccaggacaaagagtaacaataagctgtagcggaggaacaagcaatataggaaacgaatacgtaagctggtaccaacaattaccaggaacagcaccaaaactactaatatatgaaaataacaaaagaccaagcggaataccagacagattctcaggatcaaaatcaggaacaagcgcaacattaggaataacaggactacaaacaggagacgaagcagattactattgcggaacatgggacagctcattaagcgcaggaggagtatttggaacaggaacaaaagtaacagtacta

SEQ ID NO: 47446 - RNA, 333 nt, synthetic construct
  misc_feature 1..333: note = derived and/or modified sequence opt6 from anti-HIV-1_LightChain
  source 1..333: mol_type = other RNA
caatcagtactaacacaaccaccatcagtatcagcagcaccaggacaaagagtaacagtatcatgctcaggatcatcatcaaacataggaaacaactacgtatcatggtaccaacaactaccaggagcagcaccaaaactactaatatacgacacagacaaaagaccatcaggaataccagacagattctcaggatcaaaatcaggaacatcagcaacactaggaataacaggactacaaacaggagacgaagcagactactactgcggaacatgggacagatcactatcagcaggaggagtattcggaacaggaacaaaagtaacagtacta

SEQ ID NO: 47447 - RNA, 333 nt, synthetic construct
  misc_feature 1..333: note = derived and/or modified sequence opt6 from anti-HIV-1_LightChain
  source 1..333: mol_type = other RNA
caatcactattaacacaaccaccaagtgtaagcgcagcaccaggacaaaaagtaacaataagttgtagcggaggaaatagcgatataggaaaaaatttcgtaagctggtaccaacaatcaccaggagcagcaccaagactattaatatatgaaaatgacagaagaccaagcggaataccagacagattctcaggatcaaaatcaggaacaagcgcaacattaggaataacaggactacaaacaggagacgaagcagattactattgcggaacatgggacagaagcttaagcgcaggaggagtatttggaacaggaacaaaagtaacagtacta

SEQ ID NO: 47448 - RNA, 333 nt, synthetic construct
  misc_feature 1..333: note = derived and/or modified sequence opt6 from anti-HIV-1_LightChain
  source 1..333: mol_type = other RNA
caatcagtactaacacaaccaccatcagtatcagcagcaccaggacaaaaagtaaacatatcatgctcaggatcatcatcaaacataggaaaaaactacgtatcatggtaccaacaaataccaggaacagcaccaaaagtactaatatacgaaaacaacaaaagaccatcaggaataccagacagattcagcggatcaaaatcaggaacatcagcaacattaggaatagcaggactacaaacaggagacgaagcagactactactgcgcaacatgggactcatcactatcagcaggaggagtattcggaacaggaacaaaagtaacagtacta

SEQ ID NO: 47449 - RNA, 333 nt, synthetic construct
  misc_feature 1..333: note = derived and/or modified sequence opt6 from anti-HIV-1_LightChain
  source 1..333: mol_type = other RNA
caatcagtactaacacaaccaccatcagtatcagcagcaccaggacaaaaagtaacaatatcatgctcaggatcatcatcaaacataggaaacagacacgtatcatggtaccaacaactaccaggaacagtaccaaaactactaatatacgaaacaaacaaaagaccaagcggaataccagacagattctcaggatcaaaatcaggaacatcagcaacattaggaataacaggactacaaacaggagacgaagcagactactactgcggaacatgggacaactcactatcaacaggaggagtattcggaacaggaacaaaagtaacagtacta

SEQ ID NO: 47450 - RNA, 336 nt, synthetic construct
  misc_feature 1..336: note = derived and/or modified sequence opt6 from anti-HIV-1_LightChain
  source 1..336: mol_type = other RNA
caaagcgtattaacacaaccaccatcagtatcaggagcaccaggacaaagagtaacaatatcatgtacaggatcaagttcaaatataggagcaggatatgacgtacactggtaccaacaattaccaggaacagcacccaaattattaatatttggacatgacaaaagaccaagcggaataccagacagattctcaggatcaaaatcaggaacaagtgcaacattaggaataacaggactacaaacaggagacgaagcagattattattgcggaacatgggacagctcattaagtgcaggaggagtatttggaacaggaacaaaagtaacagtacta

SEQ ID NO: 47451 - RNA, 333 nt, synthetic construct
  misc_feature 1..333: note = derived and/or modified sequence opt6 from anti-HIV-1_LightChain
  source 1..333: mol_type = other RNA
caatcagtactaacacaactaccatcagcatcaggactaccaggacaaacagtaacaatatcatgctcaggaagcacatcatcaataggatcaaaccacgtatactggtaccaacaagtagcaggaacagcaccaaaattattaatatacgaaaacaacaaaagaccatcaggaataccagacagattctcaggatcaaaatcaggaacatcagcaacactaggaataacaggactacaaacaggagacgaagcagactactactgcgcaacatgggactcatcactatcagcaggaggagtattcggaacaggaacaaaagtaacagtacta

SEQ ID NO: 47452 - RNA, 333 nt, synthetic construct
  misc_feature 1..333: note = derived and/or modified sequence opt6 from anti-HIV-1_LightChain
  source 1..333: mol_type = other RNA
caatcagtattaacacaaacaccatcagcatcaggagcaccaggacaaggagtaacaatatcatgttcaggatcatcatcaaatgtaggaagaaattacgtatcatggtaccaacaattaccaggaacagcaccaaaactattaatatacgaaaacacaaaaagaccatcaggaataccagacagattctcaggatcaaaatcaggaacatcagcaacattaggaataacaggactacaaacaggagacgaagcagactactactgcggaacatgggacagatcattatcagcaggaggagtattcggaacaggaacaaaagtaacagtacta

SEQ ID NO: 47453 - RNA, 333 nt, synthetic construct
  misc_feature 1..333: note = derived and/or modified sequence opt6 from anti-HIV-1_LightChain
  source 1..333: mol_type = other RNA
caatcagtactaacacaaccaccatcagtatcagcagcaccaggacaaaaagtaacaatatcatgctcaggatcatcatcaaacataggaaacaactacgtatcatggtaccaacaattcccaggaacagcaccaaaactactaatatcagacaacaacaaaagaccatcaggaataccagacagattctcagtatcaaaatcaggaacatcagcaacactaggaataacaggactacaagcaggagacgaagcagactactactgcggaacatgggactcatcactatcagcaggaggagtattcggaacaggaacaaaagtaacagtacta

SEQ ID NO: 47454 - RNA, 333 nt, synthetic construct
  misc_feature 1..333: note = derived and/or modified sequence opt6 from anti-HIV-1_LightChain
  source 1..333: mol_type = other RNA
caatcagtactaacacaaccaccatcagtatcagcagcaccaggacaaaaagtaacaatatcatgctcaggatcaaactcaaacataggaaacaactacgtaacatggtaccaacaattcccaggaacagcaccaaaagtactaatatacgacaactcaagaagaccatcaggaataccagacagattctcaggatcaaaatcaggaacatcagcaacattaggaataacaggactacaaacaggagacgaagcagactactactgcggaacatgggactcatcactatcagcaggaggagtattcggaacaggaacaaaagtaacagtacta

SEQ ID NO: 47455 - RNA, 333 nt, synthetic construct
  misc_feature 1..333: note = derived and/or modified sequence opt6 from anti-HIV-1_LightChain
  source 1..333: mol_type = other RNA
caatcagtattaacacaaccaccatcagtatcaggagcaccaggacaaagagtaacaatatcatgctcaggatcatcatcaaacataggaaacaactacgtatcatggtaccaacaactaccaggaacagcaccaaaactactaatatacgaaaacacaaaaagaccatcaggaataccagacagattctcaggatcaaaatcaggaacatcagcaacactaggaataacaggactacaaacaggagacgaagcagactactactgcggaacatgggacagatcactatcagcaggaggagtattcggaacaggaacaaaagtaacagtacta

SEQ ID NO: 47456 - RNA, 333 nt, synthetic construct
  misc_feature 1..333: note = derived and/or modified sequence opt6 from anti-HIV-1_LightChain
  source 1..333: mol_type = other RNA
caatcagtactaacacaaccaccatcagtatcagcagcaccaggacaaacagtaacaatatcatgctcaggatcaacatcaaacataggacaaaacttcctatcatggttccaacacgtaccaggaacagcaccaaaactactaatatacgaaaacaacaaaagaccatcaggaataccagacagattctcaggatcaaaatcaggaacatcagcaacactaggaataacaggactacaaacaggagacgaagcagactactactgcggaacatggcactcatcactatcagcaggaggagtattcggaacaggaacaaaagtaacagtacta

SEQ ID NO: 47457 - RNA, 333 nt, synthetic construct
  misc_feature 1..333: note = derived and/or modified sequence opt6 from anti-HIV-1_LightChain
  source 1..333: mol_type = other RNA
aactttatgttaacacaaccaccaagtgcaagcggaacaccaggacaacgagtaacaataagctgtagcggaagctcaagcaatataggaagcaaatacgtaagctggtaccaacaattaccaggaacagcaccaaaactattaatatatgaaaatacaaaaagaccatcaggaataccagacagattctcaggatcaaaatcaggaacaagtgcaacattaggaataacaggactacaaacaggagacgaagcagattactattgcggaacatgggacagaagtttaagcgcaggaggagtatttggaacaggaacaaaagtaacagtacta

SEQ ID NO: 47458 - RNA, 333 nt, synthetic construct
  misc_feature 1..333: note = derived and/or modified sequence opt6 from anti-HIV-1_LightChain
  source 1..333: mol_type = other RNA
caatcagtactaacacaaccaccatcagtatcagcagcaccaggacaaaaagtaacaatatcatgctcaggatcatcatcaaacataggaaacaactacgtatcatggtaccaactactaccaggaacagcaccaaaactactaatatacgaaaacaacaaaagaccatcaggaataccagacagattctcaggatcaaaatcaggaacatcagcaacactaggaataacaggactacaaacaggagacgaagcagactactactgcggaacatgggacaactcactatcaacaggaggagtattcggaacaggaacaaaagtaacagtacta

SEQ ID NO: 47459 - RNA, 333 nt, synthetic construct
  misc_feature 1..333: note = derived and/or modified sequence opt6 from anti-HIV-1_LightChain
  source 1..333: mol_type = other RNA
caatcagtactaacacaaccaccatcagtatcagcagcaccaggacaaaaagtaacaatatcatgctcaggaagctcatcaaacataggaaacaactacgtatcatggtaccaacaactaccaggaacagcaccaaaaataataatatacgacaacaacaaaagaccatcaggaataccagacagattctcaggatcaaaatcaggaacatcagcaacactaggaataacaggactacaaacaggagacgaagcagactactactgcggaacatggcactcatcactatcagcaggaggagtattcggaacaggaacaaaagtaacagtacta

SEQ ID NO: 47460 - RNA, 333 nt, synthetic construct
  misc_feature 1..333: note = derived and/or modified sequence opt6 from anti-HIV-1_LightChain
  source 1..333: mol_type = other RNA
caatcagtactaacacaaccaccatcagcatcagcaacaccaggacaaagagtaacaatatcatgctcaggatcatcatcaaacataggatccaaacacgtatactggtaccaaaaactaccaggaacagcaccaaaactactaatatacgaaaacacaaaaagaccatcaggaataccagacagattctcaggatcaaaatcaggaacatcagcaacactaggaataacaggactacaaacaggagacgaagcagactactactgcggaacatgggacagatcactatcagcaggaggagtattcggaacaggaacaaaagtaacagtacta

SEQ ID NO: 47461 - RNA, 432 nt, synthetic construct
  misc_feature 1..432: note = derived and/or modified sequence opt6 from anti-HIV-1_HeavyChain
  source 1..432: mol_type = other RNA
caagcacaattagtagaaagtggaggaggagtagtacaaccaggaagaagtttaagattaagttgtgcagcaagtggatttacatttagtagttatggaatacattgggtaagacaagcaccaggaaaaggattagaatgggtagcggtaatgagtagcgatggaacatataaatattatggagatagtatgaaaggaagatttacaataagtagagataatagtaaaaatagtttatatctacaaatgaatagtttaagggcagtagatacagcagtatattattgtgcaaaagatttaggagaaggagaaaatgaagaatgggcaacagattattatgatttcagtataggatatccaggacaagatccaagaggagtagtaggaacatttgatatatggggacaaggaacaatggtaacagtaagcagt

SEQ ID NO: 47462 - RNA, 426 nt, synthetic construct
  misc_feature 1..426: note = derived and/or modified sequence opt6 from anti-HIV-1_HeavyChain
  source 1..426: mol_type = other RNA
caagtacaattagtagaaagtggaggaggagtagtacaaccaggaagaagtttaagattaagttgtgcagcaagtggatttacatttagtagctatggaatgcattgggtaagacaagcaccaggaaaaggattagaatgggtagcagtaataagtgatgatggatcaaataaatattatgcagatagtgtaaaaggaagatttacaataagtagagataatagtaaaaatacattatatttacaaatgaatagtttaagagcagaagacacagcagtatattattgtgcaaaagatttaggagaaagtgaaaacgaagaatgggcaagtgattattatgatttcggaagtgattatccaggacaagatccaagagcagtagtaggagcattctggggacaaggaacaatggtaacagtaagtagt

SEQ ID NO: 47463 - RNA, 432 nt, synthetic construct
  misc_feature 1..432: note = derived and/or modified sequence opt6 from anti-HIV-1_HeavyChain
  source 1..432: mol_type = other RNA
caagtacaattagtagaaagtggaggaggagtagtacaaagtggaagaagtttaagattaagttgtgcagcaagtggatttacatttagtgcatatgcattacattgggtaagacaagcaccaggaaaaggattagaatgggtagcagtaataagttatgatggaagagataaagattatgcagatagcgtaaaaggaagatttacaataagtagagataatagcaaaaatacattatatttacaaatgaatagcttaagagcagaagatacagcagtatattattgtgcaaaagatttaggagaaagtgaaaatgaagaatgggcaagtgattattatgattttggaagtgattatccaggacaagatccaagagcagtagtaggagcatttgacatatggggacaaggaacaatggtaacagtaagtagc

SEQ ID NO: 47464 - RNA, 432 nt, synthetic construct
  misc_feature 1..432: note = derived and/or modified sequence opt6 from anti-HIV-1_HeavyChain
  source 1..432: mol_type = other RNA
caagtacaattagtacaaagtggaggagggttagtacaaccaggaagaagtttaagactaagttgtgtagcgagtggatttagatttagttttcatggaatgcattgggtaagacaagcaccaggaaaaggactagaatgggtagcagtagtaagtgatgatggaagtgatcaaaaatatgtagatagtgtaaaaggaagattaacaataagtagagataatagtaaaaatacagtatatttacaaatgaatagtttaagagcagaagatacagcagtatattattgtgcaaaagatttaggagaaagtgaaaatgaagaatgggcaagtgattattatgattttggaagtgattatccaggacaagatccaagagcagtagtaggagcatttgatatatggggacaaggaacaatggtaacagtaagtagc

SEQ ID NO: 47465 - RNA, 432 nt, synthetic construct
  misc_feature 1..432: note = derived and/or modified sequence opt6 from anti-HIV-1_HeavyChain
  source 1..432: mol_type = other RNA
gaagtacatttagtagaaagtggaggaggagtagtacaaccaggaagaagtttaagattaagttgtgcagcaagcggatttacatttaatagttatgcaatgatatgggtaagacaagcaccaggaaaaggattagaatgggtagcagtaataagttatgatggaaataataaatattacgcagatagtgtaaaaggaagatttacaataagtagagaaaatagtaaaaatacattatatttacaaatgaatagcttaagagcagaagatacagcagtatatcattgtgcaaaagatttaggagaaagtgaaaatgaagaatgggcaagtgattattatgatttcggaagagattatccaggacaagatccaagaggagtagtaggaacatttgatatatggggacatggaacaatggtaacagtaagtagt

SEQ ID NO: 47466 - RNA, 432 nt, synthetic construct
  misc_feature 1..432: note = derived and/or modified sequence opt6 from anti-HIV-1_HeavyChain
  source 1..432: mol_type = other RNA
caagtacaattagtagaaagtggaggaggagtagtaagaccaggaggaagtttaagattaagctgtacagcaagcggattccatttcaataaatatggaatgaactgggtaagacaagcaccaggaaaaggactagcattagtagcatttatacaaagcggagcaagttacaattactatgcagatagcgtaaaaggaagatttacaataagcagagacaatagcaaaaacacactatatctacaaatgaatagcttaagagcagaagatacagcagtatattactgtgcaaaagacttaggagatagcgaaaacgaagaatgggcaagtgactattacgatttcggaagagattacccaggacaagacccaagaggagtagtaggagcattcgatatatggggacatggaacaatggtaacagtaagctca

SEQ ID NO: 47467 - RNA, 432 nt, synthetic construct
  misc_feature 1..432: note = derived and/or modified sequence opt6 from anti-HIV-1_HeavyChain
  source 1..432: mol_type = other RNA
caagtacacttagtagaaagcggaggaggagtagtacaaccaggaaaatcattaacaatatactgtgcagtaagcgaatttacactaagcaactatgcaatgcactgggtaagactaacaccaggaaaaggactacaatgggtagcagtaatatcatacgatggatcaaacaaatactatgcagatagcgtaaaaggaagattcacaataagcagggacaatagcaaaaacacactatatctacaaatgaatagcttaagagcagaagatacagcagtatattactgtgcaaaagacttaggagaaagcgaaaacgaagaatgggcatcagactattacgatttcggaagagattacccaggacaagacccaagaggagtagtaggagtattcgatatatggggacaaggaacaatggtaacagtaagctca

SEQ ID NO: 47468 - RNA, 432 nt, synthetic construct
  misc_feature 1..432: note = derived and/or modified sequence opt6 from anti-HIV-1_HeavyChain
  source 1..432: mol_type = other RNA
gaagtacaattattagaaagtggaggaggagtagtacaaccaggaagaagtttaagattaagttgtgcagcaagtggatttacatttagtacatatgcattacattgggtaagacaagcaccaggaaaaggattagaatgggtagcagtaataagttatgatggatcaacaaaattttatgcagatagtgtaaaaggaagatttacaataagtagagataatagtaaaaatacattatatttacaaatgaatagtttaagagcagaagatacagcagtatattattgtgcaaaagatctaggagaaagtgaaaatgaagaatgggcaagtgattattatgattttggaagtgattatccaggacaagatccaagagcagtagtaggagcatttgatatatggggacaaggaacaatggtaacagtaagtagt

SEQ ID NO: 47469 - RNA, 432 nt, synthetic construct
  misc_feature 1..432: note = derived and/or modified sequence opt6 from anti-HIV-1_HeavyChain
  source 1..432: mol_type = other RNA
caagtacaattagtagaaagtggaggaggagtagtacaaccaggaggaagtttaagattaagctgtgcagcaagcggatttacatttagtagttatggaatgcattgggtaagacaagcaccaggaaaaggattagaatgggtagcatttataagatatgatggaagtaataaatattatgcagatagtgtaaaaggaagatttacaataagtagagaaaatagtaaaaatacactatatttacaaatgaatagtttaagagcagaagatacagcagtatatcattgtgcaaaagatttaggagaaagtgaaatagaagaatggacaagtgattattatgattttggaagagattatccaggacaagatccaagaggagtatttggaacatttgatatatggggacatggaacaatggtaacagtaagtagt

SEQ ID NO: 47470 - RNA, 432 nt, synthetic construct
  misc_feature 1..432: note = derived and/or modified sequence opt6 from anti-HIV-1_HeavyChain
  source 1..432: mol_type = other RNA
gaagtacaattagtagaaagtggaggaggagtagtaaaaccaggaggaagtttaagattaagttgtgtagtaagtggatttacatttagtaatgcgtggatgagttgggtaagacaagcaccaggaaaaggattagaatgggtagcagtaataagtgatgatggaagtaataaatattatgcagatagtgtaaaaggaagatttacaataagtagagataatagtaaaaatacattatatttacaaatgaatagtttaagagcagaagatacagcagtatattattgtgcaaaagatttaggagaaagtgaaaatgaagaatgggcatcagattattatgattttggaagtgattatccaggacaagatccaagagcagtagtaggagcatttgatatatggggacaaggaacaatggtaacagtaagtagt

SEQ ID NO: 47471 - RNA, 432 nt, synthetic construct
  misc_feature 1..432: note = derived and/or modified sequence opt6 from anti-HIV-1_HeavyChain
  source 1..432: mol_type = other RNA
caagtacaattagtagaaagtggaggaggagtagtacaaccaggaggaagtttaagactaagctgtgcagcaagtggatttacatttagtacatatggaatgcattgggtaagacaagcaccaggaaaaggattagaatgggtagcatttataagatatgatggaagaaataaaaattatgcagatagtgtaaaaggaagatttacaataagcagagataatagtaaaaatacattatatttacaaatgaatagtttaagagcagaagatacagcggtatattattgtgcaaaagatttaggagaaagtgaaaatgaagaatgggcaacagattattatgattttagtataggatatccagggcaagatccaagaggagtagtaggaatatttgatatatggggacaaggaacaatggtaacagtaagtagt

SEQ ID NO: 47472 - RNA, 432 nt, synthetic construct
  misc_feature 1..432: note = derived and/or modified sequence opt6 from anti-HIV-1_HeavyChain
  source 1..432: mol_type = other RNA
caagtacacttagtagaaagcggaggaggagtagtacaaccaggaggaagtttaagattaagctgtgcagcaagtggattctcattcagtatatatggaatgcactgggtaagacaagcaccaggaaaaggactagaatgggtaacatttacaagatatgatggatcaaacaaatactatacagatagcgtaaaaggaagatttacaataagcagagacaatagcaaaaacacactatatctacaaatgaatagcttaagaacagaagatacagcagtatattactgtgcaaaagacttaggagaaagcgaaaacgaagaatgggcatcagactattacgatttcggaagcgattacccaggacaagacccaagagcagtagtaggagcattcgatatatggggacaaggaacaatggtaacagtaagttca

SEQ ID NO: 47473 - RNA, 432 nt, synthetic construct
  misc_feature 1..432: note = derived and/or modified sequence opt6 from anti-HIV-1_HeavyChain
  source 1..432: mol_type = other RNA
caagtacaattagtagaaagtggaggaggagtagtacaaccaggaggaagtttaagattaagttgtgcagcaagtggatttacatttagtagttatggaatgcattgggtaagacaagcaccaggaaaaggattagaatgggtagcatttataagatatgatggatcaaataaatattatgcagatccagtaaaaggaagatttacaataagtagagataatagtaaaaatacattatatttacaaatgaatagtttaagagcagaagatacagcagtatattattgtgcaaaagatttaggagaaagtgaaaacgaagaatgggcaagtgattattatgattttggaagagattatccaggacaagatccaagaggagtagtaggagtgtttgatatatggggacaaggaacaatggtaacagcaagctca

SEQ ID NO: 47474 - RNA, 432 nt, synthetic construct
  misc_feature 1..432: note = derived and/or modified sequence opt6 from anti-HIV-1_HeavyChain
  source 1..432: mol_type = other RNA
gaaatgcaattagtagaaagtggaggaggattagtacaaccaggaggaagtttaagattaagctgtgcagcaagtggatttacatttagtagttattggatgagttgggtaagacaagcaccaggaaaaggattagaatgggtagcagtaataagttacgatggaaataataaatattatgcagacagtgtaaaaggaagatttacaataagtagagaaaatagcaaaaatacattatatttacaaatgaatagtttaagagcagaagatacagcagtatattattgtgcaaaagatttaggagaaagtgaaaatgaagaatgggcaagtgattattatgattttggaagtgattatccaggacaagatccaagaggagtagtaggaacatttgatatatggggacatggaacaatggtaacagtaagtagt

SEQ ID NO: 47475 - RNA, 432 nt, synthetic construct
  misc_feature 1..432: note = derived and/or modified sequence opt6 from anti-HIV-1_HeavyChain
  source 1..432: mol_type = other RNA
caagtacaattggtagaaagtggaggtggagtagtacaaccaggaagaagtttaagattgagttgtgcagcaagtggatttacatttagtagttgtgcaatgcattgggtaagacaagcaccaggaaaaggattagaatgggtagcagtaataagttatgatggaaataacaaacattatgcagatagtgtaaaaggaagatttacaataagtagagataatagtaaaaatacattatatttacaaatgaatagtttaagagcagaagatatggcagtatattattgtgcaaaagatttaggagaaagtgaaaatgaagaatgggcaagtgattattatgatttttggagagattatccgggacaagatccaagaggatgggtaggaacatttgatatatggggacaaggaacaatggtgacagtaagtagt

SEQ ID NO: 47476 - RNA, 432 nt, synthetic construct
  misc_feature 1..432: note = derived and/or modified sequence opt6 from anti-HIV-1_HeavyChain
  source 1..432: mol_type = other RNA
caagtacaattagtagaaagcggaggaggagtagtacaaccaggaagaagtttaagattaagctgtgcagcaagcggatttacattctcaaattatggaatgcactgggtaagacaagcaccaggaaaaggactagaatgggtaacagtaatatcaagtgatggatcaaaaaaatactatgcagatagtgtaaaaggaagatttacaataagcagagacaatagtaaaaacacattatatctacaaatgaatggattaagagcagacgatacagcagtatattactgtgcaaaagacttaggagatagtgaaaatgaagaatgggcatcagactattacgatttcggaagagattacccaggacaagacccaagaggagtagtaggagcattcgatatatggggacatggtacaatggtaacagtaagttca

SEQ ID NO: 47477 - RNA, 432 nt, synthetic construct
  misc_feature 1..432: note = derived and/or modified sequence opt6 from anti-HIV-1_HeavyChain
  source 1..432: mol_type = other RNA
caagtacaattagtagaaagtggaggaggagtagtacaaccaggaggaagtttaagattaagttgtgcagcaagtggatttacattttcaagttacggaatgcattgggtaagacaagcaccaggaaaaggattagaatgggtagcatttataagatatgatggaagtaataaatattatgcagatagtgtaaaaggaagatttacaataagtagagataatagtaaaaatacattatatttacaaatgaatagtttaagagcagtagatacagcagtatattattgtgcaaaagatttaggagaaggagaaaatgaagaatgggcaacagattattatgattttagtataggatatccaggacaagatccaagaggagtagtaggagcatttgatatatggggacaaggaacaatggtaacagtaagtagt

SEQ ID NO: 47478 - RNA, 432 nt, synthetic construct
  misc_feature 1..432: note = derived and/or modified sequence opt6 from anti-HIV-1_HeavyChain
  source 1..432: mol_type = other RNA
caagtacaattagtagaaagtggaggaggagtagtacaaccaggaagaagtctaagattaagttgtgcagcaagtggatttacatttagaaattatggaatgcattgggtaagacaaagtccaggaaaaggattagaatgggtagcagtaataagttatgatggaaaaataataaattatatagattttgtaaaaggaagatttacaataagcagagaaaatagtaaaaatacattatatttacaaatgaatagtttaagagcagaagatacagcagtatattattgtgcaaaagatttaggagaaagtgaaaatgaagaatgggcaagtgattattatgattttggaagtgattatccaggacaagatccaagaggagtagtaggaacatttgatatatggggacatgggacaatggtaacagtaagtagt

SEQ ID NO: 47479 - RNA, 432 nt, synthetic construct
  misc_feature 1..432: note = derived and/or modified sequence opt6 from anti-HIV-1_HeavyChain
  source 1..432: mol_type = other RNA
gaagtacaattactagaaagcggaggaggattagtacaaccaggaaggagtctaagattaagctgtgcagcaagcggattcacattttcaagttatgtaatgcactgggtaagacaagcaccaggaaaaggattagaatgggtagcagtaatatcatacgatggatcaaacaaacactatgcagatagcgtaaaaggaagatttacaataagtagagacaatagcaaaaacacactatatctacaaatgaatagcttaagagcagaagatacagcagtatattacagagcaaaagacttaggagaaagtgaaaatgaagaatgggcatcagactattacgatttcggaagagattacccaggacaagacccaagaggagtagtaggagtattatatatatggggacaaggaacaatggtaacagtaagctca

SEQ ID NO: 47480 - RNA, 432 nt, synthetic construct
  misc_feature 1..432: note = derived and/or modified sequence opt6 from anti-HIV-1_HeavyChain
  source 1..432: mol_type = other RNA
gaagtacaattagtagaaagcggaggaggattagtaaaaccaggaggaagtctaagattaagctgtgcagcaagcggattcacattctcaacatatagcatgcactgggtaagacaagcaccaggaaaaggactagaatgggtagcagtaatatcatacgatggaaataacaaatactatgcagatagcgtaaaaggaagatttacaataagcagagaaaatagtaaaaacacactatatctacaaatgaatagtttaagagcagaagatacagcagtatatcactgtgcaaaagacttaggagaaagcgaaaacgaagaatgggcatcagactattacgatttcggaagagattacccaggacaagacccaagaggagtagtaggaacattcgatatatggggacatggaacaatggtaacagtaagcagt

SEQ ID NO: 47481 - RNA, 432 nt, synthetic construct
  misc_feature 1..432: note = derived and/or modified sequence opt6 from anti-HIV-1_HeavyChain
  source 1..432: mol_type = other RNA
caagtgcaattagtagatagtggaggaggagtagtgcaaccaggaagatcattaagattattctgtgcagtaagcggattcacattcagcacatatacaatgcactgggtaagacaagcaccaggaagaggactagaatgggtagcagtaatatcatacgatggaagtacaaaatactatgcagatagcgtacaaggaagatttacaataagcagagacaatagcaaaaacacactatatctacaaatgaatagcttaagagcagaagatacagcagtatattactgtgcaaaagacttaggagaaagcgaaaatgaagaatgggcatcagactattacgatttcggaagcgattacccaggacaagacccaagagcggtagtaggagcatttgatatatggggacaaggaacaatggtaacagtaagctca

SEQ ID NO: 47482 - RNA, 426 nt, synthetic construct
  misc_feature 1..426: note = derived and/or modified sequence opt6 from anti-HIV-1_HeavyChain
  source 1..426: mol_type = other RNA
caagtacaattagtagaaagtggaggaggagtagtacaaccaggaagaagtttaagattaagttgtgcagcaagtggatttacatttagtagttttggaatgcattgggtaagacaagcaccaggaaaaggattagaatgggtagcagtaatatcatatgatggaaataataaatattatgcagatagtgtaaaaggaagatttacaataagtagagaaaatagtaaaaatacattatatttacaaatgaatagtttaagaccagaagatacagcagtatattattgtgcaaaagatttaggagaaagtgaaaatgaagaatgggcaagtgattactatgattttggaagagattatccaggacaagatccaagaggagtagtaggaacatttgatatatggggacatggaacaatggtaacagtg

SEQ ID NO: 47483 - RNA, 432 nt, synthetic construct
  misc_feature 1..432: note = derived and/or modified sequence opt6 from anti-HIV-1_HeavyChain
  source 1..432: mol_type = other RNA
caagtacaattagtagaaagtggaggaggagtagtacaaccaggaaggagcttaagattaagttgtgcagcaagtggatttatgtttagtagatatggaatgcattgggtaagacaagcaccaggaaaaggattagaatgggtagcagtaataagtcatgatggaagtaataaatattatgcagatagtgtaaaaggaagatttataataagtagagataatagcaaaaatacattatatttacaaatgaatagtttaagagcagatgatacagcagtatattattgtgcaaaagatttaggagaaagtgaaaatgaagaatgggcaagtgattattatgatttttggataggatatccaggacaagatccaagaggagtagtaggagcatttgatatatggggacaaggaacaatggtaacagtaagttca

SEQ ID NO: 47484 - RNA, 432 nt, synthetic construct
  misc_feature 1..432: note = derived and/or modified sequence opt6 from anti-HIV-1_HeavyChain
  source 1..432: mol_type = other RNA
caagtacaattagtagaaagtggaggaggagtagtacaaccaggaggaagtttaagattaagttgtgcagcaagtgcatttacatttagtagttatggaatgcattgggtaagacaagcaccaggaaaaggattagaatgggtagcatttataagatatgatggaagtaataaatattatgcagatagtgtaaaaggaagatttacaataagtagagataatagtaaaaatacattatttttacaaatgaatagcttaagagcagaagatatggcagtatattattgtgcaaaagatttaggagaaagtgaaaatgaagaatgggcaagtgattattatgatttttggagagattatccaggacaagatccaagaggatgggtaggaacatttgatatatggggacaaggaacaatggtaacagtaagtagt

SEQ ID NO: 47485 - RNA, 426 nt, synthetic construct
  misc_feature 1..426: note = derived and/or modified sequence opt6 from anti-HIV-1_HeavyChain
  source 1..426: mol_type = other RNA
caagtacaattagtagaaagtggaggaggagtagtacaaccaggaagatcattaagattaagctgtgcagcaagcggattcacattcagcagttttggaatgcactgggtaagacaagcaccaggaaaaggactagaatgggtagcagtaatatcatacgatggatcaaacaaatactatgtagatagcgtaaaaggaagatttacaataagtagagacaatagtaaaaatacactatatttacaaatgaatagcttaagagcagaagatacagcagtatatgcaaaagacttaggagaaagcgaaaatgaagaatgggcatcagactattacgatttcggaagtgattacccaggacaagacccaagaggagtagtaggaacattcgatatatggagtcaaggaacaatggtaacagtaagctca

SEQ ID NO: 47486 - RNA, 432 nt, synthetic construct
  misc_feature 1..432: note = derived and/or modified sequence opt6 from anti-HIV-1_HeavyChain
  source 1..432: mol_type = other RNA
caagtacaattagtagaaagtggaggaggagtagtacaaccaggaggaagtttaagactaagttgtgcagcaagtggatttacatttagtacatatggaatgcattgggtaagacaagcaccaggaaaaggattagattgggtagcatttataagatatgatggaagtcataaatattatgcagatagtgtaaaaggaagatttacaataagcagagaaaatagcaaaaatacattatatttacaaatgaatagtttaagaccagaagatacagcagtatattattgtgcaaaagatttaggagaaagcgaaaatgaagaatgggcaagtgattattatgattttggaagagattatccaggacaagatccaagaggagtagtaggaacatttgatatatggggacatggaacaatggtaacagtaagtagt

SEQ ID NO: 47487 - RNA, 432 nt, synthetic construct
  misc_feature 1..432: note = derived and/or modified sequence opt6 from anti-HIV-1_HeavyChain
  source 1..432: mol_type = other RNA
caagtacaattagtagaaagtggaggaggagtagtacaaccaggaagaagtctaagattaagttgtgcagcaagtggatttacatttagtagttatgcaatgcattgggtaaggcaagcaccaggaaaaggattagaatgggtagcagtaataagttatgatggatcaggagattattatgcagatagtgtaaaaggaagatttacaataagtagagataatagtaaaagcacattatatttacaaatgaatagtttaagaccagaagatacagcagtatattattgtgcaaaagatttaggagaaagcgaaaatgaagaatgggcaagtgattattatgattttggaagagattatccaggacaagatccaagaggagtagtaggaacatttgatatatggggacatggaacaatggtaacagtaagtagt

SEQ ID NO: 47488 - RNA, 432 nt, synthetic construct
  misc_feature 1..432: note = derived and/or modified sequence opt6 from anti-HIV-1_HeavyChain
  source 1..432: mol_type = other RNA
caagtacatttggtagaaagtggaggaggagtagtacaaccaggaggaagtttaagattaagttgtgcagcaagtgggtttacatttagtacatatggaatgcaatgggtaagacaagcaccaggaaaaggattagaatgggtagcatttataaaaaatgatggaacaaatgaattttatggagatagtgtaaaaggaagatttacgataagtagagataatagtaaaaatacagtaagtttacatatggatagtttaagaccagaagatacagcattatattattgtgcaaaagatttaggagaaagtgaaaatgaggaatgggcaagtgattattatgattttggaagtgattatccaggacaagatccaagagcagtagtaggagcatttgatatatggggacaaggaacaatggtaacagtaagttca

SEQ ID NO: 47489 - RNA, 432 nt, synthetic construct
  misc_feature 1..432: note = derived and/or modified sequence opt6 from anti-HIV-1_HeavyChain
  source 1..432: mol_type = other RNA
caagtacaattagtagaaagtggaggaggagtagtgcaaccaggaggaagtttaagattaagttgtgtagcaagcggatttacattttcaagttatggaatgcattgggtaagacaagcgccaggaaaaggactagaatgggtagcatttataagatatgatggaagaaataaatattatgcagatagtgtaaaaggaagatttacaataagtagagataaaagtaaaaatacattatgtctacaaatgaatagtttaagagtagaagatacagcagtatattattgtgcaaaagatttaggagatagtgaaaatgaagaatgggcaagtgattattatgattttgggagagattatccaggacaagatccaagaggagtagtaggagcatttgatatatggggacatggaacaatggtaacagtaagtagt

SEQ ID NO: 47490 - RNA, 432 nt, synthetic construct
  misc_feature 1..432: note = derived and/or modified sequence opt6 from anti-HIV-1_HeavyChain
  source 1..432: mol_type = other RNA
caagtacaattggtagaaagtggaggaggagtagtacaaccaggaagaagtttaagattaagctgtgcagcaagtggatttacatttagtagttatggaatgcattgggtaagacaagcaccaggaaaaggattagaatgggtagcagtaataagttatgatggatcaaataaatattatagagatagtgtaaaaggaagatttacaataagtagagataatagtaaaaatacagtatatttacaaatgaatagtttaagagcagaagatacagcagtatattattgtgcaaaagatttaggagaaagtgaaagtgaagaatgggcaagtgattattatgattttggaagagattatccaggacaagatccaagaggagtagtaggagcattagatatatggggacaaggaataatggtaacagtaagtagt

SEQ ID NO: 47491 - RNA, 432 nt, synthetic construct
  misc_feature 1..432: note = derived and/or modified sequence opt6 from anti-HIV-1_HeavyChain
  source 1..432: mol_type = other RNA
gaagtacaattagtagaaagtggaggaggaatggtacaaccaggaagaccattaagattaagttgtgcagcaagtggatttatatttagtggatttggactacattgggtaagacaagcaccaggaaaaggattagaatgggtagcaagtataagttatgatggaggaaataaatattatgcagatagtgtaagaggaaggtttacaataagtagagataatagtaaaaatacattatatttacaaatgaatagtttaagagcagaagatacagcagtatattattgtgcaaaagatttaggagaaagtgaaaatgaagaatgggcaagtgattattatgattttggaagtgattatccaggacaagatccaagagcagtagtaggagcatttgatatatggggacaaggaacaatggtaacagtaagtagt

SEQ ID NO: 47492 - RNA, 432 nt, synthetic construct
  misc_feature 1..432: note = derived and/or modified sequence opt6 from anti-HIV-1_HeavyChain
  source 1..432: mol_type = other RNA
gaagtacaattagtagaaagtggaggaggagtagtaagaccaggaggaagtctaagattaagttgtgcagcaagtggatttacatttaatgattatggaatggcatgggtaagacaagcaccaggaaaaggattagaatgggtagcagatataagttatgatggaagcaataaatattatgcagatagtgtaaaaggaagatttacaataagtagagataatagtaaaaatacattatatttacaaatgaatagtttaagagcagaagatacagcagtatattattgtgcaaaagatttaggagaaagtgaaaatgaagaatgggcaagtgattattatgattttggaagagattatccaggacaagatccaagaggagtagtaggagcatttgatatatggggacaaggaacaatggtaacagtaagtagt

SEQ ID NO: 47493 - RNA, 429 nt, synthetic construct
  misc_feature 1..429: note = derived and/or modified sequence opt6 from anti-HIV-1_HeavyChain
  source 1..429: mol_type = other RNA
caagtacaattagtagaaagtggaggaggagtagtacaaccaggaaggtcattaagattaagctgtgcagcaagtggattcacatttagtagttatggaatgcattgggtaagacaagcaccaggaaaaggattagaatgggtagcagtagtaagttatgatgaaagtaaatattatgcagatagtgtaaaaggaagatttacaataagtagagataatagtaaaaatacattatatttacaaatgaatagtttaagagcagaagatatggcagtatattattgtgcaaaagatttaggagaaagtgaaaatgaagaatgggcaagtgattattatgaattttggagagattatccaggacaagatccaagaggatgggtaggaacatttgatatatggggacaaggaacaatggtaacagtaagtagt

SEQ ID NO: 47494 - RNA, 432 nt, synthetic construct
  misc_feature 1..432: note = derived and/or modified sequence opt6 from anti-HIV-1_HeavyChain
  source 1..432: mol_type = other RNA
caagtacaattagtagaaccaggaagaggagtagtacacccaggaggaagtttaagactaagctgtgtaacaagcggattcacatttgaaaattttccaatgcactgggtaagacaagcaccaggaaaaggactagaatgggtagcattaatatcatatgatggatcagacaaatactatagcgatagcgtaaaaggaagatttacaataagcagagacaatagcaaaaacacattatatttacaaatgaatagcttaagagcagaagatacagcagtatattactgtgcaaaagacttaggagaaagtgaaaatgaagaatgggcatcagactattacgatttcggaagcgattacccaggacaagacccaagaggagtagtaggaacattcgatatatggggacatggaacaatggtaacagtaagttca

SEQ ID NO: 47495 - RNA, 432 nt, synthetic construct
  misc_feature 1..432: note = derived and/or modified sequence opt6 from anti-HIV-1_HeavyChain
  source 1..432: mol_type = other RNA
caagcacaattagtagaaagtggaggaggagtagtacaaccaggaagaagtttaagattaagttgtgcagcaagtggatttagttttgcaacacatgcaatgcattgggtaagaagaagtccaggaaaaggattagaatgggtagcaacaataagttatggaggaaaaaatgaatattatgcagatagcgtaaaaggaagatttacaataagtagagaaaatagtaaaaatacattatatttacaaatgaatagtttaagagcagaagatacagcagtatattattgtgcaaaagatttaggagaaagtgaaaatgaagaatgggcaagtgattattatgattttggaagtgattatccaggacaagatccaagaggagtagtaggaacatttgatatatggggacatggaacaatggtaacagtaagtagt

SEQ ID NO: 47496 - RNA, 432 nt, synthetic construct
  misc_feature 1..432: note = derived and/or modified sequence opt6 from anti-HIV-1_HeavyChain
  source 1..432: mol_type = other RNA
gcagtacaattagtagaaagtggaggaggattagtaaaaccaggaggaagtttaagattaagttgtgcagcaagtggatttacattttttaatacatggatgagctgggtaaggcaaagtccaggaaaaggattagaatgggtagcagatataagttatgatggaagtaataaatattatgcagatagtgtaaaaggaagatttacaataagtagagataatagtaaaaatacattatatttacaaatgaatagtttaagagcagaagatacagcagtatattattgtgcaaaagatttaggagaaagtgaaaatgaagaatgggcaagtgattattatgattttggaagagattatccaggacaagatccaagaggagtagtaggagtgtttgatatatggggacaaggaacaatggtaacagtaagtagt

SEQ ID NO: 47497 - RNA, 432 nt, synthetic construct
  misc_feature 1..432: note = derived and/or modified sequence opt6 from anti-HIV-1_HeavyChain
  source 1..432: mol_type = other RNA
caagtacaattagtagaaagcggaggaggagtagtacaaccaggaagaagtttaagattaagctgtgcagcaagcggatttacattttcaagctatggaatgcactgggtaagacaagcgccaggaaaaggactagaatgggtagcagtaatatcatatgatggatcaaataaatattatgcagatagtgtaaaaggaagatttacaataagcagagacaatagtaaaaatacattatatctacaaatgaatagtttaagagcagaagatacagcagtatattactgtgcaaaagacttaggagaaagtgaaaatgaagaatgggcatcagactattatgatttcggaagtgattatccaggacaagacccaagagcagtagtaggagcatttgatatatggggacaaggaacaatggtaacagtaagcagt

SEQ ID NO: 47498 - RNA, 432 nt, synthetic construct
  misc_feature 1..432: note = derived and/or modified sequence opt6 from anti-HIV-1_HeavyChain
  source 1..432: mol_type = other RNA
caagtaagattagtagaaagtggaggaagagtagtacaaccaggaggaagtttaagattaagttgtgtagcaagcggatttacatttagtagttatggaatacattgggtaagacaagcaccaggaaaaggattagaatgggtaacatttatatggcatgatggaagagatacatattatgcagatgcagtaaaaggaagatttacaataagtagagataatagtaaaaatacattatatttacaaatgaatagtttaagagcagaagatacagcggtatattattgtgcaaaagatttaggagaaagtgaaaatgaagaatgggcaacagattattatgatttttggacaggatatccaggacaagatccaagagcagtagtaggagcatttgatatatggggacaaggaacaatggtaacagtaagtagt

SEQ ID NO: 47499 - RNA, 432 nt, synthetic construct
  misc_feature 1..432: note = derived and/or modified sequence opt6 from anti-HIV-1_HeavyChain
  source 1..432: mol_type = other RNA
caagtacatttagtagaaagcggaggaggagtagtacaaccaggaagaagtttaagaatatactgtgcagtaagtgaatttacattcagaaattatgcaatgcactgggtaagactagcaccaggaaaaggactacaatgggtagcagtaatatcatatgatggatcaaataaatattatggagatagtgtaaaaggaagatttacaataagcagagacaatagtaaaaatacactatatttacaaatggatagcttaagagcagaagatacagcagtatattactgtgcaaaagacttaggagaaagtgaaaatgaagaatgggcatcagactattatgatttcggaagagattatccaggacaagacccaagaggagtagtaggaacatttgatatatggggacatggaacaatggtaacagtaagttca

SEQ ID NO: 47500 - RNA, 432 nt, synthetic construct
  misc_feature 1..432: note = derived and/or modified sequence opt6 from anti-HIV-1_HeavyChain
  source 1..432: mol_type = other RNA
gaagtacaattagtagaaagtggaggaggattagtaaaaccaggaggaagtttaagattaagttgtgcagcaagtggatttacatttagtgatgcatggatgagctgggtaagacaagcaccaggaaaaggaatggaatgggtagcagtaataagttatgatggaagtaataaatattatgcagatagtgtgaaaggaagatttacaataagtagagataatagtaaaaatacattatatctacaaatgaatagtttaagagcagtagatacagcagtatattattgtgcaaaagatttaggagaaggagaaaatgaagaatgggcaacagattattatgattttagtataggatatccaggacaagatccaagaggagtagtaggagcatttgatatatggggacaaggaacaatggtaacagtaagtagt

SEQ ID NO: 47501 - RNA, 432 nt, synthetic construct
  misc_feature 1..432: note = derived and/or modified sequence opt6 from anti-HIV-1_HeavyChain
  source 1..432: mol_type = other RNA
gaagtacaagtagtagaaagtggaggaggattagtaaaaccaggaggaagtttaagattaagttgtgaagcaagtggatttacatttagtaatgcatggatgagttgggtaagacaagcaccaggaaaaggattagaatgggtagcagtaataagttatgatggaaataataaatattatgcagatagcgtaaaaggaagatttacaataagtagagaaaatagtaaaaatacattatatttacaaatgaatagtttaagagcagaagatacagcagtatatcattgtgcaaaagatttaggagaaagtgaaaatgaagaatgggcaagtgattattatgattttggaagagattatccaggacaagatccaagaggagtagtaggaacatttgatatatggggacatggaacaatggtaacagtaagtagt

SEQ ID NO: 47502 - RNA, 432 nt, synthetic construct
  misc_feature 1..432: note = derived and/or modified sequence opt6 from anti-HIV-1_HeavyChain
  source 1..432: mol_type = other RNA
caagtacaattagtagaaagcggaggaggagtagtacaaccaggaggaagtttaagattaagctgtgcagcaagtggatttacatttagtagttatggaatacattgggtaagacaagcaccagggaaaggattagaatgggtagcatttataagaagtgatgcaacaaataaatattatgcagatagtgtaaaaggaagatttacaataagtagagaaaatagtaaaaatacattatatctacaaatgaatagtttaagagcagaagatacagcagtatattattgtgcaaaagatttaggagaaagtgaaaatgaagaatgggcaagtgattattatgattttggaagtgattatccaggacaagatccaagaggagtagtaggaacatttgatatatggggacatggaacaatggtaacagtaagtagt

SEQ ID NO: 47503 - RNA, 432 nt, synthetic construct
  misc_feature 1..432: note = derived and/or modified sequence opt6 from anti-HIV-1_HeavyChain
  source 1..432: mol_type = other RNA
caagtacaattagtagaaagtggaggaggagtagtacaaccaggaagaagtttaagattaagttgtgcagcaagtggatttacattttcaagttttggaatgcactgggtaagacaagcaccaggaaaaggattagaatgggtagcagtaataagttatgatggaaataataaatattatgcagatagtgtaaaaggaagatttacaataagcagagaaaatagtaaaaatacactttatttacaaatgaatagtttaagagcagaagatacagcagtatattattgtgcaaaagatttaggagaaagtgaaaatgaagaatgggcatcagattattatgattttgggagtgattatccaggacaagatccaagaggagtagtaggaacatttgatatatggggacatggaacaatggtaacagtaagtagt

SEQ ID NO: 47504 - RNA, 432 nt, synthetic construct
  misc_feature 1..432: note = derived and/or modified sequence opt6 from anti-HIV-1_HeavyChain
  source 1..432: mol_type = other RNA
caagtacaattagtagaaagtggaggaggagtagtacaaccaggaagaagtttaagactaagttgtgcagcaagtggatttacatttagtaattatgcaatggattgggtaagacaagcaccaggaaaaggattagaatgggtagcagtaataagttatgatggaagtaataaatattatgcagatagtgtaaaaggaagatttacaataagtagagataatagcaaaaatacattatatttacaaatgaatagtttaagagcagaagatacagcagtatattattgtgcaaaagatttaggagaaagtgaaaatgaagaatgggcaacagattattatgatttttggacaggatatccaggacaagatccaagagcagtagtaggagcatttgatatatggggacaaggaacaatggtaacagtaagtagt

SEQ ID NO: 47505 - RNA, 432 nt, synthetic construct
  misc_feature 1..432: note = derived and/or modified sequence opt6 from anti-HIV-1_HeavyChain
  source 1..432: mol_type = other RNA
caagtacaattagtagaaagtggaggaggagtagtacaaccaggaaggagcttaagattaagttgtgcagcaagtggatttacatttagtagttatggaatgcattgggtaagacaagcaccaggaaaaggattagaatgggtagcagtagtaagttatgatgaaagtaataaatattatgcaggaagtgtaaaaggaaggtttacaataagtagagataatagtaaaaatacattatatttacaaatgaatagtttaagaacagaagatatggcagtatattattgtgcaaaagatttaggagaaagtgaaaatgaagaatgggcaagtgattattatgattttggaagagaatatccaggacaagatccaagaggatgggtaggaacatttgatatatggggacaaggaacaatggtaacagtaagtagt

SEQ ID NO: 47506 - RNA, 432 nt, synthetic construct
  misc_feature 1..432: note = derived and/or modified sequence opt6 from anti-HIV-1_HeavyChain
  source 1..432: mol_type = other RNA
caagtacaattagtagaaagtggaggaggagtagtacaaccaggaagaagtttaagattaagttgtgcagcaagtggatttacatttagtagttatggaatgcattgggtaagacaagcaccaggaaaaggattagaatgggtagcagtaataagttatgatggaagtaataaatattatgtagatagtgtaaaaggaagatttacaataagtagagataatagtaaaaatacattatatttacaaatgaatagtttaagagcagaagatacagcagtatattattgtgcaaaagatttaggagaaagtgaaaatgaagaatgggcaacagattattatgattttagtataggatatccaggacaagatccaagaggagtagtaggaatatttgatatatggggacaaggaacaatggtaacagtaagtagt

SEQ ID NO: 47507 - RNA, 432 nt, synthetic construct
  misc_feature 1..432: note = derived and/or modified sequence opt6 from anti-HIV-1_HeavyChain
  source 1..432: mol_type = other RNA
caagtacaattagtagaaagtggaggaggagtagtacaaccaggaagaagtttaagattaagttgtgcagcaagtggatttacatttagtacaagtggaatgcattgggtaagacaagcaccaggaaaaggaatggaatgggtagcagtaataagttatgatggaagtaataaatattatgcagatagtgtaaaaggaagatttacaataagtagagataatagcaaaaatacactatatttacagatgaatagtttaagagcagtagatacagcagtatattattgtgcaaaagatttaggagaaggagaaaatgaagaatgggcaacagattattatgattttagtataggatatccaggacaagatccaagaggagtagtaggagcatttgatatatggggacaaggaacaatggtaacagtaagcagt

SEQ ID NO: 47508 - RNA, 363 nt, synthetic construct
  misc_feature 1..363: note = derived and/or modified sequence opt6 from anti-HIV_C38-VRC18.02_HeavyChain
  source 1..363: mol_type = other RNA
caagtaagattagtacaaagtggaaatcaagtaagaaaaccaggagcaagtgtaagaataagttgtgaagcaagtggatataaatttatagatcattttatacattgggtaagacaagtaccaggacatggattagaatggctaggatggataaatccaagaggaggaggagtaaattatagtagaagttttcaaggaaaattaagtatgacaatgacaagagataattttgaagaaacagcatatttagatttaagtaaactaaatccaggagatacagcagtatatttttgtgcaagaggatttgcaggatatgaatggagttttatatggggacaaggaacattagtaatagtaagcagt

SEQ ID NO: 47509 - RNA, 396 nt, synthetic construct
  misc_feature 1..396: note = derived and/or modified sequence opt6 from anti-HIV_44-VRC13.02_HeavyChain
  source 1..396: mol_type = other RNA
caagtacaattagtacaatcaggaacagcactaaaaagtccaggatcaagtgcaaaattaagttgtacagtactaggagatgaatttggaacatatttcataagctggataagacaagcaccaggacaaggactagaatgggtaggaggaatagtaccacatagccaattacaaagttcagcacaaaaatttcacggaagaataataataagcgcaggagcaggagtaacaccaccagtagtatcactacaactaacaaacttaacatttgaagatacaggaacatatttctgtgcaagagaaagaggaagacacagagacccaaaaacaggagatgcattaagaggaagatatttcgatttctggggaagaggaacaggattaagagtaagcaca

SEQ ID NO: 47510 - RNA, 321 nt, synthetic construct
  misc_feature 1..321: note = derived and/or modified sequence opt6 from anti-HIV-1_LightChain
  source 1..321: mol_type = other RNA
gatataaaactaacacaatcaccagcattcttaagtgcaagcgtaggagaaagagtaacatttacatgtagagcaagccaagacataagccatgacttagtatggttccaacaaaaagcaggaagagcaccatcactattaatgttttacggaagcacactagaaagaggagtaccaccaagattctcaggaagaagatcaggaacagaatttacagtaacaatagactcactacaaccagaagacgtaggaacatactattgccaacaattaagcgcattcccactaacattcggaggaggaacaacagtagatataaaa

SEQ ID NO: 47511 - RNA, 321 nt, synthetic construct
  misc_feature 1..321: note = derived and/or modified sequence opt6 from anti-HIV-1_LightChain
  source 1..321: mol_type = other RNA
gatataaaaatgacacaatcaccagcattcttaagcgcaagcgtaggagaaagagtaacatttacatgtagagcaagccaagacataagccatgacgtagtatggttccaacaaaaatcaggaagcgcaccaaaactattaatgttttacggaagcacactagaaagaggagtaccaccaagattcagcggaagaagatcaggaacagaatttacagtaacaatagacggactacaaccagaagacgtaggaacatactattgccaacaattaagcgcattcccactaacattcggaggaggaacaacagtagatataaaa

SEQ ID NO: 47512 - RNA, 321 nt, synthetic construct
  misc_feature 1..321: note = derived and/or modified sequence opt6 from anti-HIV-1_LightChain
  source 1..321: mol_type = other RNA
gatataaaactaacacaatcaccagcattcttaagtgcaagcgtaggagaaagagtaacatttacatgtagagcaagccaagacataagacatgaattagtatggtaccaacaaaaaccaggaagaggaccaaaattattaatatattacggaagtacactagaaggaggagtaccaagcagattctcaggaagaagatcaggaacagaatttacagtaacaataagctcactacaaccagaagacgtaggaacatactattgccaacaattaaactcattcccactaacattcggaggaggaacaacagtagatataaga

SEQ ID NO: 47513 - RNA, 321 nt, synthetic construct
  misc_feature 1..321: note = derived and/or modified sequence opt6 from anti-HIV-1_LightChain
  source 1..321: mol_type = other RNA
gacatacaactaacacaatcaccatcattcctatcagcatcagtaggagacagagtatcaataacatgcagagcatcacaaggaataaaacacgaactagcatggtaccaacaaaaaccaggaagagcaccatcactactaatatactacgcatcaacactagcaagaggagtaccatcaagattctcagcatcatggtcaggaacactattcacactaacaataaacggactacaaccagaagacttcgcaacatacttctgccaacaaatgaactcactaccactaacattcggaggaggaacaaaaatggacgtaaga

SEQ ID NO: 47514 - RNA, 321 nt, synthetic construct
  misc_feature 1..321: note = derived and/or modified sequence opt6 from anti-HIV-1_LightChain
  source 1..321: mol_type = other RNA
gacatacaactaacacaatcaccatcattcctatcagcatcagtaggagacaaagtaacaataacatgcagagcatcacacggagtaagaaacgaactagcatggtaccaacaaaaaccaggaaaagcaccaaacctactaatatactacgcatcaacactacaatcaggagtaccatcaagattctcagcaacaggatcaggaacacacttcacactaacagtatcatcactacaaccagaagacttcgcaacatacttctgccaacacatgtcatcatacccactaacattcggaggaggaacaaaagtagaaataaaa

SEQ ID NO: 47515 - RNA, 321 nt, synthetic construct
  misc_feature 1..321: note = derived and/or modified sequence opt6 from anti-HIV-1_LightChain
  source 1..321: mol_type = other RNA
gacatacaactaacacaatcaccatcattcctatcagcatcagtaggagacaaagtaacattcacatgcagagcatcacaaggagtaagaaacgaactagcatggtaccaacaaaaaccaggaaaagcaccaaacctactaatatactacgcatcaacattacaatcaggagtaccatcaagattctcagcaacaggatcaggaacacacttctcactaacagtatcatcactacaaccagaagacttcgcaacatacttctgccaacacatgtcatcatacccactaacattcggaggaggaacaaaagtagaaataaaa

SEQ ID NO: 47516 - RNA, 321 nt, synthetic construct
  misc_feature 1..321: note = derived and/or modified sequence opt6 from anti-HIV-1_LightChain
  source 1..321: mol_type = other RNA
gacatacaactaacacaatcaccatcattcctatcagcatcagtaggagacaaagtaacaataacatgccgagcatcacaaggagtaagaaacgaactagcatggtaccaacaaaaaccaggaaaagcaccaaacctactaatatactacgcatcaacattacaatcaggagtaccatcaagattctcagcaacaggatcaggaacacacttcacattaacagtatcatcactacaaccagaagacttcgcaacatacttctgccaacacatgtcatcatacccactaacattcggaggaggaacaaaagtagaaataaaa

SEQ ID NO: 47517 - RNA, 366 nt, synthetic construct
  misc_feature 1..366: note = derived and/or modified sequence opt6 from anti-HIV-1_HeavyChain
  source 1..366: mol_type = other RNA
agtcaatatttagcacaaccaggagcagaagtagcaaaaccaggagcaagtgtaaaagtaagttgtaaagtacacggagacaatttcagaggacattatttacactgggtaagacaagcaccaggacaaggactacaatggataggaggaataaatccatttagcggagaagcagcatatggaaaaagatttgaaggaagattaagattaacaagagacacaagtgtaaatacagcatatatggaattagcaaaactaacaccagacgatacagcagtatatttctgtgcaagagataaaacatataacgatgaatttacagcaatggatatatggggacatggaacaacagttatagtaagcagt

SEQ ID NO: 47518 - RNA, 366 nt, synthetic construct
  misc_feature 1..366: note = derived and/or modified sequence opt6 from anti-HIV-1_HeavyChain
  source 1..366: mol_type = other RNA
agtcaatatttagcacaaccaggagcagaagtagcaaaaccatgggcaagtgtaaaagtaagttgtagagtacatggagataattttagaggattttatctacattgggtaagacaagcaccaggacaaggattagaatggataggaggaataaatccatttagtggagaagcagcatatggaagaagatttgaaggaagattaagattaacaagagatacgagtataaatacagcatatatggaagtaacaaaattaacaagtgatgatacagcagtatatttttgtgcaagagataaaacatataatgatgaatttacagcaatggatatatggggacaaggaacaacagtaatagtaagtagt

SEQ ID NO: 47519 - RNA, 366 nt, synthetic construct
  misc_feature 1..366: note = derived and/or modified sequence opt6 from anti-HIV-1_HeavyChain
  source 1..366: mol_type = other RNA
tcacaatatttagcacaatcaggatcagaagtaaaaaaaccaggagcatcagtaaaagtatcatgcagactacatggagataaatttggagcacactatatacattgggtaagacaagcaccaggacaaggattagaatggctaggattctttcacccaggaacaggagatgccgtaagtgcacaaaaatttcaaggaagaatatcattaacaagagatacatcaatatcaacaggatacttagaagtaagaagattatcaagtgatgacacagcagtatactattgcgcaagagataaaacatactcagacgaagcaacaggaatggacatatggggacaaggaacaacagtaatagtatcaagc

SEQ ID NO: 47520 - RNA, 366 nt, synthetic construct
  misc_feature 1..366: note = derived and/or modified sequence opt6 from anti-HIV-1_HeavyChain
  source 1..366: mol_type = other RNA
tcactagaactagtacaatcaggaacagaagtaaaaaaaccaggagcatcagtaaaagtatcatgcaaactatttggagatacaataacatcaggaccaatacattgggtaagacaagcaccaggacaaggattagaatggatgggatggacaaacccacactcaggagatacagcaacagcaccaaaattccaaggaagagtatatatgacaaacgataaaaaaataaatacagcattcttagacgtaacaagattagcaagcgatgacacagcaatatacttttgcgcaagagatatgtattactcaaacgaagcagtaggaatggacgtatggggacaaggaacaacagtatcagtatcaagc

SEQ ID NO: 47521 - RNA, 366 nt, synthetic construct
  misc_feature 1..366: note = derived and/or modified sequence opt6 from anti-HIV-1_HeavyChain
  source 1..366: mol_type = other RNA
caagaagtattagtacaaagtggagcagaagtaaaaaaaccaggagcaagtgtaaaagtaagttgtagagcatttggatatacatttacagcacatgcattacattgggtaagacaagcaccaggacaaggattagaatggttaggatggataaatccacatagtggagatacaacaacaagtcaaaaatttcaaggaagagtatatatgacaagagataaaagtataaatacagcatatttagaagtaacaagattaacaagtgatgatacagcaatattttattgtgcaagagataaatattatggagatgaagcagtaggaatggatgtatggggacaaggaacaagtgtaacagtaagtagt

SEQ ID NO: 47522 - RNA, 366 nt, synthetic construct
  misc_feature 1..366: note = derived and/or modified sequence opt6 from anti-HIV-1_HeavyChain
  source 1..366: mol_type = other RNA
caagaagtattagtacaaagcggagcagaagtaaaaaaaccaggagcaagtgtaaaagtaagttgtagagcatttggatatacatttacaggaaatgcattacattgggtaagacaagcaccaggacaagggctagaatggttaggatggataaatccacatagtggagatacaacaacaagtcaaaaatttcaaggaagagtatatatgacaagagataaagcaataaatacagcatatttagatgtaacaagattaacaagtgatgatacagcaatatattattgtgcaagagataaatattatggaaatgaagcagtaggaatggatgtatggggacaaggaacaagtgtaacagtaagtagt

SEQ ID NO: 47523 - RNA, 366 nt, synthetic construct
  misc_feature 1..366: note = derived and/or modified sequence opt6 from anti-HIV-1_HeavyChain
  source 1..366: mol_type = other RNA
caagaagtattagtacaaagcggagcagaagtaaaaaaaccaggagcaagtgtaaaagtaagttgtagagcatttggatatacatttacaggaaatgcattacattgggtaagacaagcaccaggacaaggattagaatggttaggatggataaatccacatagtggagatacaacaacaagtcaaaaatttcaaggaagagtatatatgacaagagataaaagtataaatacagcatttttagatgtaacaagattaacaagtgatgatacaggaatatattattgtgcaagagataaatattatggaaatgaagcagtaggaatggatgtatggggacaaggaacaagtgtaacagtaagtagt

SEQ ID NO: 47524 - RNA, 303 nt, synthetic construct
  misc_feature 1..303: note = derived and/or modified sequence opt6 from anti-HIV_45_LightChain
  source 1..303: mol_type = other RNA
tcactaacacaatcaccaggaacactatcactatcaccaggagaaacagcaataatatcatgcagaacatcacaatacggatcactagcatggtaccaacaaagaccaggacaagcaccaagattagtaatatactcaggatcaacaagagcagcaggaataccagacagattctcaggatcaagatggggaccagactacaacctaacaatatcaaacctagaatcaggagacttcggagtatactactgccaacaatacgaattcttcggacaaggaacaaaagtacaagtagacataaaa

SEQ ID NO: 47525 - RNA, 303 nt, synthetic construct
  misc_feature 1..303: note = derived and/or modified sequence opt6 from anti-HIV_45_LightChain
  source 1..303: mol_type = other RNA
gtactaacacaatcaccaggaacactatcactatcaccaggagaaacagcaacaatatcatgcagaacatcacaatacggatcattagcatggtaccaacaaagaccaggacaagcaccaagactagtaatatactcaggatcaacaagagcagcaggaataccagacagattctcaggatcaagatcaggaccagactacacattaacaatatcaaacctagaatcaggagacttcggagtatactactgccaacaatacgaattcttcggacaaggaacaaaagtacaacaagacaacaaa

SEQ ID NO: 47526 - RNA, 303 nt, synthetic construct
  misc_feature 1..303: note = derived and/or modified sequence opt6 from anti-HIV_45_LightChain
  source 1..303: mol_type = other RNA
gtactaacacaatcaccaggaacactatcactatcaccaggagaaacagcaataatatcatgcagaacatcacaatacggatcattagcatggtaccaacaaagaccaggacaagcaccaagactagtaatatactcaggatcaacaagagcagcaggaataccagacagattctcaggatcaagatggggaccagactacaacctaacaatatcaaacctagaatcaggagacttcggagtatactactgccaacaatacgaattcttcggacaaggaacaaaagtacaagtagacataaaa

SEQ ID NO: 47527 - RNA, 363 nt, synthetic construct
  misc_feature 1..363: note = derived and/or modified sequence opt6 from anti-HIV_45_HeavyChain
  source 1..363: mol_type = other RNA
caagtaagattaagtcaaagtggaggacaaatgaaaaaaccaggagaaagtatgagaataagttgtagagcaagtggatatgaatttatagattgtacattaaattggataagattagcaccaggaagaagaccagaatggatgggatggttaaaaccaagaggaggagcagtaaattatgcaagagtatttcaaggaagagtaacaatgacaagagatgtatatagtgatacagcatttttagaattaagaagtttaacagcagatgatacagcagtatatttttgtacaagaggaaaaacagtagattataattgggattttgaacatgtaggaccaggaacaccagtaacagtaagtagt

SEQ ID NO: 47528 - RNA, 363 nt, synthetic construct
  misc_feature 1..363: note = derived and/or modified sequence opt6 from anti-HIV_45_HeavyChain
  source 1..363: mol_type = other RNA
caagtaagattaagtcaaagtggaggacaaatgaaaaaaccaggagaaagtatgagaataagttgtcaagcaagtggatatgaatttatagattgtacattaaattgggtaagattagcaccaggaagaagaccagaatggatgggatggttaaaaccaagaggaggagcagtaaattatgcaagaatatttcaaggaagagtaacaatgacaagagatgtatatagtgacacagcatttttagaattaagaagtttaacagcagatgatacagcagtatatttttgtacaagaggaaaaaattgtgattataattgggattttgaacatgtaggaccaggatatccagtaacagtaagtcca

SEQ ID NO: 47529 - RNA, 375 nt, synthetic construct
  misc_feature 1..375: note = derived and/or modified sequence opt6 from anti-HIV_45_HeavyChain
  source 1..375: mol_type = other RNA
caagtaagattaagtcaaagcggaggacaaatgaaaaaaccaggagatagtatgagaataagttgtagagcaagtggatatgaatttataaattgtccaataaattggataagattagcaccaggaaaaagaccagaatggatgggatggatgaaaccaagaggaggagcagtaagttatgcaagacaattacaaggaagagtaacaatgacaagagatatgtatagtgaaacagcatttttagaattaagaagcttaacaagtgatgatacagcagtatatttttgtacaagaggaaaatattgtacagcaagagattattataattgggattttgaacattggggacaaggaacaccagtaacagtaagtagt

SEQ ID NO: 47530 - RNA, 435 nt, synthetic construct
  misc_feature 1..435: note = derived and/or modified sequence opt6 from anti-HIV_cap256-206-252885_VR-Chain
  source 1..435: mol_type = other RNA
caagaacaattagtagaaagtggaggaggagtagtaccaccaggaagtagtttaacattaagttgtgtagcaagtagatttacatttagtgcatttggaatgcattgggtaagacaagcaccaggaaaaggattagaatgggtagcaggagtaagttttgtaggaataaaaaaatattatgcagatagtgtaaaaggaaggtttacaataagtagagataatagtaaaaatacattatttttacaaatgaatggattaagaggagaagatacaggattatattattgtgtaaaagatatgagatatttagaatgtgaagaatgggcaagtgattattatgattttggaaaaccaaatcaaccatgtttagatagaagaggagtaagtgggataagtgcattttggggacaaggaacaacagtaacagtaagtagt

SEQ ID NO: 47531 - RNA, 438 nt, synthetic construct
  misc_feature 1..438: note = derived and/or modified sequence opt6 from anti-HIV_cap256-206-249183_VR-Chain
  source 1..438: mol_type = other RNA
caagtattattagtagaaagcggaggtggagtagtagaaccaggaacaagcttaacactaagttgtgcagcaagtagatttacatttagtaattttggaatgcattgggtaagacaaacaccaggaggaggattagaatgggtagcaagtataagtaatgaaggaaataaaaaatatcatgcagaaagtgtatggggaagatttataataagtagagataatagtaaaaatacagtatttttacatatgagcagtttaagaccagatgatagtgcattatatttttgtgtaagagatagacaagaagatgattgtgaagtatggtggagtgattatgaagcatttggaagagaaataccatgtagacaatatagaggacaaggactagcaggaatatttgatatatggggaagaggaacaatggtaacagtaagtagt

SEQ ID NO: 47532 - RNA, 438 nt, synthetic construct
  misc_feature 1..438: note = derived and/or modified sequence opt6 from anti-HIV_cap256-206-220956_VR-Chain
  source 1..438: mol_type = other RNA
caaatgatgttagtagaaagtggaggagatgtagtagaaccaggaagaagtttaacattaagttgtgcaacaagtcaatttacatttagtaattatggaatgcattgggtaagacaagcaccaggaagaggactagaatgggtagcaagtataagtaatgaaggaaataaaaaatatcatgcagaaagtgtatggggaagattaataataagtagagataatagtaaaaatacattatttttacatatgagtagtttaagagcagatgatagtgcattatatttttgtgtaagagatagacaagaagatgaatgtgaagaatggtggagtaattattatgcatttggaagaggaggaccatgtagaaaatatagaggacaaggattagcaggaatatttgatgtatggggaagaggaacaatggtaacagtaagcagt

SEQ ID NO: 47533 - RNA, 432 nt, synthetic construct
  misc_feature 1..432: note = derived and/or modified sequence opt6 from anti-HIV_cap256-206-220629_VR-Chain
  source 1..432: mol_type = other RNA
caagaacaattagtagaaagtggaggaggagtagtaccaccaggaaaaagtttaaaattaagttgtgtagcaagtagatttagttttggagcatttggaatgcattgggtaagacaagcaccaggaaaaggattagaatgggtagcaggaataagttttgcaggaataaaaaaatattatggagatagtgtaaaaggaagattttatataagcagagataatagtcaaaatacactatttttagaaatgaatggattaagaggagatgatacagcaagatattattgtgtaaaagatttaagagaattagaatgtgaagaatgggcaagtgattattatgattttggaaaaccacaaccatgtttagatagtagaggagtaagtggaataagtgcaatgtggggaccaggaacaatggtaacagtaagtagt

SEQ ID NO: 47534 - RNA, 381 nt, synthetic construct
  misc_feature 1..381: note = derived and/or modified sequence opt6 from anti-HIV_cap256-206-200599_VR-Chain
  source 1..381: mol_type = other RNA
caagaaaaattagtagaaagtggaggaggagcagtacaaccaggaggaagtttaagattaagctgtgtagcaagtggatttacatttaatggatttggaatgcattgggtaagacaagcaccaggaaaaggattagaatgggtagcaacaataagttttagtggagtatatataagtagagaaaatagtaaaaatacattatatttacaaatgaatggattaagaggagaagatacagcattatattattgtgcaaaagatttaagatatttagaatgtggagaatggagtacatattatccacaaccatgtttagatacaagaggagtaagtggaataagcaatgtatggggaccaggaacaagagtaacagtaagtagt

SEQ ID NO: 47535 - RNA, 432 nt, synthetic construct
  misc_feature 1..432: note = derived and/or modified sequence opt6 from anti-HIV_cap256-206-186347_VR-Chain
  source 1..432: mol_type = other RNA
caagaattattagtagaaagtggaggaggagtagtaccaccaggaaaaagtttaacaataagttgtgtagcaagtagatttacatttagtgcatttggaatgcattgggtaagacaagcaccaggaaaaggattacaatgggtagcaagtataagttttgcaggaacaaaaaaatattatgcagattttgtaaaaggaagatttacaataagcagagataatagtaaaaatacaatatttttacaaatgaatggattaagaggagaagatacggcattatatcattgtgtaaaagatatgagacaattagaatgtgaagaatggacaagtgattattatgattttggaagaccacaaccatgtatagatagaagaggagtaagtggaataagtgcaatgtggggaccaggaacaatggtaacagtaagtagt

SEQ ID NO: 47536 - RNA, 438 nt, synthetic construct
  misc_feature 1..438: note = derived and/or modified sequence opt6 from anti-HIV_cap256-206-186226_VR-Chain
  source 1..438: mol_type = other RNA
caaatgttattagtagaaagtggaggaggagtagtagaaccaggaagaagtttaacattaagttgtgcaacaagtcaatttacatttagtaattatggaatgcattgggtaagacaaacaccaggaacaggattagaatgggtagcaagtataagtaatgaaggaaataaaaaatatcatggagaagcagtatggggaagatttataataagtagagataatagtaaaaaaacattatttttacatatgagtaatttaagagcagatgatagtggattatatttttgtgtaagagatagacaagaagatgaatgtgaagaatggtggagtgattattatagttttggaagaggaggaccatgtagaaaatatcatggacaaggactagcaggaatatttgatatatggggaagaggaacattagtaacagtaagtagt

SEQ ID NO: 47537 - RNA, 435 nt, synthetic construct
  misc_feature 1..435: note = derived and/or modified sequence opt6 from anti-HIV_cap256-206-179686_VR-Chain
  source 1..435: mol_type = other RNA
caagaacaattagtagaaagtggaggaggagtagtaccaccatggaaaagtttaacactaagttgtgaagcaagtagatttacatttagtgcatttggaatgcattgggtaagacaagcaccaggaaaaggattagaatgggtagcaggaataagttttgcaggaataaaaaaatattatgcagatagtgtaaaaggaagattttttataagcagagataatagtaaaaatagagtattattagaaatgaatggattaagaagagaagatacagcaagatatttttgtgtaaaagatttaagagaattagaatgtgaagaatgggcaagtgattattatgattttggaaaaccaaatcaaccatgtttagatagaagaggggtaagtggaataagtgcaatgtggggacaaggaacaatggtaacagtaagtagt

SEQ ID NO: 47538 - RNA, 417 nt, synthetic construct
  misc_feature 1..417: note = derived and/or modified sequence opt6 from anti-HIV_cap256-206-173707_VR-Chain
  source 1..417: mol_type = other RNA
caagaaaaattagtagaaagtggaggaggagcagtacaaccaggaggaagtttaagattaagttgtgtagcaagtggatttacatttaaaggatttggaatgcattgggtaagacaagcaccaggaaaaggactagaatgggtggcaacaataagttttagtggagtaaaaaaatattatggaaatagtgcaaaaggaagattttttataagtagagataatttaaaaaatacagtatatttagaaatgaatggattaagaggagaagatacagcattatattattgtgcaaaagatttaagatatttagaatgtggagaatggagtacatattatccacaaccatgtttagatacaagaggagtaagtggaataagtaatgtgtggggaccaggaacaaaagtaacagtaagtagt

SEQ ID NO: 47539 - RNA, 432 nt, synthetic construct
  misc_feature 1..432: note = derived and/or modified sequence opt6 from anti-HIV_cap256-206-173339_VR-Chain
  source 1..432: mol_type = other RNA
caagaactattagtagaaagtggaggaggagtagtaccaccaggaaaaagtttaaaactaagttgtgtagcaagtagatttacatttggagcatttggaatgcattgggtaagacaagcaccaggaaaaggattagaatgggtagcaggaatatcatttgcaggaacaaaaaattattatgcagatagtgtaaaaggaagatttacaataagtagagataatccaaaaaatacattatttctacaaatgaatggattaagaggagatgatacaggattatattattgtgtaaaagatatgagagaattagaatgtgaattatggacatcagattattatgattttggaagaccacaaccatgtatagatcaaagaggagtaagtggaataagtgcaatgtggggacaaggaacaatggtaacaataagtagt

SEQ ID NO: 47540 - RNA, 438 nt, synthetic construct
  misc_feature 1..438: note = derived and/or modified sequence opt6 from anti-HIV_cap256-206-172689_VR-Chain
  source 1..438: mol_type = other RNA
caaatgatgttagtagaaagtggaggaggagtagtagaaccaggaagaagtttgacattaagttgtgcaacaagtcattttacatttagtaattatggaatgcattgggtaagacaagcaccaggaggaagattagaatgggtagcaagtataagtaatgcaggaaataaaaaatatcatggagatagtgtatggggaagattaataataagcagagataatagtaaaaatacattatttttacatatgagtagtttaagagtagatgatagtgcattatatttttgtgtaagggatagacaagaagatgaatgtgaagaatggtggagtgattattatgcatttggaagaggaggaccatgtagaaaatatagagggcaaggattagcaggaatatttgatatatggggaagaggaacaatggtaacagtaagtagt

SEQ ID NO: 47541 - RNA, 432 nt, synthetic construct
  misc_feature 1..432: note = derived and/or modified sequence opt6 from anti-HIV_cap256-206-162744_VR-Chain
  source 1..432: mol_type = other RNA
caagaaaaattagtagaaagtggaggaggagtagtaccaccaggaaaaagtttaagattaagttgtgtagcaagtggatttacatttagtgcatttggaatgcattgggtaagacaagcaccaggaaaaggattagaatgggtagcaggaataagttttgcaggaataaaaaattattatgcagatagtgtaaaagggagatttacaataagtagagataatagcaaaaatagtctatttttacaaatgaatggactaagaggagatgatacagcaagatattattgtgtaaaagatatgagagaattagaatgtgaagaatggacaagtgattattacgattttggaaaaccacaaccatgtatagatagaagaggagtaagtggaataagcgcaatgtggggacaaggaacaatggtaacaataagtagt

SEQ ID NO: 47542 - RNA, 438 nt, synthetic construct
  misc_feature 1..438: note = derived and/or modified sequence opt6 from anti-HIV_cap256-206-146057_VR-Chain
  source 1..438: mol_type = other RNA
caaatgcaattagtagaaagcggaggaggagtagtacaaccaggaacaagtttaacattaagttgtgtagcaagtcaatttacattttcaaattatggaatgcattggataagacaagcaccaggacaaggattagaatgggtagcatcaatatcaaatgatggaggaaaaagatatcatggagatgcagtatgggcaagatttataataagcagagataatagtaaaaatacagtatttttacaaatgacaagtttaagagcagaagatacagcgagatatttttgtgtaagagatagacaagaagatgaatgtttagaatggtggtcagattattataattttggaagacaactaccatgtgcaaaatttagaggattaggattagcaggagtatttgatatatggggacatggaacaatggtaacagtaagttca

SEQ ID NO: 47543 - RNA, 435 nt, synthetic construct
  misc_feature 1..435: note = derived and/or modified sequence opt6 from anti-HIV_cap256-206-139519_VR-Chain
  source 1..435: mol_type = other RNA
caagaacaattagtagaaagtggaggaggagtggtaccaccaggaacaagtttaagattaagttgtgtagcaagtagatttagttttggaagttttggaatgcattgggtaagacaagcaccaggaaaaggactagaatgggtagcaggaataagttttgtaggaataaaaaaatattatggagatagtgtaaaaggaagattttttataagcagagataatagtaaaaatacattatttttagaaatgaatggattaagaggagaagatacggcaagatattattgtgttaaagatatgagagaattagaatgtgaagaatgggcaagtgattattatgattttggaaaaccaaatcaaccatgtttagatagaagaggagtaagtggaataagtgcaatgtggggaccaggaacaatgttaacagtaagtagt

SEQ ID NO: 47544 - RNA, 432 nt, synthetic construct
  misc_feature 1..432: note = derived and/or modified sequence opt6 from anti-HIV_cap256-206-136316_VR-Chain
  source 1..432: mol_type = other RNA
caagaacaattagtagaaagtggaggaggagtagtaccaccaggaaaaagtttaacattaagttgtgtagcaagtggatttacatttagtgcatttggaatgcattgggtaagacaagcaccaggaaaaggattagaatgggtagcaggaataagttttgtaggaataaaaaaatattatggagatagtgtaaaaggaagatttacaataagtagagataatagtaaaaatacattatttttacaaatgaatggattaagaggagatgatacagcattatatcattgtgtaaaagatatgagacaattagaatgtgaagaatggacaagtgattattatgattttggaaaaccacaaccatgtatagatccaagaggagtaagtggaataagtgcaatgtggggacaaggaacaatggtaacagtaagtagt

SEQ ID NO: 47545 - RNA, 438 nt, synthetic construct
  misc_feature 1..438: note = derived and/or modified sequence opt6 from anti-HIV_cap256-206-116098_VR-Chain
  source 1..438: mol_type = other RNA
caaatgatgttagtagaaagtggaggaggagtagtagaaccaggaaggagtttaacattaagttgtgcagcaagccaatttacatttagtaattatggtatgcattgggtaagacaagcaccaggaagagaactagaatgggtagcaagtataagtaatgcaggaaataaaaaatatcatggagaagcagtatggggaagattaataataagtagagataatagtaaaaatacattatttttacatatgagtaatttaagaccagatgatagtgcattatatttttgtgtaagagatagacaagaagatgaatgtgaagaatggtggagtgattattatgcatttggaagaggaggaccatgtagaaaatatcatggacaaggattagcaggaatatttgatatatggggaagaggaacgatggtgacagtgagtagt

SEQ ID NO: 47546 - RNA, 432 nt, synthetic construct
  misc_feature 1..432: note = derived and/or modified sequence opt6 from anti-HIV_cap256-206-115862_VR-Chain
  source 1..432: mol_type = other RNA
caagaacaattagtagaaagcggaggaggagtagtaccaccaggaaaaagtttaagattaagttgtgtaggaagtagatttacatttagtgcatttggaatgcattgggtaagacaagcaccgggaaaaggattagaatgggtagcaagcataagttttgcaggaacaaaaaaatattatgtagatagtgtgaaaggaagattttttataagtagagataatagtaaaaatacagtatttttagaaatgaatggattaagaggagaagatacaggactatattattgtgtaaaagatatgagagaattagaatgtgaagaatgggcaagtgattattatgattttggaaaaccacaaccatgtttagatagaagaggagtaagtggaataagtgcaatgtggggacaaggaacactagtaataataagtagt

SEQ ID NO: 47547 - RNA, 435 nt, synthetic construct
  misc_feature 1..435: note = derived and/or modified sequence opt6 from anti-HIV_cap256-206-107018_VR-Chain
  source 1..435: mol_type = other RNA
caagaacaattagtagaaagtggaggaggagtagtaccaccaggaaaaagtttaacattaagttgtgtagcaagtagatttagttttagtgcatttggaatgcattgggtaagacaagcaccgggaaaaggattagaatgggtagcaagtataagttttgtaggaataaaaaaatattatggagatagtgtaaaaggaagattttttataagtagagataatagtaaaaatacagtatttttagaaatgaatggattaaggggagaagatacaggattatattattgtgtaaaagatatgagagaattagaatgtgaagaatgggcaagtgattattatgattttggaaaaccaaatcaaccatgtttagatagaagaggagtaagtggaataagtgcaatgtggggacaaggaacattagtaatagtaagtagt

SEQ ID NO: 47548 - RNA, 438 nt, synthetic construct
  misc_feature 1..438: note = derived and/or modified sequence opt6 from anti-HIV_cap256-206-098644_VR-Chain
  source 1..438: mol_type = other RNA
caaatgttattagtagaaagcggaggaggagtagtagaaccaggaagaagtttaacattaagttgtgcagcaagtcaatttacatttagtaattatggaatgcattgggtaagacaagcaccaggaggagggttagaatgggtagcaagtataagtaatgaaggaaataaaagatatcatggagaaagtgtatggggaagatttgtaataagtagagataatagtaaaaatacattatttttacatatgagtacattaagaccagatgatagtgcattatatttttgtgtaagagatagacaagaagatgaatgtgaagaatggtggagtgattattatgcatttggaagaggaggaccatgtaggaaatatcatggacaaggattagcaggaatatttgatgtatggggaagaggaacaatggtaacaggattattt

SEQ ID NO: 47549 - RNA, 417 nt, synthetic construct
  misc_feature 1..417: note = derived and/or modified sequence opt6 from anti-HIV_cap256-206-098135_VR-Chain
  source 1..417: mol_type = other RNA
caagaaaaattagtagaaagcggaggaggagcagtacaaccaggaggaagtttgagattaagttgtgtagcaagcggattcacatttagtggatttggaatgcactgggtaagacaagcaccaggaaaaggattagaatgggtagcaacaatatcattctcaggaatgaaaaaatattatggaacaagcgcaaaaggaagatttagtatatacagagacaatagtaaaaacacattatatttacaaatggatggattaagagaaaaagatacagcattatattactgtgcaaaagacttaagatatttagaatgcggagaatggagtacatattatccacaaccatgtctagatagaagaggagtaagtggaatatcaaatgtatggggaccaggaacaatggtaacagtaagtagc

SEQ ID NO: 47550 - RNA, 435 nt, synthetic construct
  misc_feature 1..435: note = derived and/or modified sequence opt6 from anti-HIV_cap256-206-096276_VR-Chain
  source 1..435: mol_type = other RNA
caagaacaattagtagaaagtggaggaggagtagtaccaccaggaagtagtttaagattaagttgtgtagcaagtagatttacatttagtgcatttggaatgcattgggtaagacaagcgccaggaaaaggattagaatgggtagcaggaataagttttgtaggaataaaaaaatattatgcagatagtgtaaaaggaagatttacaataagtagagataatagtaaaaatacattatttttacaaatgaatggattaagaggagaagatacgggattatattattgtgtaaaagatatgagagaattagaatgtgaagaatggagatcagattattatgattttggaaaaccaaatcaaccatatttagatagaagaggagtaagtggaataagtgcattttggggacaaggaacaatggtaacagtaagtagt

SEQ ID NO: 47551 - RNA, 438 nt, synthetic construct
  misc_feature 1..438: note = derived and/or modified sequence opt6 from anti-HIV_cap256-206-092794_VR-Chain
  source 1..438: mol_type = other RNA
caaatgatgttagtagaaagtggaggaggagtagtagaaccaggaagaagtttaacattaagttgtgcaacaagtcaatttacatttagtaattatggaatgcattgggtaagacaagcaccaggaagaggattagaatgggtagcaagtatatcaaatgaaggaaataaaaggtatcatggagaaagtgtatggggaagatttataataagtagagataatagtaaaaatacattatttttacatatgagtacattaagagcagatgatagcgcattatatttttgtgtaagagatagacaagaagatgaatgtgaagaatggtggtcagattattatgcatttggaagaggaggaccatgtagaaaatatcatggacaaggattagcaggaatatttgatatagtaggaagaggaacattagtaacagtaagcagt

SEQ ID NO: 47552 - RNA, 432 nt, synthetic construct
  misc_feature 1..432: note = derived and/or modified sequence opt6 from anti-HIV_cap256-206-086817_VR-Chain
  source 1..432: mol_type = other RNA
caagaacaattagtagaaagtggaggaggagtagtaccaccaggaaaaagtttaagattaagttgtgcagcaagtggatttagttttggagcatttggaatgcattgggtaagacaagcaccaggaaaaggattagaatgggtagcaggaataagttttgtaggaataaaatattattatgcagatagtgtaaaaggaagatttacaataagtagagataatagtaaaaatacagtatttttacaaatgaatggattgagaggagatgatacaggaagatattattgtgtaaaagatatgagagaattagaatgtgaagaatggacaagtgattattatgattttggaaaaccacaaccatgtatagatagaagaggagtaagtggaataagtgcaatgtggggacaaggaacaatggtaacaataagtagt

SEQ ID NO: 47553 - RNA, 432 nt, synthetic construct
  misc_feature 1..432: note = derived and/or modified sequence opt6 from anti-HIV_cap256-206-086446_VR-Chain
  source 1..432: mol_type = other RNA
caagaacaattagtagaaagtggaggaggagtagtaccaccaggaaaaagcttaagattaagttgtgtagcaagtagatttacattctcagcatttggaatgcattgggtaagacaagcaccaggaaaaggattagaatgggtagcaggaataagttttgtaggaataaaaaaatattatagtgatgcagtaaaaggaagattttatataagtagagataatagtaaaaatacattatttttagaaatgaatggattaagaggagatgatacagcaagatattattgtgtaaaagatttaagagaattagaatgtgaagaatgggcaagtgattattatgattttggaaaaccacaaccatgtttagatagtagaggagtaagtggaataagtgcaatgtggggacaaggaacaatggtaacagtaagtagt

SEQ ID NO: 47554 - RNA, 432 nt, synthetic construct
  misc_feature 1..432: note = derived and/or modified sequence opt6 from anti-HIV_cap256-206-086180_VR-Chain
  source 1..432: mol_type = other RNA
caagaacaattagaagaaagtggaggaggagtagtaccaccaggaaaaagtttaagattaagttgtgtagcaagtagatttacatttagtgcatttggtatgcattgggtaagacaagcaccaggaaaaggattagaatgggtagcaggaataagttttgtaggaataaaaaaatattatgcagatagcgtaaaaggaagatttacaataagcagagataatagtaaaaatacactatttttacaaatgaatggattaagaggagatgatacaggattatatttttgtgtaaaagatatgagagaattagaatgtgaacaatggacatcagattattatgattttggaaaaccacaaccatgtatagatccaagaggagtatcaggaataagtgcaatgtggggacaaggaacaatggtaacagtaagttca

SEQ ID NO: 47555 - RNA, 435 nt, synthetic construct
  misc_feature 1..435: note = derived and/or modified sequence opt6 from anti-HIV_cap256-206-083708_VR-Chain
  source 1..435: mol_type = other RNA
caagaacaattagtagaaagtggaggaggagtaataccaccaggacaaagtttaagattaagttgtgtagcaagtagatttacatttagtgcatttggaatgcattgggtaagacaagcaccaggaaaaggattagaatgggtaagtagtgtaagttttgcaggaataaaaaaatattatgcagatagtgtaaaaggaagattttttataagtagagataatagtaaaaacacagtatttttagaaatgaatggattaagaggagaagatacaggattatactattgtgtaaaagatatgagagaattagaatgtgaagaatgggcaagtgattattatgattttggaaaaccagatcaaccatgtttagatagaagaggagtaagcggaataagtgcaatgtggggacaaggaacattagtaatagtaagtagt

SEQ ID NO: 47556 - RNA, 432 nt, synthetic construct
  misc_feature 1..432: note = derived and/or modified sequence opt6 from anti-HIV_cap256-206-079556_VR-Chain
  source 1..432: mol_type = other RNA
caagaacaattagtagaaagtggaggaggagtagtaccaccaggaaaaagtttaagattaagttgtgtagcaagtgggtttacatttagtggatttggaatgcattgggtaaggcaagcaccaggaaaaggactagaatgggtagcaggaatatcatttgtaggaataaaatattattatgcagatagcgtaaaaggaagatttagcataagtagagataatagtaaaaatacattatttctacaaatgaatggattaagaggagatgatacagcgttatattattgtgtaaaagatatgagagaattagaatgtgaagaatggacatcagattattatgattttggaaaaccacaaccatgtatagatagaaggggagtatcaggaataagtgcgatgtggggacaaggaacaatggtaacggtaagtagt

SEQ ID NO: 47557 - RNA, 438 nt, synthetic construct
  misc_feature 1..438: note = derived and/or modified sequence opt6 from anti-HIV_cap256-206-078657_VR-Chain
  source 1..438: mol_type = other RNA
caaatgttattagtagaaagtggaggaggagtagtagaaccaggaagaagtttaacattaagttgtgcaacaagtcaatttacatttagtaattatggaatgcattgggtaagacaagcaccaggaagaggattagaatgggtggcaagtataagtaatgaaggaagtaaaaaatatcatggagaaccagtatggggaagatttataataagtagagataatagtaaaaaaacattatttttacatatgagtaatctaagagtagatgatagtgcattatatttttgtgtaagagatagacaagaagatgaatgtgaagaatggtggagtgattattatgcatttggaagaggaggaccatgtagaaaatatcatggacaaggattagcaggaatatttgatatatggggaagaggaacaatggtaacagtaagtagt

SEQ ID NO: 47558 - RNA, 438 nt, synthetic construct
  misc_feature 1..438: note = derived and/or modified sequence opt6 from anti-HIV_cap256-206-075802_VR-Chain
  source 1..438: mol_type = other RNA
caaatgttattagtagaaagtggaggagatgtagtagaaccaggaaaaagtttaacattaagttgtgcaacaagtagatttacatttagtaattatggaatgcattgggtaagacaagcaccaggaggagggttagaatgggtagcatcaatatcaaatgaaggaaataaaaaatatcatggagaaagtgtatggggaagatttataataagtagagataatagtaaaaatacattatttttacatatgagtgcattaagaacagatgatagtgcattatatttttgtgtaagagatagacaagaagatgaatgtgaagaatggtggagtgattattatgcatttggaagaggaggaccatgtagaaaatatcatgggcaaggattagcaggaatatttgatatatggggaagaggaacaatggtaacagtaagtagt

SEQ ID NO: 47559 - RNA, 438 nt, synthetic construct
  misc_feature 1..438: note = derived and/or modified sequence opt6 from anti-HIV_cap256-206-069097_VR-Chain
  source 1..438: mol_type = other RNA
caaatgttattagtagaaagtggaggaggagtagtagaaccaggaaggagtttaacattaagttgtgcaacaagtagatttacatttagtaattatggaatgcattgggtaagacaagcaccaggaagagaattagaatgggtagcaagtataagtaatgaaggaaataaaaaatatcatgcagaaagtgtatggggaagatttataataagtagagataatagtaaaaatacactatttttacatatgagtaatgtaagaggagatgatagtgcattatatttttgtgtaagagataggcaagaagatgaatgtgaagaatggtggagtgattattatgcatttggaagaggaggaccatgtagaaaatatcatggacaaggattagcaggaatatttgatgtatggggaagaggaacagtagtaacagtaagtagt

SEQ ID NO: 47560 - RNA, 438 nt, synthetic construct
  misc_feature 1..438: note = derived and/or modified sequence opt6 from anti-HIV_cap256-206-067758_VR-Chain
  source 1..438: mol_type = other RNA
caaatgttattagtagaaagtggaggaggagtagtagaaccaggaagaagtttaacattaagttgtgcagcaagtcaatttacattttcacattatggaatgcattgggtaaggcaagcaccagggagaggattagaatgggtagcatcaataagtaatgaaggaaataaaagatatcatggagaaagtgtatggggaagatttataataagtagagataatagcaaaaatacattatttttacatatgagtgcattaagaacagatgatagtgcattatatttttgtgtaagagatagacaagaagatgagtgtgaagaatggtggagcgattattatgcatttggaagaggaggaccatgtagaaaatggcatgggcaagggttagcaggaatatttgacatatggggaagaggaacagtagtaacagtaagtagt

SEQ ID NO: 47561 - RNA, 417 nt, synthetic construct
  misc_feature 1..417: note = derived and/or modified sequence opt6 from anti-HIV_cap256-206-057019_VR-Chain
  source 1..417: mol_type = other RNA
caagaaaaattagtagaaagtggaggaggagcagtacaaccaggaggaagtttaagattaagttgtgtagcaagtggatttagttttagtggatatggaatgcattgggtaagacaagcaccaggaaaaggattagaatggttagcaacaataagttttagtggagtaaaaaaatattatggaacaagtgcaaaaggaagattttatatatatagagataatacaaaaaatacaatgtatttagaaatgaatggattaagaggagaagatacagcactatattattgtgcaaaagatttaagatatttagaatgtggagaatggagtacatattatccacaaccatgtttagatacaagaggagtaagtggaataagtaatgtatggggaccaggaacaatggtaacagtaagtagt

SEQ ID NO: 47562 - RNA, 438 nt, synthetic construct
  misc_feature 1..438: note = derived and/or modified sequence opt6 from anti-HIV_cap256-206-055385_VR-Chain
  source 1..438: mol_type = other RNA
caaatgatgttagtagaaagtgggggaggggtagtagaaccaggaagaagtttaacattgagttgtgcagcaagtaaatttacatttagtaattatggaatgcattgggtaagacaagcaccaggaagaggattagaatgggtagcaagtataagtaatgaaggaaataaaaaatatcatggagaaccagtatggggaagattaataataagtagagataatagtaaaaatacattatttttacatatgagtgatttaagagcagatgatagtgcattatatttttgtgtaagagatagacaagaagatgaatgtgaagaatggtggagtaattattatgcatttggaagaggaggaccatgtagaaaatggagaggacaaggattagcaggaatatttgatgtatggggaagaggaacaatggtaacagtaagtagt

SEQ ID NO: 47563 - RNA, 435 nt, synthetic construct
  misc_feature 1..435: note = derived and/or modified sequence opt6 from anti-HIV_cap256-206-053187_VR-Chain
  source 1..435: mol_type = other RNA
caagaacaattagtagaaagtggaggaggagtagtaccgccaggaagtagtttaagattaagttgtgtagcaagtagatttacatttagcgcatttggaatgcattgggtaagacaagcaccaggaaaaggattagaatgggtagcaggaataagttttgtaggaataaaatattattatgcagatagcgtaaaaggaagatttacaataagtagagataatagtaaaaatacattatttctacaaatgaatggattaagaggagaagatacaggattatattattgtgtaaaagatatgagagaattagaatgtgaagaatgggcaagtgattattatgattttggaaaaccaaatcaaccatgtttagatagaagaggagtaagtggaataagtgcattttggggacaaggaacaatggtaacagtaagtagt

SEQ ID NO: 47564 - RNA, 438 nt, synthetic construct
  misc_feature 1..438: note = derived and/or modified sequence opt6 from anti-HIV_cap256-206-053139_VR-Chain
  source 1..438: mol_type = other RNA
caaatgttattagtagaaagtggaggagatgtagtagaaccaggaagaagtttaacattaagttgtgcaacaagtcaatttacatttagtaattatggaatgcattgggtaagacaagcaccagggagaggattagaatgggtagcaagtataagtaatgaaggaagtaaaaaatatcatggagaaagtgtatggggaagatttataataagtagagataatagtaaaaatacattatttttacatatgacgacattaagaccagatgatagtgcattatatttttgtgtaagagataggcaagaagatgaatgtgaagaatggtggagtgattattatgcatttggaagaggaggaccatgtagaaaatatcatggacaaggattagcaggaatatttgatatatggggaagaggaacaatggtaacagtaagtagt

SEQ ID NO: 47565 - RNA, 432 nt, synthetic construct
  misc_feature 1..432: note = derived and/or modified sequence opt6 from anti-HIV_cap256-206-050350_VR-Chain
  source 1..432: mol_type = other RNA
caagaacaactagtagaaagtggaggaggagtagtaccaccaggaaaaagcttaaaactaagttgtgtagcaagtagatttagttttggagcatttggaatgcattgggtaagacaagcaccaggaaaaggattagaatgggtagcaggaataagttttgtaggaataaaaaaatattatgcagatagcgtaaaagggagattttatataagcagagataatagtaaaaatacagtatttctagaaatgaatgcattaagaggagaagatacagcattatatcattgtgtaaaagatatgagagaattagaatgtgaagaatgggcaagtgattattatgattttggaaaaccacaaccatgtttagatagaagaggagtaagtggaataagtgcaatgtggggaccaggaacaatggtaatagtaagttca

SEQ ID NO: 47566 - RNA, 432 nt, synthetic construct
  misc_feature 1..432: note = derived and/or modified sequence opt6 from anti-HIV_cap256-206-046207_VR-Chain
  source 1..432: mol_type = other RNA
caagaacaattagtagaaagtggaggaggagtagtaccaccaggaacaagtttaagattaagttgtgtagcgagtagatttacatttagtgcatttggaatgcattgggtaagacaagcaccaggaaaaggattagaatgggtagcaggaataagttttgcaggaataaaaaaatattatgcagatagtgtaaaaggaagatttacaataagtagagataatagtaaaaatagtttatttttagaaatgaatggattaagaggagatgatacagcattatattattgtgtaaaagatttaagatatttagaatgtgaactatggacaagtgattattatgattttggaagaccacaaccatgtatagatagtagaggagtatcaggaataagtgcaatgtggggaccgggaacaatggtaacagtaagtgca

SEQ ID NO: 47567 - RNA, 417 nt, synthetic construct
  misc_feature 1..417: note = derived and/or modified sequence opt6 from anti-HIV_cap256-206-043389_VR-Chain
  source 1..417: mol_type = other RNA
caagaaaaattagtagaaagcggaggaggagcagtacaaccaggaggaagcttaagattaagctgtgtagcaagtggattcacattctcaggatttggaatgcactggttcagacaagcaccaggaaaaggactagaatgggtagcaacaatatcattctcaggaataaaaaaatactataacacaagcgcaaaaggaagatttttcataagcagagacaatacaaaagacacattatatctacaaatggatggattacaagaaaaagatacagcactatatctatgtgcaaaagacttaagatatctagaatgcggatactggagcacatactatccacaaccatgtctagatacaagaggagtaagcggaatatcaaacgtatggggaccaggaacaatggtaacagtatcgagt

SEQ ID NO: 47568 - RNA, 432 nt, synthetic construct
  misc_feature 1..432: note = derived and/or modified sequence opt6 from anti-HIV_cap256-206-042555_VR-Chain
  source 1..432: mol_type = other RNA
caagaacaattagtagaaagtggaggaggagtagtaccaccaggaaaaagtttaagattaagttgtgtagtaagtggatttacatttagtgcatttggaatgcattgggtaagacaagcaccaggaaaaggattagaatgggtagcaggaataagttttgcaggaacaaaaagttattatgcagaaagtgtaaaaggaagatttacaatatcaagagataatagtaaaaatagtttatttttacaaatgaatggattaagaggagacgatacagcactatattattgtgtaaaagatatgagagaattagaatgtgaattatggacatcagattattatgattttggaagaccacaaccatgtatagatagaagaggagtaagtggaataagtgcaatgtggggacaaggaacaatggtaacaataagtagt

SEQ ID NO: 47569 - RNA, 432 nt, synthetic construct
  misc_feature 1..432: note = derived and/or modified sequence opt6 from anti-HIV_cap256-206-029720_VR-Chain
  source 1..432: mol_type = other RNA
caagaaaaattggtagaaagtggaggaggagtagtacaaccaggaagaagtttaacattaagctgtgtagcaagtcattttacatttagtggagtaggaatgcattgggtaagacaagcaccaggaaaaggattagaatgggtagcaggaataagttttgcgggaacaagaaaatattatgcagatagcgtaaaaggaagatttacaataagtagagataatagtaaaaatacagtatatttacaaatgaatggattaagaggagaagatacagcattatatcattgtgcaaaagatttaagagaattagaatgtgaactatggacaagtgattattatgattttggaagaccacaaccatgtatagatagaagaggagtatcagggatatgtgatatgtggggacaaggaacaatggtaatagtaagtagt

SEQ ID NO: 47570 - RNA, 432 nt, synthetic construct
  misc_feature 1..432: note = derived and/or modified sequence opt6 from anti-HIV_cap256-206-028848_VR-Chain
  source 1..432: mol_type = other RNA
caagaacaattagtagaaagtggaggaggagtagtaccaccaggaaaaagtttaagattaagttgtgtagcaagtggatttacatttagtggatttggaatgcattgggtaagacaagcaccaggaaaaggattacaatgggtagcaggaatatcgttcgcaggaacaaaatattattatgaagatagtgtaaaaggaagatttacaataagtagagataatagtaaaaatacagtatttttacaaatgaatggattaagaggagatgatacagcattatattattgtgtaaaagatatgagagaattagaatgtgaagaatggacaagtgattattatgattttggaaaaccacaaccatgtatagatagaagaggagtaagtggaataagtgcaatgtggggacaaggaacaatggtaacaataagttca

SEQ ID NO: 47571 - RNA, 432 nt, synthetic construct
  misc_feature 1..432: note = derived and/or modified sequence opt6 from anti-HIV_cap256-206-027652_VR-Chain
  source 1..432: mol_type = other RNA
caagaacaattagtagtaagtggaggagatgtagtaccaccaggaaaaagtttgagattaagttgtgtagcaagtggatttacatttagtgcatttggaatgcattgggtaagacaagcaccaggaaaaggattagaatgggtagcaagtataagttttgcaggaacaaaatattattatgcagatagtgtaaaaggaagatttgcaataagtagagataatagtaaaaatacattatttttacaaatgaatggattaagaagagaagatacaggattatattattgtgtaaaagatatgagacaattagaatgtgaagaatggacaagtgattattatgattttggaagaccacaaccatgtatagatagaagaggagtaagtggaataagtgcaatgtggggacaaggaacaatggtaacaataagttca

SEQ ID NO: 47572 - RNA, 417 nt, synthetic construct
  misc_feature 1..417: note = derived and/or modified sequence opt6 from anti-HIV_cap256-206-024075_VR-Chain
  source 1..417: mol_type = other RNA
caagaaaaattagtagaaagtggaggaggagcagtacaaccaggaggaagtttaagattaagctgtgtagcaagtggatttacatttagtggatttggaatgcattgggtaagacaagcaccaggaaaaggattagaatggttagcaacaataagttttagtggagtaaaaaaatattatggaacaagtgcaaaaggaagattttatataagtagagataatacaaaaaatacagtatatttacaaatggatggattaagaggagacgatacagcaatatattattgtgcaaaagatttaagatttttagaatgtggactatggagtacatattatccacaaccatgtttagatacaagaggagtaagtggaataagtaatgtatggggaccaggaacaatggtaacagtaagtagt

SEQ ID NO: 47573 - RNA, 417 nt, synthetic construct
  misc_feature 1..417: note = derived and/or modified sequence opt6 from anti-HIV_cap256-206-008748_VR-Chain
  source 1..417: mol_type = other RNA
caagaaaaattagtagaaagtggaggaggagcagtacaaccaggaggaagtttaagattaagctgtgtagcaagtggatttacatttaatggatttggaatgcattgggtaagacaagcaccaggaaaaggattagaatgggtagcaacaataagttttagtggagtgaaaaaatattatggaacaagtgcaaaaggaagattttttataagtagagaaaatagtaaaaatacattatatttacaaatgaatggattaagaggagaagacacagcattatattattgtgcaaaagatttaagatatttagaatgtggagaatggagtacatattatccacaaccatgtttagatacaagaggagtaagtggaataagtaatgtatggggaccaggaacaagagtaacagtaagtagt

SEQ ID NO: 47574 - RNA, 432 nt, synthetic construct
  misc_feature 1..432: note = derived and/or modified sequence opt6 from anti-HIV_cap256-206-008530_VR-Chain
  source 1..432: mol_type = other RNA
caagaacaattagtagaaagtggaggaggagtagtaccaccaggaaaaagtttaagattaagttgtgtagcaagtggatttagttttggagcatttggaatgcattgggtaagacaagcaccaggaaaaggattagaatgggtagcaggaataagttttgtgggaataaaatattattatgcagatagtgtaaaaggaagatttacaataagtagagataatagtaaaaaaacattatttttacaaatgaatggattaagaggagatgatacagcattatattattgtgtaaaagatatgagagaattagaatgtgaagaatggacaagtgattattatgattttggaaaaccacaaccatgtatagatagaagaggagtaagtggaataagcgcattttggggacaaggaacaatggtaacaataagtagt

SEQ ID NO: 47575 - RNA, 432 nt, synthetic construct
  misc_feature 1..432: note = derived and/or modified sequence opt6 from anti-HIV_cap256-176-723043_VR-Chain
  source 1..432: mol_type = other RNA
caagaacaattagtagaaagtggaggaggagtagtaccaccaggaaaaagtttaagattaagttgtgtagcaagtgggtttacatttagtgcatttggaatgcattgggtaagacaagcaccaggaaaaggattagaatgggtagcaggagtaagttttgcaggaataaaatattattatgcagatagtgtaaaaggaagatttacaataagtagagataatagtaaaaatacattatttttacaaatgaatggattaagaggagatgatacagcattatattattgtgtaaaagatttaagggaattagaatgtgaagaatggacaagcgattattatgattttggaagaccacaaccatgtatagatccaagaggagtaagtggaataagtgcaatgtggggacaaggaacagtagtaacaataagttca

SEQ ID NO: 47576 - RNA, 432 nt, synthetic construct
  misc_feature 1..432: note = derived and/or modified sequence opt6 from anti-HIV_cap256-176-600049_VR-Chain
  source 1..432: mol_type = other RNA
gaagtacaattagtacaaagtggaggaggagtagtacaaccaggaagaagtctaagattaagttgtgcagcaccatattttgaatttggaagatatggatttcattgggtaagacaagcaccaggaaaaggattagaatgggtagcaagtataagttttgcaggaagaggatattatcattcaccaagcgtatggggaagatttacaataagtagagataatagtaaaaatacattatatctacaaatgaatagtctaagaatagaagatacagcattatatttttgtgcaagagatttaagagaaagtgaatgtgaagaatgggaaagtgattattatgattttggaaaaaaaggaccatgtgtaaaaccaagaggagtagcaggaggattagatttatggggacaaggaacaatggtaatagtaagtagt

SEQ ID NO: 47577 - RNA, 432 nt, synthetic construct
  misc_feature 1..432: note = derived and/or modified sequence opt6 from anti-HIV_cap256-176-531926_VR-Chain
  source 1..432: mol_type = other RNA
caagtacaattagtagaaagcggaggaggagtagtaccaccaggaaaaagtttaacattaagttgtgtagcaagtagatttacatttagtgcatttggaatgcattgggtaagacaagcaccaggaaaaggattggaatgggtagcaggaataagttttgtaggaataagaaaatattatgcagatagtgtaaaaggaagatttagtataagtagagataatagtaaaaatacagtatttttagaaatgaatggattaagaggagaagatacaggattatattattgtgtaaaagatatgagagaattagaatgtgaagaatgggcaagtgattattatgattttggaaaaccacaaccatgtttagatagaagaggagtaagtggaataagtgcaatgtggggacaaggaacattagtaataataagtagt

SEQ ID NO: 47578 - RNA, 432 nt, synthetic construct
  misc_feature 1..432: note = derived and/or modified sequence opt6 from anti-HIV_cap256-176-504134_VR-Chain
  source 1..432: mol_type = other RNA
gaagtacaattagtagaaagtggaggaggagtagtgccaccaggaaaaagtttgagattaagttgtgtaacaagtagattagcatttggagcatttggaatgcattgggtaagacaagcaccaggaaaaggattagaatgggtagcaagtataagttttgcaggaataaaaaaatattatgcagatagtgtaaaaggaagatttacaataagtagggataatagtaaagacacagtgtttttagaaatgaatggattaagaggagatgatacaggattatattattgtgtaaaagatatgagatatttagaatgtgaagaatgggcaagtgattattatgattttggaagaccacaaccatgtttagatccaagaggagtaagtggaataagtgcaatgtggggacaaggaacattagtaataataagtagt

SEQ ID NO: 47579 - RNA, 432 nt, synthetic construct
  misc_feature 1..432: note = derived and/or modified sequence opt6 from anti-HIV_cap256-119-186229_VR-Chain
  source 1..432: mol_type = other RNA
caaatgcaattagtagaaagtggaggaggagtagtacaaccaggaggaagcttaagattactatgtagtgcaagtggattcacattctcaacatatggaatgcactgggtaagacaagcaccaggaaaaggactagaatgggtagcatcaatatcatacgatggatcagacaaataccatgcaggactagtatggggaagatttataataagcagagacaatagcaaaaacacactatatctacaaatgaatagcttaagagcagaagatacagcactatattactgtgtaagagacgaaagagaaagcgaatgcgaattatgggaatcagactattacaatttcggaaaaaaattaccatgcgtaaaaccaagaggagtagcaggaacattagatatatggggacaaggaacaacagtaatagtaagctca

SEQ ID NO: 47580 - RNA, 432 nt, synthetic construct
  misc_feature 1..432: note = derived and/or modified sequence opt6 from anti-HIV_cap256-119-183891_VR-Chain
  source 1..432: mol_type = other RNA
caagtacaattagtagaaagtggaggaggagtagtacaaccaggaggaagtttaagattaagctgtgcagcaagcggattcacattctcaagctatggaatgcactgggtaagacaagcaccaggaaaaggactagaatgggtagcatttacaagatacgatggatcagacaaatactatctagatagcgtaaaaggaagatttacaataagcagagacaatagcaaatacacattatttttacaaatggtaagcttaagaacagaagatacagcattatatttctgtgcaagagacttaagagaaagtgaatgcgaagaatgggaatcatactattacgatttcggaaaaaaaggaccatgcgtaaaaccaagaggggtagtaggagtactagatatatggggacaaggaacgctagtaacagtaagctca

SEQ ID NO: 47581 - RNA, 435 nt, synthetic construct
  misc_feature 1..435: note = derived and/or modified sequence opt6 from anti-HIV_cap256-119-183631_VR-Chain
  source 1..435: mol_type = other RNA
caagtacaattagtacaaagtggaggaggagtagtacaaccaggaagaagtttaagattaagctgtgcagcaagtaaatttacatttagtacatatacattacattgggtaagacaagcaccaggaaaaggattagaatgggtagcagtaataagtcatgatggaggaaatagattttatgcagatagtgtaaaaggaagatttacaataagtagagataatagcaaaaataatttatttttacaaatgaatagtttaagagtagaagatacagcattatattattgtgcaagggatttaagagaaatggaatgtgaagaatggacattatataattattatgatttcggaagtagaggaccatgtgtagatccaagaggagtagtaggaagttttgatgtatggggacaaggaacaatggtaacagtaagtagt

SEQ ID NO: 47582 - RNA, 432 nt, synthetic construct
  misc_feature 1..432: note = derived and/or modified sequence opt6 from anti-HIV_cap256-119-182676_VR-Chain
  source 1..432: mol_type = other RNA
caagtacaattagtagaaagcggaggaggagtagtacaaccaggaaaaagcttaagattaagctgtgtagtaagtggattcacattttcaaattatccaatgcactgggtaaggcaagcaccaggaaaaggattagaatgggtagcaagtatatcatttgcaggaataaaaaaatattatggagatagtgtaaaaggaagatttacaataagcagagacaatagtaaaaatacactatatttacaaatggatggattaagaggagaagatacagcactatattactgtgcaaaagacttaagagaactagaatgtgaagaatgggcatcagactattatgatttcggaagaccacaaccgtgtttagacccaagaggagtaagtggaataagtaatgtatggggacaaggaacaatggtaacagtaagttca

SEQ ID NO: 47583 - RNA, 432 nt, synthetic construct
  misc_feature 1..432: note = derived and/or modified sequence opt6 from anti-HIV_cap256-119-180772_VR-Chain
  source 1..432: mol_type = other RNA
caagtacaattagtagaaagcggaggaggagtagtacaaccaggaagaagtttaagattaagctgtgcagcaagcgaatttacattctcaaactatgcaatgcactgggtaagacaagcaccaggaaaaggactagaatgggtagcatcaatatcattcgatggaagagacaaataccatagttcattagtatggggaagattaacaataagtagagacaatagtaaaagcacactattcctacaaatgaatagcctaagaccagaagatacagcactatattactgtgcaagagacgtaagagaaagcgaatgcgaagaatggcaatcagactattacgcattctatagaaaattaccatgtgtgaaaccaagaggagtagcaggaacactagatatatggggacaaggaacaatggtgacagtaagctca

SEQ ID NO: 47584 - RNA, 435 nt, synthetic construct
  misc_feature 1..435: note = derived and/or modified sequence opt6 from anti-HIV_cap256-119-180508_VR-Chain
  source 1..435: mol_type = other RNA
caagtacatttagtagaaagtggaggaggagtagtacaaccaggaagaagtttgagattaagttgtgcagcaagtcattttagtttaagtagttatggaatgcattgggtaagacaaacaccaggaaaaggattagaatgggtagcaggaataagttttgcaggagtaaaaacatattatggaacaagtgtaaaaggaagatttacaataagtagggataatagcaaaaataatttatatttacaaatgaatagcttaagaccagaagatacagcattatattattgtgcaagagatttaagagaaatggaatgcgaagaatggaaattatataattattatgattttagaacaagaggaccatgtgtagatccaagaggagtagtaggaagttttgatgtatgggggcaaggaacagtagtaacagtaagtagt

SEQ ID NO: 47585 - RNA, 432 nt, synthetic construct
  misc_feature 1..432: note = derived and/or modified sequence opt6 from anti-HIV_cap256-119-180260_VR-Chain
  source 1..432: mol_type = other RNA
gaagtacaattagtagaaagcggaggaggagtagtaagaccaggaggaagtttaagattaagttgtgcagcaagtcaattcacattttcgaattttggaatgcactgggtaagacaagcaccaggaaaaggattagaatgggtagcatcaatatcatttgtaggaataaaaacacattatgcaaatagtgtaagagggagatttacaataagtagagaccaaagtaaaaatacattatatctacaaatgaatagtgtaagagtagaagatactggaagatattactgtgcaagagacatgagagaatatgaatgcgaattatgggcatcagactattatgatttcggaaaaccacaaccatgtgaagacccaagaggagtagtaggaacatttgatatgtggggattaggaacattagtaacagtaagttcg

SEQ ID NO: 47586 - RNA, 432 nt, synthetic construct
  misc_feature 1..432: note = derived and/or modified sequence opt6 from anti-HIV_cap256-119-180173_VR-Chain
  source 1..432: mol_type = other RNA
gaagtacaattagtagaaagcggaggaggactagtacaaccaggaggaagcctaagattaagctgtgcagcaagcggattcacagtatcaagcaattacatgagctgggtaagacaagcaccaggaaaaggactagaatgggtagcatcaatatcattcgcaggaacaaaaaaacactatggaaatagcgtaaaaggaagatttacaataagcagagacaatagcaaaaacacattatatctacaaatgaatagcttaagaggagaagatacagcactatattactgtgcaaaagacttaagagaatacgaatgcgaagaatggacatcggactattacgatttcggaagaccacaaccatgcatagactcaagaggagtagtaggaatactagatatatggagccaaggaacaatggtaacagtaagttca

SEQ ID NO: 47587 - RNA, 432 nt, synthetic construct
  misc_feature 1..432: note = derived and/or modified sequence opt6 from anti-HIV_cap256-119-179839_VR-Chain
  source 1..432: mol_type = other RNA
caagtacaattagtagaaagtggaggaggagtagtacaaccaggaagaagtctaagattaagttgtgcagcaagtggattttcatttggaacaagtgatgtacattgggtaagacaagcaccaggagaaggattagaatgggtagcattaataagttttgatggaagacaaaaagatttagcagatagtgtaagaggaagatttacaataagtagagatagtagtaaaaatacattatatttagaaatgaatagtttaagaccagaagatacagcattatattattgtgcaaaagatatgcgaggatatgaatgtgaagaatggacatcagattattacgattttggaagaccacaaccatgtatagatagtagaggagtagtaggaacatttgatgtatggggacaaggaacaatggtaacagtaagtagt

SEQ ID NO: 47588 - RNA, 423 nt, synthetic construct
  misc_feature 1..423: note = derived and/or modified sequence opt6 from anti-HIV_cap256-119-179262_VR-Chain
  source 1..423: mol_type = other RNA
caagtacaattagtagaatcaggaggaagagtagtacaaagcggaggatcactaagactatcatgcggagcatcaggatttagctttacaacaagtgcaatgcattgggtaagacaagcaccaggaaaaggactagaatgggtagcaataaatggagcaaacaaacactatgcagaaagcgtaaaaggaagatttacaataagcagagacaatagcaaaaacacactatttctagaaatgaatagtttaagaccagacgatacagcactatatttctgtgtaaaagaccaaagagaagacgaatgcgaagaatggtggtcagactattacgatttcggaagagaacaaccatgcttagacccaagaggagtagtaggaatattcgatctatggggacaaggaacaatggtaacagtaagctca

SEQ ID NO: 47589 - RNA, 432 nt, synthetic construct
  misc_feature 1..432: note = derived and/or modified sequence opt6 from anti-HIV_cap256-119-178995_VR-Chain
  source 1..432: mol_type = other RNA
caagtgcaattagtagaaagtggaggaggagtagtacaaccaggaaaaagtttaagattaagctgtgcagcaagtggattcacactaacaagatttgcaatgcactgggtaagacaagcaccaggaaaaggactagaatgggtagcagtaatatggtacgatggaagtaacaaatactatgcagatagcgtaaaaggaagatttacagtaagtagagacaatagcaaaaacacactatatctacaaatgaatagcttaagaacagaagatacagcactatattactgtgtaagagacagaagagaaagcgaatgcgaattatgggaatcagactattacaatttcggaagaagactaccatgcgtaaaaccaagaggagtagcaggaatactagatatatggggacaaggaacaacagtaacagtaagtcca

SEQ ID NO: 47590 - RNA, 432 nt, synthetic construct
  misc_feature 1..432: note = derived and/or modified sequence opt6 from anti-HIV_cap256-119-178455_VR-Chain
  source 1..432: mol_type = other RNA
gaagtacaattagtagaaagtggaggaggattagtacaaccaggaggaagtttaagattaagctgtgtagtaagcggattcacattctcaaatttttggatgagctgggtaagacaagcaccaggaaaaggactagaatgggtagcatcaatatcatatgatggaagagacaaatatcatagctcactagtatggggaagattaacaataagcagagacaatagtaaaagcacactatttctacaaatgaatagcttaagagcagaagatacagcactatattactgtgcaagggacttaagagaaagtgaatgtgaagaatggcaatcggactattacgcattctataaaaaactaccatgcgtaaaaccaagaggagtagcaggaacactagatatatggggacaaggaacaatggtaacagtaagttca

SEQ ID NO: 47591 - RNA, 438 nt, synthetic construct
  misc_feature 1..438: note = derived and/or modified sequence opt6 from anti-HIV_cap256-119-177993_VR-Chain
  source 1..438: mol_type = other RNA
caagtacatttagttgaaagtggaggaggagtagtacaaccaggaaaaagtttaagaatatattgtgcagtaagtgaatttacatttagtaattatgcaatgcattgggtaagactagcaccaggaagaggattacaatggttagcagtaataagttatgatggaagtaaaaaatattatgcagatagtttagaaggaagatttacaataagtaaagataatagtaaaaatacattatttttacaaatgaatagtctaagagtagaagatacagcattatatttttgtgtaaaagatcaaagagaagatgaatgtgaagaatggtggagtgactattatgattttggagaaagagcaccattaccaaaagtaccaggaccaggaccaggatggaatttagatatgtggggacatggaacaatggtaacagtaagtagt

SEQ ID NO: 47592 - RNA, 438 nt, synthetic construct
  misc_feature 1..438: note = derived and/or modified sequence opt6 from anti-HIV_cap256-119-177727_VR-Chain
  source 1..438: mol_type = other RNA
caagtacaattagtagaaagcggaggaggagtagtacaaccaggaagaagcttaagattaagctgtgcagcaagcggattcacactatcgagatatgacatgcactgggtaagacaagcaccaggaaaaggactagaatgggtagcatcaatatcaaaagatggaacaaaaaaatatcatggagatagtgtatggggaagatttataataagcagagacaatagtaaaaacacgttatttctacaaatgtcaagtttaagagcagaagatacagcattatatttctgtgtaagagatcaaagagaagcagaatgtgaagaatggtggtcagactattacgatttcggaagagaattaccatgcagaaaatttagaggactaggactagcaggaatatttgatatatggggacatggaacaatggtaacagtaagtagt

SEQ ID NO: 47593 - RNA, 432 nt, synthetic construct
  misc_feature 1..432: note = derived and/or modified sequence opt6 from anti-HIV_cap256-119-176746_VR-Chain
  source 1..432: mol_type = other RNA
gaagtacaattagtagaaagtggaggaggattagtacaaccaggaggaagtttaagattaagctgtgcagcaagcgattttacatttgatgattatgcaatgcattgggtaagacaagcaccaggaaaaggattagaatgggtaggaggaataagttatgatggaagtgataaatatcatacaaatagtgtatgggggagatttatagtaagtagagataatagtaaaaatacattatatttacaaatgaatagcttaagaccagaagatacagcattatattattgtgtaagagatagaagagaaagtgaatgtgaagaaagatggagtgattattatgattttggaaaacaactaccatgtgtaaaaccaagaggagtagcaggaatatttgatatatggggacaaggaacaatggtaacagtaagtagt

SEQ ID NO: 47594 - RNA, 432 nt, synthetic construct
  misc_feature 1..432: note = derived and/or modified sequence opt6 from anti-HIV_cap256-119-176241_VR-Chain
  source 1..432: mol_type = other RNA
caagtacaattggtagaaagtggaggaggagtagtacaaccaggaagaagtttaagattaagttgtgcagcaagtggatttacatttagtaattatgcaatgcattgggtaagacaagcaccaggaaaaggattagaatgggtagcagtaataagttatgatggatcaaataaatattatgcagatagtgtaaaaggaagatttacaataagtagagataatagtaaaaatacattatatttacaaatggatggattaagaggagaagatacagcattatattattgtgcaaaagatttaagagaattagaatgtgaagaatgggcaagtgattattatgattttggaagaccacaaccgtgtctagatccaagaggagtaagtggaataagtaatgtatggggacaaggaacaatggtgacagtaagtagt

SEQ ID NO: 47595 - RNA, 432 nt, synthetic construct
  misc_feature 1..432: note = derived and/or modified sequence opt6 from anti-HIV_cap256-119-175215_VR-Chain
  source 1..432: mol_type = other RNA
caagtacaattagtagaaagcggaggaggagtagtacaaccaggaaggagcttaagattaagttgtgcagtaagtcaatttacatttggaagatatggaatgtattgggtaagacaagcaccaggaaaaggattagaatgggtagcaggaataagttatgatggaagtgataaatatcatacaaatagtgtatggggaagatttatagtaagtagagataatagcaaaaatatgttatatttacaaatgaataatttaagaccagaagatacagcattatattattgtgtaagagatagaagagaaagtgaatgtgaagaaagatggagtgattattatgattttggaaaacaattaccatgtgtaaaaccaagaggagtagcaggaatatttgatatatggggacaaggaacaatggtaacagtaagttca

SEQ ID NO: 47596 - RNA, 432 nt, synthetic construct
  misc_feature 1..432: note = derived and/or modified sequence opt6 from anti-HIV_cap256-119-173928_VR-Chain
  source 1..432: mol_type = other RNA
ggagtagaattattagaaagtggaggaggattagtagaaccaggaggaagtctaagattaagttgtgtaggaagtcaatttagttttgatagatatggaatgcattgggtaagacaagcaccaggaaaaggattagaatgggtagcagcagtaagttttgatggaacagataaatatcatgcagatgatgtatggggaagatttacaataagtagagataatagtaaaaatacattatatttacaaatgaatagtttaagagcagaagatacagcattatattattgtgcaaaagatttgagagaagatgaatgtgaagaatggtggagtgattattatgatttaggaaaacaattaccgtgtaggaaaagtagaggagtagcaggagtattagataaatggggattaggaacaatggtaacagtaagtagt

SEQ ID NO: 47597 - RNA, 432 nt, synthetic construct
  misc_feature 1..432: note = derived and/or modified sequence opt6 from anti-HIV_cap256-119-173495_VR-Chain
  source 1..432: mol_type = other RNA
caagtacaattagtagaaagtggaggaggagtagtacaaccaggaaaaagtttaagattaagttgtgcagcaagtagatttacatttaatagatatggaatgcactgggtaagacaagcaccaggaaaaggattagaatgggtagcagcaatatcatttgatggaacagataaatatcatagcgatgacgtatggggaagatttacaataagtagagacaatagtaaaaatacattatatttacaaatgaatagcttaagagcagaagatacagcagtatattattgtgcaaaagatttaagagaagatgaatgtgaagaaagatggtcagactattatgatttcggaaaacaattaccatgtagaaaatcaagaggggtagcaggaatatttgataattggggacaaggaacaatggtaacagtaagctca

SEQ ID NO: 47598 - RNA, 432 nt, synthetic construct
  misc_feature 1..432: note = derived and/or modified sequence opt6 from anti-HIV_cap256-119-172882_VR-Chain
  source 1..432: mol_type = other RNA
caagtacaattagtagaaagcggaggaggagtagtacaaccaggaagatcattaacattaagctgtgaagtgagcggattcacattcaaaacatacggaatgcactgggtaagacaagcgccaggaaaaggactagaatgggtagcaagcatatcatacgatggatcagacaaataccatgcagatagagtatggggaagatttacaataagcagagacaatagcaaaaacacattatatctacaaatgaatagcttaagagcagaagatacagcattatattactgtgtaagagacgcaagagaaagtgaatgcgaactatgggaatcagactattacaatttcggaagaaaactaccatgcgtaaaaccaagaggagtagcaggaacactagatatatggggacaaggaacaatggtaacagtaagctcg

SEQ ID NO: 47599 - RNA, 432 nt, synthetic construct
  misc_feature 1..432: note = derived and/or modified sequence opt6 from anti-HIV_cap256-119-172429_VR-Chain
  source 1..432: mol_type = other RNA
gaagtacaattagtagaaacaggaggaggactaatacaaccaggaggaagtttaagattaagctgtgtagcaagccaattcacattcagtggatgtggattacactgggtaagacaagcaccaggaaaaggactagaatgggtagcatcaatatcattcgcaggaacaaaaaaacactatggaaatagtgtaaaaggaagatttacaataagcagagacaatagcaaaaacacattatatttagaaatgaatacattaagagcagaagatacagcactatattattgtgcaaaagacttaagagaatatgaatgtgaagaatggacaagtgactattacgatttcggaagaccacaaccatgcatagactcaagaggagtagtaggaatattagatatatggggacaaggaacaatggtaagcgtaagttca

SEQ ID NO: 47600 - RNA, 432 nt, synthetic construct
  misc_feature 1..432: note = derived and/or modified sequence opt6 from anti-HIV_cap256-119-172223_VR-Chain
  source 1..432: mol_type = other RNA
caagtacaattagtagaaagtggaggaggggtagtacaaccaggaagaagtttaagattaagttgtgcagcaagtggatttacatttagtagttatgcaatgcattgggtaagacaagcaccaggaaaaggattagaatgggtagcagtaataagttatgatggaagagatttttatcatgcaagaagtgtatggggaagatttacaataagtagagataatagtaaaaatacactacatttacaaatgaatagtttaagaccagaagatacagcattatatttttgtgcaagagatttaagggaaagtgaatgtgaagaatgggaaagttattattatgattttggaaaaaaagatccatgtgtaaaaccaagaggagtagtaggagtattagatatatggggacaaggaacattagtaacagtaagtagt

SEQ ID NO: 47601 - RNA, 432 nt, synthetic construct
  misc_feature 1..432: note = derived and/or modified sequence opt6 from anti-HIV_cap256-119-171838_VR-Chain
  source 1..432: mol_type = other RNA
caagtacaattaggagaaagtggaggaggagtagtacaaccaggaagaagtttaagattaagttgtgcagcaagtggatttacattttcaacatttgcaatgcattgggtaagacaagcaccaggaaaaggattagaatgggtagcagtaataagttatgatggaagtaataaatattatgcagatagtgtaaaaggaagatttgcaataagtagagataatgcaaaaaatttattacatttacaaatgaatagtttaagaccagaagatacagcattatattattgtgcaaaagatttacaagaagatgaatgtgaagaatggtggagtgattattatgattttggaaaacaattaccatgtagaaaaagtagaggagtagcaggaatatttgatgattggggacaaggaacaatggtaacagtaagttca

SEQ ID NO: 47602 - RNA, 432 nt, synthetic construct
  misc_feature 1..432: note = derived and/or modified sequence opt6 from anti-HIV_cap256-119-171587_VR-Chain
  source 1..432: mol_type = other RNA
gaagtacaattagtagaaagcggaggaggcctagtacaaccaggaggaagtctaagattaagctgtgcagcaagtggattcacattctcagactattacatgagttggataagacaagcaccaggaaaaggactagaatgggtagcatcaatatcattcgcaggaacaaaacaacactatggaaatagcgtaaaaggaagatttacaataagcagagacaatagtaaaaacacagtatatctacaaatgaatagcttaagattagaagatacagcactatattactgtgcaaaagacttaagagaatacgaatgcgaagaatggacatcagactattacgatttcggaagaccacaaccatgcatagactcaagaggagtagtaggaatactagatatatggggacaaggaacaatggtaacagtaagttca

SEQ ID NO: 47603 - RNA, 432 nt, synthetic construct
  misc_feature 1..432: note = derived and/or modified sequence opt6 from anti-HIV_cap256-119-169596_VR-Chain
  source 1..432: mol_type = other RNA
ctagtacaattagtagaaagtggaggaggagtagtacaaccaggaagatcattaagattaagctgtacagcaagcggattcacattcagcagctttgcaatgcacagagtaagacaaacaccaggaaaaggactagaatgggtagcatcaatatcatacgatggatcagacaaataccatgcagatagagtatggggaagatttacaataagcagagacaatagcaaaaacacactatatttacaaatgaatagcttaagagcagaagatacagcactatattactgtgtaagagacgcaagagaaagcgaatgcgaactatgggaatcagactattataatttcggaagaaaattaccatgcgtaaaaccaagaggagtagcaggaacactagatatatggggacaaggaacaatggtaacagtaagttca

SEQ ID NO: 47604 - RNA, 432 nt, synthetic construct
  misc_feature 1..432: note = derived and/or modified sequence opt6 from anti-HIV_cap256-119-169523_VR-Chain
  source 1..432: mol_type = other RNA
caagtacaattagtagaaagtggaggaggagtagtacaaccaggagaaagtttaagattaagttgtgcagcaagtggatttagttttggaacaagtgatgtacattgggtaagacaagcaccaggagaaggattagaatgggtagcaagtataagttttgcaggaataaaaaaatattatggagatagtgtaaaaggaagatttacaataagtagagataatagtaaaaatacattatatttacaaatggatggactaagaggagaagatacagcattatattattgtgcaaaagatttaagagaattagaatgtgaagaatgggcaagtgattattatgattttggaagaccacaaccatgtttagatccaagaggagtaagcggaataagtaatgtatggggacaaggaacaatggtaacagtaagtagt

SEQ ID NO: 47605 - RNA, 432 nt, synthetic construct
  misc_feature 1..432: note = derived and/or modified sequence opt6 from anti-HIV_cap256-119-169462_VR-Chain
  source 1..432: mol_type = other RNA
gaagtacaattagtagaaagcggaggaggattagtacaaccaggaggatcattaagattaagctgtgcagcaagcggattcacattcacaacatacagcttacactgggtaagacaaagcccaggaaaaggattagaatgggtagcagcaatatcattcgcaggaacaaaagaaaactatgcaaatagcgtaagaggaagatttacaataagtagagacaatagcaaaaacacactatatctacaaatgaatagtttaagagcagaagatacagcactatattactgtacaaaagacatgagagaatacgaatgcgaagaatggacatcagactattacgatttcggaagaccacaaccatgcatagactcaagaggagtagtaggaacattcgatgtatggggacaaggaacaatggtaacagtaagctca

SEQ ID NO: 47606 - RNA, 432 nt, synthetic construct
  misc_feature 1..432: note = derived and/or modified sequence opt6 from anti-HIV_cap256-119-169092_VR-Chain
  source 1..432: mol_type = other RNA
gaagtacaattagtagaaagtggaggaggattagtacaaccaggaggaagtttgagattaagttgtgtaataagtggatttacatttagtagttatgaaatgaattgggtaagacaagcaccaggaaaaggattagaatgggtagcaggaatatcatatgatggaagagataaatatcatgcacattttgtatggggaagaataacaataagtagggataatagcaaaaatacattatatttacaaatgaatagtttaagagcagaagatacagcgttatatcattgtgtaagagatttaagagaaagtgaatgtgaattatgggaatcagattattatgattttggaaaaaaattaccatgtgtaaaaccaagaggagtagcaggaatatttgatttatggggacaaggaacaatggtaacagtaagttca

SEQ ID NO: 47607 - RNA, 432 nt, synthetic construct
  misc_feature 1..432: note = derived and/or modified sequence opt6 from anti-HIV_cap256-119-168680_VR-Chain
  source 1..432: mol_type = other RNA
caagtacaattagtagaaagtggaggaggagtagtacaaccaggaagaagtttaagagtaagttgtgcagcaagtcattttacatttagtagatatggaatgcattgggtaaggcaagcaccaggaaaaggattagaatgggtagcaagtataagttatgatggaagagatttttatcatgcaagaagtgtatggggaagatttgcaataagtagagataatagcaaaaatacattacatttacaaatgaatagtttaagaacagaagatacagcattatatcattgtgtaagagatttaagagaaagtgaatgcgaattatgggaaagtgattattatgattttggaaaaaaattaccatgtgtaaaaccaagaggagtagcaggaacatttgatttatggggacaaggaacaatggtaacagtaagtagt

SEQ ID NO: 47608 - RNA, 438 nt, synthetic construct
  misc_feature 1..438: note = derived and/or modified sequence opt6 from anti-HIV_cap256-119-166385_VR-Chain
  source 1..438: mol_type = other RNA
caagtacaattagtagaaagtggaggaggagtagtacatccaggaagaagtttaagattaagttgtgcagcaagtggatttagttttggaaattttggaatgcattgggtaagacaagcaccaggaaaaggattagaatgggtagcaagtataagtaatgatggaacaaaaaaatatcatgcagaaagtgtatgggatagatttagtataagtaaagataatagtaaaaatacattatttttacaaatgaatagcttaagagtagaagatacagcattatatttttgtgtaaaagatcaaagagaagacgaatgtgaagaatggtggagtgattattatgattttggaagagaattaccatgtagaaaaagtagaggattaggactagcaggaatatttgatatgtggggacatggaacaatggtaacagtaagtagt

SEQ ID NO: 47609 - RNA, 432 nt, synthetic construct
  misc_feature 1..432: note = derived and/or modified sequence opt6 from anti-HIV_cap256-119-165943_VR-Chain
  source 1..432: mol_type = other RNA
gaagtacaattagtagaaagtggaggaggattagtacaaccaggaaggagtttaagattaagttgtgcagtgagtggatttacagtaagtagtaattatatgagctgggtaagacaagcaccaggaaaaggattagaatgggtagcaagtataagttttgcaggaataaaaaaatattatggagatagtgtaaaaggaagatttacaataagtagagataatagtaaaaatacattatatttacaaatggatggattaagaggagaagatacagcattatattattgtgcaaaagatttgagagaactagaatgtgaagaatgggcgagtgattattatgattttggaagaccacaaccatgtttagatccaagaggagtaagtggaataagtaatgtatggggacaaggaacaatggtaacagtaagtagt

SEQ ID NO: 47610 - RNA, 432 nt, synthetic construct
  misc_feature 1..432: note = derived and/or modified sequence opt6 from anti-HIV_cap256-119-165738_VR-Chain
  source 1..432: mol_type = other RNA
gaagtacaattagtagaaagtggaggaggattagtacaaccaggaagaagtttaagattaagttgtgcagcaagcggatttacatttgatgactatgcaatgaattgggtaagacaagcaccaggaaaaggattagaatgggtagcaacaataagttttgatggaacagataaatatcatgcagatgatgtatggggaagatttacaataagcagagataatagcaaaaaaacattatatttacaaatgaatagtttaagagcagaagatacagcattatattattgtgcaaaagatttaagagaagatgaatgtgaagaatggtggagtgattattatgatttaggaaaacaattaccatgtagaaaatcaagaggagtagcaggagtattagataaatggggattaggaacaatggtaacagtaagtagt

SEQ ID NO: 47611 - RNA, 432 nt, synthetic construct
  misc_feature 1..432: note = derived and/or modified sequence opt6 from anti-HIV_cap256-119-164913_VR-Chain
  source 1..432: mol_type = other RNA
caagatcatttagtagaaagcggaggaggtggagtgcaaccaggaaaaagtttaagattaagctgtgcagcaagtggatttacatttagtgcacatgcaatgcattgggtaagacaagcaccaggaaaaggaccagaatgggtagcagtaataagtcatgatggaggacaacaattttatagagaaagtgtaaaaggaagatttacaataagcagagataatagtaaaaatacattatatttacaaatggatggattaagaggagaagatacagcattatattattgtgcaaaagatttaagagaattagaatgtgaagaatgggcaagtgattattatgattttggaagaccacaaccatgtttagatccaagaggagtaagtggaataagtaatgtatggggacaaggaacaatggtaacagtaagtagt

SEQ ID NO: 47612 - RNA, 432 nt, synthetic construct
  misc_feature 1..432: note = derived and/or modified sequence opt6 from anti-HIV_cap256-119-164167_VR-Chain
  source 1..432: mol_type = other RNA
gaagtaagattagtagaaagtggaggaggattaatacaaccaggaggaagtttaagattaagttgtgcagcaagtggattaacagtaagtagtaatcatatgagttgggtaagacaagcaccaggaaaaggattagaatgggtagcaagtataagttatgatggaagagatttttatcatgcaagaagtgtatggggaagatttacaataagtagagataatagtaaaaatacattacatctacaaatgaatagtctaagaccagaagatacggcactatatttttgtgcaagagatttaagagaaagtgaatgtgaagaatgggaaagttattattatgattttggaaaaaaaggaccatgtgtaaaaccaagaggagtagtaggagtattagatatatggggacaaggaacactagtaacagtaagtagt

SEQ ID NO: 47613 - RNA, 432 nt, synthetic construct
  misc_feature 1..432: note = derived and/or modified sequence opt6 from anti-HIV_cap256-119-163558_VR-Chain
  source 1..432: mol_type = other RNA
caaatgcaattagtagaaagcggaggaggagtagtacaaccaggaagatcattaacattaagctgtgcagcaagccaattcaatttcgcaaactatggaatgcactgggtaagacaagcaccaggaaaaggactagaatgggtagcaagcatatcatacgatggatcagacaaataccatgcagatagagtatggggaagatttacaataagcagagacaatagcaaaaacacactatatctacaaatgaatagcttaagagcagaagatacagcactatattactgtgtaagagacgcaagagaaagcgaatgcgaattatgggaatcagactattacaatttcggaagaaaattaccatgcgtaaaaccaagaggagtagcaggaacactagatatatggggacaaggaacaatggtaacagtaagttca

SEQ ID NO: 47614 - RNA, 432 nt, synthetic construct
  misc_feature 1..432: note = derived and/or modified sequence opt6 from anti-HIV_cap256-119-162043_VR-Chain
  source 1..432: mol_type = other RNA
caagtacaattagtagaaagtggaggaggagtagtacaaccaggaagaagtttaagagtaagttgtgcagcaagtcattttacatttagtagatatggaatgcattgggtaagacaagcaccaggaaaaggattagaatgggtaacaggaataagttttgcagcaacaaaaacatattatggagatagtgtaaggggaagatttacagtaagtagagatataagtaaaaatacattatatttacaaatgaatagcttaagaccagaagatacagcaatgtattattgtgcaagagatcaaagatattatgaatgtgaagaatgggcaagtgattattatgattttggaagagaacaaccatgtcaagatccaagaggagtagtagggatattagatttatggggacaaggaacaatggtaacagtaagctca

SEQ ID NO: 47615 - RNA, 432 nt, synthetic construct
  misc_feature 1..432: note = derived and/or modified sequence opt6 from anti-HIV_cap256-119-161718_VR-Chain
  source 1..432: mol_type = other RNA
caagtacaattagtagaaagcggaggaggagtagtacaaccaggaaaatcattaagattaagctgtgcagcaagccatttcagcttcaatagatatggaatgcactgggtaagacaagcaccaggaaaaggactagaatgggtagcagcaatatcatacgatggaacagacaaatatcatgcagatcaagtatggggaagatttacaataagcagagacaatagcaaaaacacattatatttacaaatgaatagcttaagaccagaagatacagcattatattactgtgcaaaagacttaagagaagacgaatgtgaagaatggtggtcagactattacgatctaggaaaacaactaccatgcagaaaatcaagaggagtagcaggaatattcgataaatggggacaaggaacaatggtaacagtaagctca

SEQ ID NO: 47616 - RNA, 432 nt, synthetic construct
  misc_feature 1..432: note = derived and/or modified sequence opt6 from anti-HIV_cap256-119-161675_VR-Chain
  source 1..432: mol_type = other RNA
caagtacaattagtagaaagtggaggaggagtagtacaaccaggaagaagtttaagattaagctgtacagcaagcggatttacattttcaatatatagtatgaactgggtaagacaagcaccaggaaaaggactagattgggtagcaggaatatcatttgcagcaacaaaaacatattatggaggaagtgtaaaaggaagatttacagtaagcagagacataagtaaaaatacattatatttacaaatgaatagtttaagaccagaagatacagcaatgtattattgtgcaagagatcaaagatattatgaatgtgaagaatgggcatcagattattatgatttcggaagagaacaaccatgtcaagacccaagaggagtagtaggagtatttgatatgtggggacaaggaacaatggtaacagtaagttca

SEQ ID NO: 47617 - RNA, 432 nt, synthetic construct
  misc_feature 1..432: note = derived and/or modified sequence opt6 from anti-HIV_cap256-119-161053_VR-Chain
  source 1..432: mol_type = other RNA
caagtacatttagtagaaagcggaggaggagtagtacaaccaggaacaagtttaagattaagttgtgtagcaagtggatttacattttcaaattttgcaatgcactgggtaagacaagcaccaggaaaaggactagaatgggcagcaataatatcaacaagaggaaataacagaaattatgcagatagcgtaagaggaagatttacagtaagcagagatataagtaaaaatacattatatttacaaatgaatagtttaagaccagaagatacagcaatgtattactgtgcaagagatcaaagatattatgaatgtgaagaatgggcatcagactattatgatttcggaagagaacaaccatgtcaagacccaagaggagtagtaggaatattagatttatggggacaaggaacaatggtaacagtaagctca

SEQ ID NO: 47618 - RNA, 432 nt, synthetic construct
  misc_feature 1..432: note = derived and/or modified sequence opt6 from anti-HIV_cap256-119-159499_VR-Chain
  source 1..432: mol_type = other RNA
caagtacaattagtagaaagtgggggaggagtagtacaaccaggaagaagtttaagattaagttgtgcagcaagtggatttgcattttcacattatggaatattttgggtaagacaagcaccaggaaaaggactagaatgggtagcaagtataagttttgatggaagagattattatcatagtccacatgtatggggaagattaacaataagtagagataatagtaaaaatacactatatttacaaatgaatagcttaagagcagaagatacagcattatattattgtgcaagagatttaagagaaagtgaaagagaagaatgggaaagtgattattatgattttggaaaaaaaggaccatgtgtaaaaccaagaggagtagcaggaagtttagatatgtggggacaagggacaatggtaatagtaagcagt

SEQ ID NO: 47619 - RNA, 432 nt, synthetic construct
  misc_feature 1..432: note = derived and/or modified sequence opt6 from anti-HIV_cap256-119-159114_VR-Chain
  source 1..432: mol_type = other RNA
gaagtacaattagtagaaagtggaggaggattagtacaaccaggagggagtttaagattagcatgtgcagcaagtggattaacatttagaaaacatggtatgcattgggtaagacaagcaccaggaaaaggattagaatgggtaagctatataagtagtgatggagtaaataattatttaatagatagtgtaagaggaagatttacagtaagcagagataatagtaaaaatacattatatttacaaatggatggattaagaggagaagatacagcattatattattgtgcaaaagatttgagagaactagaatgtgaagaatgggcaagtgattattatgattttggaagaccacaaccatgtttagatccaagaggagtaagtggaataagtaatgtatggggacaaggaacaatggtgacagtaagttca

SEQ ID NO: 47620 - RNA, 432 nt, synthetic construct
  misc_feature 1..432: note = derived and/or modified sequence opt6 from anti-HIV_cap256-119-156751_VR-Chain
  source 1..432: mol_type = other RNA
gaagtacaattattagaaagcggaggaggattagtacaaccaggaggaagtttaagattaagttgtgcagcaagcggatttgcatttagtagttatggaatgcattgggtaagacaagcaccaggaaaaggactagaatgggtagcaagtatatcatatgatggaagagatttttatcatgcaagaagtgtatggggaagatttacaataagtagagataatagtaaaaatacattacatttacaaatgaatagtttaagaccagaagatacagcattatatttttgtgcaagagatttaagagaaagtgaatgtgaagaatgggaaagttattattatgattttgggaaaaaaggaccatgtgtaaaaccaagaggagtagtaggagtattagatatatggggacaaggaacactagtaacagtaagtagt

SEQ ID NO: 47621 - RNA, 432 nt, synthetic construct
  misc_feature 1..432: note = derived and/or modified sequence opt6 from anti-HIV_cap256-119-155656_VR-Chain
  source 1..432: mol_type = other RNA
gaagtacaattagtagaaagtggaggaggattagtacaaccaggaggaagtttaagattaagttgtgcagcaagtggaataacatttagtagttatggaatgcattgggtaagacaagcaccaggaaaaggattagaatgggtagcatttataagatatgatggaagtagtaaatattatgcagatagtgtaaaaggaagatttacaataagtagagataatagtaaaaatacattatatttacaaatggatggattaagaggagaagatacagcattatattattgtgcaaaagatttaagagaattagaatgtgaagaatgggcaagtgattattatgattttggaagaccacaaccatgtttagatccaagaggagtaagtggaataagcaatgtatggggacaaggaacaatggtaacagtaagtagt

SEQ ID NO: 47622 - RNA, 432 nt, synthetic construct
  misc_feature 1..432: note = derived and/or modified sequence opt6 from anti-HIV_cap256-119-154420_VR-Chain
  source 1..432: mol_type = other RNA
caagtaagattagtagaaagtggaggaggagtagtacaaccaggaagaagcttaagaataagttgtgcagcaagtcaatttatgtttagtagatatggaatgcattgggtaagacaagcaccaggaaaaggattagaatgggtagcaagtataagttatgatggaacagataaatatcatgcagatctagtatggggaagatttacaataagtagggataatagtaaaaatacattatatttacaaatgaatagtttaagagcagaagatacagcattatattattgtgcaagggatttaagagaaagtgaatgtgaagaatgggaaagtgattattatgattttggaaaaaaaggaccatgtgtaaaaccaagaggagtagcgggaagtttagatatgtggggacaaggaacaatggtaatagtaagtagt

SEQ ID NO: 47623 - RNA, 432 nt, synthetic construct
  misc_feature 1..432: note = derived and/or modified sequence opt6 from anti-HIV_cap256-119-153954_VR-Chain
  source 1..432: mol_type = other RNA
gaagtacaagtattagaaagcgggggaggactagtacaaccaggaggaagtttaagattaagctgtgtagcaagccaattcacattctcaggatgtggattacactgggtaagacaagcaccaggaaaaggactagaatgggtagcatcaatatcattcgcaggaacaaaaaaacactatggaaatagtgtaaaaggaagatttacaataagtagagacaatagcaaaaacacagtatatttagaaatgaatagtttaagagcagaagatacagcactatattactgtgcaaaagacttaagagaatacgaatgtgaagaatggacaagtgactattacgatttcggaagaccacaaccatgcatagactcgagaggagtagtaggaatactagatatatggggacaaggaacaatggtaacagtaagctca

SEQ ID NO: 47624 - RNA, 432 nt, synthetic construct
  misc_feature 1..432: note = derived and/or modified sequence opt6 from anti-HIV_cap256-119-153864_VR-Chain
  source 1..432: mol_type = other RNA
caagtacatttagtagaaagtggaggaggagtagtacaaccaggaggaagtttaagattaagctgtgcagcaagtggatttacattttcaggatgtggactacattgggtaagacaagcaccaggaaaaggattagaatgggtagcatcaatatcatttgcaggaacaaaaaaacattatggatcaagtgtaagaggaagatttagtataagtagagataatagtaaaaatacattatatttacaaatgaatagcttaagaacagaagatacagcattatatttttgtgcaaaagatttaagagaatatgaatgtgaagaatggacatcagattattatgattttggaagaccacaaccatgcatagattcaagaggagtagtaggaatactagatatatggggacaaggaacaatggtaacagtaagttca

SEQ ID NO: 47625 - RNA, 432 nt, synthetic construct
  misc_feature 1..432: note = derived and/or modified sequence opt6 from anti-HIV_cap256-119-153793_VR-Chain
  source 1..432: mol_type = other RNA
gaagtacaattagtagaaagtggaggaggagtagtacaaccaggaggaagtttaagattaagttgtgcaacaagtggatttacatttggaacatttggaatgcattgggtaagacaagcaccaggaaaaggattagattgggtagcatatataagatatgatggaaaaacaaagaattatggagaaagtgtgaaaggaagatttacaataagcagggataatagtaaaaatacaatgagtttacaaatgaatagtttaagaccagaagatacagcattatattattgtgcaaaagacttaagagaagatgaatgtgaagaaagatggagtgattattatgattttggaaaacaattaccatgtagaaaaagtagaggagtagcaggagtatttgataattggggacaaggaacaatggtaacagtaagcagt

SEQ ID NO: 47626 - RNA, 432 nt, synthetic construct
  misc_feature 1..432: note = derived and/or modified sequence opt6 from anti-HIV_cap256-119-153462_VR-Chain
  source 1..432: mol_type = other RNA
caagtacaattagtagaaagcggaggaggagtagtacaaccaggaggaagtttaagattaagctgtgcagcaagtggattcacattctcaaactatggaatgcaatgggtaagacaagcaccaggaaaaggactagaatgggtagcagcaatatcgtacgatggaagaaacgaatactatgcagaaagcgtaaaaggaagatttacaataagtagagacaatttcaaaagcacactatttctacaaatgaatagcttgagagcagaagatacagcactatattactgtgcaagagacttaagagaaagtgaatgtgaagaatgggaatcagactattacgcattctatagaaaactaccatgcgtaaaaccaagaggagtagcaggaacattagatatatggggacaaggaacaatggtaacagtaagttca

SEQ ID NO: 47627 - RNA, 438 nt, synthetic construct
  misc_feature 1..438: note = derived and/or modified sequence opt6 from anti-HIV_cap256-119-153124_VR-Chain
  source 1..438: mol_type = other RNA
caagtacaattagtagaaagcggaggaggagtagtacaaccaggaagaagcttaacattaagctgtatagcaagccaattcaattttgcaagctatggaatgcactgggtaagacaagcaccaggaaaaggactagaatgggtagcatcaatatcacacgatggaacaaaaaaataccatgcagaaagcgtatggggaagatttacaataagcaaagacaatagcaaaaacacattatttctacaaatgaatagcttaagagtagaagatacagcactatatttctgtgtaaaagaccaaagagaagacgaatgcgaagaatggtggtcagactattacgatttcggaagagaattaccatgcagaaaaagtagaggactaggattagcaggaatattcgatatgtggggacatggaacaatggtaacagtaagctca

SEQ ID NO: 47628 - RNA, 438 nt, synthetic construct
  misc_feature 1..438: note = derived and/or modified sequence opt6 from anti-HIV_cap256-119-153025_VR-Chain
  source 1..438: mol_type = other RNA
caaatgcaattagtagaaagcggaggaggagtagtacaaccaggaaaaagtttaacattaagctgtgcagcaagccaattcacattctcaaactatggaatgcactgggtaagacaagcaccaggaaaaggattagaatgggtagcatcaatatcaaacgatggaaataaaaaataccatggagatagtgtatggggaagattaacaataagcagagacaatagcaaaaacactctatttctacaaatgaatagcttaagaccagaagatacagcactatatttctgtgtaaaagaccaaagagaagacgaatgcgaagaatggtggtcagactattacgatttcggaagagaactaccatgcagaaaatttagaggactaggactagcaggaatattcgatatatggggacatggaacaatggtaacagtaagctca

SEQ ID NO: 47629 - RNA, 432 nt, synthetic construct
  misc_feature 1..432: note = derived and/or modified sequence opt6 from anti-HIV_cap256-119-152713_VR-Chain
  source 1..432: mol_type = other RNA
gaagtacaattggtagaaagtggaggaggattagtaagaccaggaggaagcctaagattaagttgtgcaacaagtggatttacattttcaagtcattggatgagttgggtaagacaagcaccaggaaaaggattagaatgggtagcaggaataagttttgcaggaacaaaaacatattatggagatagtgtaaaaggaagatttacagtaagtacagacataagtaaaaacacattatatttacaagtaaatagtttaagaccagaagatacagcaatgtattattgtgcaagagatcaaagatattatgaatgtgaagaatgggcatcagactattatgatttcggaaaagaacaaccatgtttagacccaagaggagtagtaggaatatttgatatatggggacaaggaacaatggtaacagtaagttca

SEQ ID NO: 47630 - RNA, 438 nt, synthetic construct
  misc_feature 1..438: note = derived and/or modified sequence opt6 from anti-HIV_cap256-119-151794_VR-Chain
  source 1..438: mol_type = other RNA
cacgtacaattagtagaaagtggaggaggagtagtacaaccaggaacaagtttaagattaagctgtgtagcaagcgaattctcattcaaaaactatggcatgcactgggtaagacaagcaccaggaaaaggactagaatgggtagcatcaatatcaaacgatggaacaaaaaaataccatgcagaaagtgtatgggatagatttagcataagtaaagacaatagcaaaaacacactatttttacaaatgaatagcttaagagtagaagatacagcactatatttctgtgtaaaagaccaaagagaagacgaatgcgaagaatggtggtcagactattacgatttcggaagagaattaccatgtagaaaatcaagaggattaggactagcaggaatattcgatatgtggggacatggaacaatggtaacagtaagctca

SEQ ID NO: 47631 - RNA, 438 nt, synthetic construct
  misc_feature 1..438: note = derived and/or modified sequence opt6 from anti-HIV_cap256-119-150980_VR-Chain
  source 1..438: mol_type = other RNA
caagtgcaattagtagaaagtgggggaggagtagtacaaccaggaaaaagcttaagattaagttgtgcagcaagtggattcatactatcaaactatgcaatgcactgggtaagacaagcaccagggaaaggactagaatgggtagcatcaatatcaaacgatggatcaaaaaaataccatggagatagcgtatgggcaagatttataataagtagagacaatagcaaaaacacactatttctacaaatgtcaagcttaagagcagaagatacagcactatatttctgtgtaagagaccatagagaagacgaatgcgaagaatggtggtcagactattacgatttcggaagagaattaccatgcagaaaatttagagggttaggattagcaggaatattcgatatatggggacatggaacaatggtgacagtaagctca

SEQ ID NO: 47632 - RNA, 432 nt, synthetic construct
  misc_feature 1..432: note = derived and/or modified sequence opt6 from anti-HIV_cap256-119-148895_VR-Chain
  source 1..432: mol_type = other RNA
caagtacaattagtagaaagtggaggaggagtagtacaaccaggaagaagtttaagattaagttgtgcagcaagtggatttacatttagaagttatggaatgcattgggtaagacaagcaccaggaaaaggattagaatgggtagcagtaataagtagtgatggagatatagaatattatacacaaagtgtaaaaggaagatttacaataagtagagataatagcaaaaatacattatatttacaaatgaatgcattaagaccagaagatacagcaatgtattattgtgcaagagatcaaagatattatgaatgtgaagaatgggcaagtgattattatgattttggaagagaacaaccatgtcaagatccaagaggggtagtaggagtatttgatatgtggggacaaggaacaatggtaacagtaagtagt

SEQ ID NO: 47633 - RNA, 438 nt, synthetic construct
  misc_feature 1..438: note = derived and/or modified sequence opt6 from anti-HIV_cap256-119-148848_VR-Chain
  source 1..438: mol_type = other RNA
caaatgcaattagtagaaagcggaggaggagtagtacaaccaggaagaagcttaacattaagttgtgcagcaagccaattctcattcacaagctatggaatgcactgggtaagacaagcaccaggaaaaggactagaatgggtggcatcaatatcaaacgatggaacaaaaaaataccatggagaaagcgtatgggatagatttagcataagtagagacaatagcaaaaacacactatttctacaaatgaatagcttaagagtagaagatacagcattatatttctgtgtaaaagaccaaagagaagacgaatgcgaagaatggtggtcagactattacgatttcggaaaagaactaccatgcaggaaatggaaaacaagaggagtagcaggaatactagataactggggacaaggaacaatgttgacagtaagcagt

SEQ ID NO: 47634 - RNA, 432 nt, synthetic construct
  misc_feature 1..432: note = derived and/or modified sequence opt6 from anti-HIV_cap256-119-148743_VR-Chain
  source 1..432: mol_type = other RNA
caagtacaattagtagaaagcggaggaggagtagtacaaccaggaagaagcttaacattaagttgtgcagcaagtcaattcaatttcgcaaactatggaatgcactgggtaagacaagcaccaggaaaaggattagaatgggtagcatcgatatcaaacgatggaacaaaaaaataccatgcagaaagcgtatgggatagatttagcataagcaaagacaatagcaaaaacacgctatttctacaaatgaatagcttaagagtagaagatacagcactatatttctgtgtaaaagaccaaagagaagacgaatgcgaagaatggtggtcagactattacgatttcggaaaaaaactaccatgcagaaaaagtagaggactagcaggaatattccatgtatggggacatggaacaatggtaacagtaagctca

SEQ ID NO: 47635 - RNA, 432 nt, synthetic construct
  misc_feature 1..432: note = derived and/or modified sequence opt6 from anti-HIV_cap256-119-148595_VR-Chain
  source 1..432: mol_type = other RNA
gaagtacaattagtagaaagcggaggaggattagtacaaccaggaggaagtttaagattaagctgtgcagcaagtagattcacattcgataattatggaatgcactgggtaagacaagcaccaggaaaaggactagaatgggtagcattattaaattatgatggttcaaaaaaatattatgtagatagtgtaaaaggaagatttataatattcagagacaatagtaaaaatacactatttttacaaatgaatagtttaagaccagaagatacagcattatatttctgtgtaaaagatcaaagagaagacgcatgtgaagaatggtggtcagactattatgatttcggaaaaaaattaccatgcagaaaatcaagaggactagcaggaatatttcatgtatggggacatggaacaatggtaacagtaagtagt

SEQ ID NO: 47636 - RNA, 432 nt, synthetic construct
  misc_feature 1..432: note = derived and/or modified sequence opt6 from anti-HIV_cap256-119-148490_VR-Chain
  source 1..432: mol_type = other RNA
caagtacaattagtagaaagtggaggaggagtagtacaaccaggaagaagtttaagattaagttgtgtagcaagtggatttacatttagtgattatgcaatgcattgggtaagacaagcaccaggaaaaggattagaatgggtagcaacaatatcatttgatggagcagataaatatcatgcagatgatgtatggggaaggtttacaataagtagagataatagtaaaaatacattatatttacaaatgaatagtttaagaccagaagatacagcattatattattgtgcaaaagatttaagagaagatgaatgtgaagaaagatggagtgattattacgattttggaaaacaattaccatgtagaaaatcaagaggagtagcaggagtatttgataattggggacaaggaacaatggtaacagtaagtagt

SEQ ID NO: 47637 - RNA, 438 nt, synthetic construct
  misc_feature 1..438: note = derived and/or modified sequence opt6 from anti-HIV_cap256-119-148470_VR-Chain
  source 1..438: mol_type = other RNA
caagtacaattagtagaaagtggaggaggagtggtacaaccaggaagaagtttaagattaagttgtgtagcaagtggatttacatttagtagctatggaatacattgggtaagacaagcaccaggaaaaggattagaatgggtagcagtaatatcagatgatggaagtaaaaaatatcatgaagaaagtgtatggggaagatttacaataagtaaagataatagtaaaaatacattatttctacaaatgaatagtttaagaatagaagatacagcattatatttttgtgtaaaagatcaaagagaagatgaatgtgaagaatggtggagtgactattatgattttggaagagaattaccatgtagaaaaagtagagggttaggattagcaggaatatttgatatgtggggacatggaacgatggtaacagtaagtagt

SEQ ID NO: 47638 - RNA, 432 nt, synthetic construct
  misc_feature 1..432: note = derived and/or modified sequence opt6 from anti-HIV_cap256-119-148107_VR-Chain
  source 1..432: mol_type = other RNA
gaagtacaattagtagaaagcggaggaggattagtacaaccaggaggaagtttaagattaagctgtgcagcaagtggatttacagtaagtagtaattatatgacatgggtaagacaagcaccaagaaaaggattagaatgggtaggaagcataagttatgatggaagtgataaatatcatacaaatagtttatgggggagatttatagtaagtagagataatagtaaaaacacactatatttacaaatgaataatttaagaccagaagatacagcattatattattgtgtaagagatagaagagaaagtgaatgtgaagaaaggtggtcagattattatgattttggaaaacaattaccatgtgtaaaaccaagaggagtggcaggaatatttgatatatggggacaaggaacaatggtaacagtaagtagt

SEQ ID NO: 47639 - RNA, 432 nt, synthetic construct
  misc_feature 1..432: note = derived and/or modified sequence opt6 from anti-HIV_cap256-119-147933_VR-Chain
  source 1..432: mol_type = other RNA
gaattacaattagtagaaagtggaggaggattagtacaaccaggatggagtttaagattaagttgtgaagcaagtggatttccatttagtgcattttggatgacatgggtaaggcaagcaccaggaaaaggattaggatgggtagcatttataagatatgatggaagtaataaatattatgcagatagtgtaaaaggaagatttacaataagtagagataatagtatgacaacattatatttacaaatgaatagtttaagagcagaagatgcagcagtgtattattgtgcaaaagatttaagagaagatgaatgtgaagaatggtggagtgattattatgattttggaaaaagattaccatgtagaaaaagtagaggagtagcaggagtatttgataaatggggacaaggaacaatggtaacagtaagcagt

SEQ ID NO: 47640 - RNA, 432 nt, synthetic construct
  misc_feature 1..432: note = derived and/or modified sequence opt6 from anti-HIV_cap256-119-147434_VR-Chain
  source 1..432: mol_type = other RNA
caagtacaattagtagaaagtggaggaggagtagtacaagcaggaagaagtttaagattaagttgtgcagcaagtcaatttacatttggaagatatggaatgcattgggtaagacaagcaccaggaaaaggattagaatgggtgggaagtataagttatgatggaagtgataaatatcatacaaatagtgtatggggaagatttatagtaagtagagataatagtaaaaatacattatatttacaaatgaatagtttaagaccagaagatacagcaatgtattattgtgcaagagatcaaagatattatgaatgtgaagaatgggcaagtgattattatgattttggaagagaacaaccatgtcaagatccaagaggagtagtaggagtatttgatatgtggggacaaggaacaatggtaacagtaagtagt

SEQ ID NO: 47641 - RNA, 435 nt, synthetic construct
  misc_feature 1..435: note = derived and/or modified sequence opt6 from anti-HIV_cap256-119-146106_VR-Chain
  source 1..435: mol_type = other RNA
caagtacaattagtagaaagtggaggaggagtagtacaaccaggaagaagtttaagattaagttgtgcagcaagtggatttacatttagtagtagtggaatgcattgggtaagacaagcaccaggaaaaggattacaatgggtagcagtaataagttatgatggaggaaataaatattatgcagatagtgtaaaaggaagatttacaataagtagagataatagtaaaaataatttatacttacaaatgaatagtttaagaccagaagatacagcattatattattgtgcaagagatttaagagaaatggaatgcgaagaatggaaattatataattattatgattttagaacaagaggaccatgtgtagatccaagaggagtagtaggatcatttgatgtatggggacaaggaacagtagtaacagtaagtagt

SEQ ID NO: 47642 - RNA, 438 nt, synthetic construct
  misc_feature 1..438: note = derived and/or modified sequence opt6 from anti-HIV_cap256-119-145604_VR-Chain
  source 1..438: mol_type = other RNA
gacgtacaattagcagaaagtgggggaggattagtacaaccaggaggaagtttaagattaagttgtgtagcaagcggatttacattttcaagttttgaaatgcactgggtaagacaagcaccaggaaaaggactagaatgggtagcatcaatatcaaatgatggaacaaaaagatatcatgcagaaagcgtatgggatagatttagtataagtaaagataatagtaaaaatacattatttttacaaatgaatagtttaagagtagaagatacagcattatatttctgtgtaaaagatcaaagagaagatgaatgtgaagaatggtggtcagattattacgatttcggaagagaattaccatgtagaaaaagtagaggactaggattagcaggaatatttgatatgtggggacatggaacaatggtaacagtaagttcg

SEQ ID NO: 47643 - RNA, 438 nt, synthetic construct
  misc_feature 1..438: note = derived and/or modified sequence opt6 from anti-HIV_cap256-119-143998_VR-Chain
  source 1..438: mol_type = other RNA
caagtacaactagtagaaagcggaggaggagtagtacaaccaggaaggagcttaagattaagttgtgcagcaagtggatttacatttagaaattatggaatgcactgggtaagacaagcaccaggaaaaggactagaatgggtagcatcaatatcaaatgatggatcaaaaaaatatcatggagatagtgtatgggcaagatttataataagtagagataatagtaaaaatacattatttttacaaatgtcaagtttaagagcagaagatacagcattatatttttgtgtaaaagatcaaagagaagatgaatgtgaagaatggtggtcagactattatgatttcggaagagaattaccatgtagaaaatcaagaggactaggattagcaggaatatttgatatgtggggacatggaacaatggtaacagtaagttca

SEQ ID NO: 47644 - RNA, 438 nt, synthetic construct
  misc_feature 1..438: note = derived and/or modified sequence opt6 from anti-HIV_cap256-119-143441_VR-Chain
  source 1..438: mol_type = other RNA
gaagtacacttagtagaaagcggaggaggactagcacaaccaggaagaagtttaagattaagctgtgcagcaagccaattcaatttcgcaagttatggaatgcactgggtaagacaagcaccaggaaaaggattagaatgggtagcctcaatatcgaacgatggaacgaaaagataccatgcagaaagcgtatgggatagatttagcataagcaaagacaatagcaaaaacacattatttctacaaatgaatagtttaagagtagaagatacagcgctatatttctgtgtaaaagaccaaagagaagacgaatgcgaagaatggtggtcagactattacgatttcggaagagaattaccatgcagaaaatcaagaggactaggactagcaggaatattcgatatgtggggacatggaacaatggtaacagtaagttca

SEQ ID NO: 47645 - RNA, 432 nt, synthetic construct
  misc_feature 1..432: note = derived and/or modified sequence opt6 from anti-HIV_cap256-119-141307_VR-Chain
  source 1..432: mol_type = other RNA
caagtacatttagtagaaagtggaggaggagtagtacaaccaggaagaagtctaagattaagctgtgcagcaagccaatttacatttaatagatatggattacattgggtaagacaagcaccaggaaaaggattagaatgggtagcaggaatatcgtatgatggaagagataaatatcatgcacattttgtatggggaagatttataataagtagagataatagtaaaaatacactatatctacaaatgaatagcttaagagcagaagatacagcattatattattgtgtaagagatctaagagaaagtgaatgtgaattatgggaatcagattattatgatttcgggaaaagattaccatgtgtaaaaccaagaggagtagcaggaacatttgatttatggggacaaggaacaatggtaacagtaagttca

SEQ ID NO: 47646 - RNA, 432 nt, synthetic construct
  misc_feature 1..432: note = derived and/or modified sequence opt6 from anti-HIV_cap256-119-140896_VR-Chain
  source 1..432: mol_type = other RNA
gaagtaaaactagtagaaagtggaggaggactagtacaaccaggaggaagtttaaaattaagctgtgcagcaagcggattcacattctcatactatgcaatgcactgggtaagacaagcaccaggaaaaggactagaatgggtagcagtaatatcatacgatggatcagacaaatactatgcagatagcgtaaaaggaagatttacaataagcagagacaatagcaaaaatacactacatctacaaatgaatagcttaagaccagaagatacagcattatatttctgtgcaagagacttaagagaaagcgaatgcgaagaatgggaatcatactattacgatttcggaaaaaaaggaccatgcgtaaaaccaagaggagtagtaggagtactagatatatggggacaaggaacactagtaacagtaagcagt

SEQ ID NO: 47647 - RNA, 432 nt, synthetic construct
  misc_feature 1..432: note = derived and/or modified sequence opt6 from anti-HIV_cap256-119-140090_VR-Chain
  source 1..432: mol_type = other RNA
gaagtacaattagtagaaagtggaggaggattagtacaaccaggaggaagtttaagattaagctgtgcagcaagtggatttgcatttagtagttattggatgacatgggtaagacaagcaccaggaaaaggattagaatgggtagcagtaataagttatgatggaagtaataaatattatgcagatagtgtaagaggaagatttacaataagtagagatagtagtaaaaatacattatatttagaaatgaatagtttaagaccagaagatacagcactatattattgtgcaaaagatatgagaggatatgaatgtgaagaatggacgtcagattattatgattttggaagaccacaaccatgtatagatagtagaggagtagtaggaacatttgatgtatggggacaaggaacaatggtaacagtaagtagt

SEQ ID NO: 47648 - RNA, 438 nt, synthetic construct
  misc_feature 1..438: note = derived and/or modified sequence opt6 from anti-HIV_cap256-119-140037_VR-Chain
  source 1..438: mol_type = other RNA
caagtacaattagtagaaagcggaggaggattagtacaaccaggaaggagtttaagattaagctgtgcagcaagcggattcacatttgatgactatgtaatgcactgggtaagacaagcaccaggaaaaggactagaatgggtagcatcaataagtaatgatggaacaaaaaaataccatgaagaaagcgtatggggaagatttacaataagcaaagacaatagtaaaagcacactatttttacaaatgaatagtttaagaatagaagatacagcactatatttctgtgtaaaagaccaaagagaagacgaatgtgaagaatggtggtcagactattacgatttcggaagagaattaccatgcaggaaatcaagaggactaggactagcaggaatattcgatatgtggggacatggaacaatggtaacagtaagttca

SEQ ID NO: 47649 - RNA, 432 nt, synthetic construct
  misc_feature 1..432: note = derived and/or modified sequence opt6 from anti-HIV_cap256-119-139135_VR-Chain
  source 1..432: mol_type = other RNA
gaagtacaattagtagaaagtggaggaggagtagtaagaccaggaggaagtgtaagattgagttgtgtagcaagtggatttagttttagaagttatggaatgcattgggtaagacaagcaccaggaaaaggactagaatgggtagcaagtataagttatgatggaagagatttttatcatgcaagaagtgtatggggaagatttacaataagtagagataatagtaaaaatacattacatttacaaatgaatagtttaaggccagaagatacagcattatatttttgtgcaagagatttaagagaaagtgaatgtgaagaatgggaatcatattattatgattttggaaaaaaaggaccatgtgtaaaaccaagaggagtagtaggagtattagatatatggggacaaggaacattagtaacagtaagttca

SEQ ID NO: 47650 - RNA, 438 nt, synthetic construct
  misc_feature 1..438: note = derived and/or modified sequence opt6 from anti-HIV_cap256-119-137881_VR-Chain
  source 1..438: mol_type = other RNA
caagtacaattggtagaaagcggaggaggattagtaaaaccaggaagaagtttaacattaagttgtgcagcaagtcaattcacattttcaaattatggaatgcactgggtaagacaagcaccaggaaaaggactagaatgggtagcatcaatatcaaatgatggaaataaaaaatatcatggagatagcgtatgggcaagatttacaataagcagagacaatagcaaaaacacattatttttacaaatgtcaagtttaagaacagaagatacagcattatatttctgtgtaagagacagaagagaagatgaatgtgaagaatggtggagtgactattacgatttcggaagagaactaccatgcagaaaatttagaggactaggactagcaggaatatttgatatatggggacatggaacaatggtaacagtaagtagt

SEQ ID NO: 47651 - RNA, 432 nt, synthetic construct
  misc_feature 1..432: note = derived and/or modified sequence opt6 from anti-HIV_cap256-119-137643_VR-Chain
  source 1..432: mol_type = other RNA
gaagtacaattagtagaaagtggaggagatctagtacaaccaggaggaagtttaagattaagctgtgcagcaagcggattctcattctcaagctatggaatgcactgggtaagacaagcaccagataaaggactagaatgggtaacagtaatatcatacgatggatcaaacaaacactatgcagatagcgtaaaaggaagatttacaataagcagagacaatagcaaaaacacactatatctagaaatgaatacattaagagcagaagatacagcactatattactgtgcaaaagacttaagagaatacgaatgtgaagaatggacatcagactattacgatttcggaagaccacaaccatgcatagactcaagaggagtagtaggaatactagatatatggggacaaggaacaatggtaagcgtaagttca

SEQ ID NO: 47652 - RNA, 438 nt, synthetic construct
  misc_feature 1..438: note = derived and/or modified sequence opt6 from anti-HIV_cap256-119-137170_VR-Chain
  source 1..438: mol_type = other RNA
caagtgcaattagtagaaagtggaggaggagtagtacaaccaggaagaagtttaagattaagctgtgcagcaagcgaatttacattctcaagatatagcatgcactgggtaagacaagcaccaggaaaaggactagaatgggtagcagtgatatcaagtgatggatcaaaccaattccatgcagatagcgtatggggaagattcacaataagcaaagacaatagcaaaaacacactatttttacaaatgaatagcttaagaatagaagatacagcactatatttctgtgtaaaagaccaaagagaagacgaatgcgaagaatggtggtcggactattacgatttcggaagagaactaccatgcagaaaatcaagaggactaggactagcaggaatattcgatatgtggggacatggaacaatggtaacagtaagctca

SEQ ID NO: 47653 - RNA, 432 nt, synthetic construct
  misc_feature 1..432: note = derived and/or modified sequence opt6 from anti-HIV_cap256-119-136616_VR-Chain
  source 1..432: mol_type = other RNA
caagtacaattagtagaaagcggaggaggagtagtacaaccaggaagatcattaagattaagctgtgcagcaagcggattcacattcagcagaaatgcaataaactgggtaagacaagcgccagggagaggattagaatgggtagcagtaatatcagacgatggatcactaaaatactatgcagatagcgtaaaaggaagatttacaataagcagagacaatagcaaaaacacactatatctacaaatgaataacttaagaccagaagatacagcattatattactgtgtaagagacagaagagaaagcgaatgcgaagaaagatggtcagactattacgatttcggaaaacaactaccatgcgtaaaaccaagaggagtagcaggaatattcgatatatggggacaaggaacaatggtaacagtaagctca

SEQ ID NO: 47654 - RNA, 432 nt, synthetic construct
  misc_feature 1..432: note = derived and/or modified sequence opt6 from anti-HIV_cap256-119-136206_VR-Chain
  source 1..432: mol_type = other RNA
caagtacaattagtagaaagcggaggaggagtagtacaaccaggaagaagtttaagattaagctgtgcagcaagtcaatttacattcggaagatatggaatgcattgggtaagacaagcaccaggaaaaggactagaatgggtagccgcaatatcatttgcaggaacaaaaaaatactatggagatagtgcaagaggaagatttacaataagcagagacaatagcaaaaacatgctatttctacaaatgaatagtttaagagcagaagatacagcattatattactgtgcaagagatttaagagattatgaatgtgaagaatgggaagcatactattacgattttggaagagtaggaccatgtacagacccaagaggagtagtaggaatattagatgtatggggacaaggaacactagtaacagtaagctca

SEQ ID NO: 47655 - RNA, 438 nt, synthetic construct
  misc_feature 1..438: note = derived and/or modified sequence opt6 from anti-HIV_cap256-119-135565_VR-Chain
  source 1..438: mol_type = other RNA
caagtacatttagtagaaagtggaggaggagtagtacaaccgggaaaaagtttaagattaagttgtgcagcaagtcaatttacatttgatagatatggaatgcattgggtaagacaagcaccgggaaaaggattagaatgggtagcaagtataagtaatgatggaacagataaatatcatgcagataatgtatggggaagatttacaataagtagagataatagtaaaaatacattatatttagaaatgaatagtttaagaggagaagatacagcattatatttttgtgtaaaagatcaaagagaagatgaatgtgaagaatggtggagtgattattatgattttggaagagaactaccatgtagaaaaagtagaggactaggattagcaggaatatttgatatgtggggacatggaacaatggtaacagtaagtagt

SEQ ID NO: 47656 - RNA, 432 nt, synthetic construct
  misc_feature 1..432: note = derived and/or modified sequence opt6 from anti-HIV_cap256-119-135025_VR-Chain
  source 1..432: mol_type = other RNA
gaagtacaattagtagaaagcggaggaggattagtacaaccaggaggaagtttaagattaagctgtgaagcaagcggatttacatttaatacatatgaaatgaattgggtaagacaaccaccaggaagaggattagaatgggtagcaggaataagttttgcagcaacaaaaacatattatggaggaagtgtaaaaggaagatttacagtaagtagagatataagtaaaaatacattatatttacaaatggatggattaagaggagaagatacagcattatattattgtgcaaaagatttaagagaattagaatgtgaagaatgggcaagtgattattatgattttggaagaccacaaccatgtttagatccaaggggagtaagcggaataagtaatgtatggggacaaggaacaatggtaacagtaagtagt

SEQ ID NO: 47657 - RNA, 432 nt, synthetic construct
  misc_feature 1..432: note = derived and/or modified sequence opt6 from anti-HIV_cap256-119-133983_VR-Chain
  source 1..432: mol_type = other RNA
caaatgcaattagtagaaagcggaggaggagtagtacaaccaggaagaagtttaacattaagttgtgcagcaagccaattcaatttcgcaaactatggaatgcactgggtaagacaagcaccaggaaaaggactagaatgggtagcatcaatatcaaacgatggaacaaaaaaataccatgaagaaagcgtatggggaagatttacaataagcaaagacaatagcaaaaacacactatttctacaaatgaatagcttaagaccagaagatacagcattatattactgtgcaaaagacttaagagaagacgaatgcgaagaaagatggtcagactattacgatttcggaaaacaattaccatgcagaaaatcaagaggagtagcaggagtattcgataactggggacaaggaacaatggtaacagtaagctca

SEQ ID NO: 47658 - RNA, 438 nt, synthetic construct
  misc_feature 1..438: note = derived and/or modified sequence opt6 from anti-HIV_cap256-119-133917_VR-Chain
  source 1..438: mol_type = other RNA
caaatgcaattagtagaaagcggaggaggagtagtacaaccaggaagaagtttaacattaagctgtgcagcaagccaattcacattctcaaattatggaatgcactgggtaagacaagcaccaggaaaaggattagaatgggtagcatcaatatcaaacgatggatcaaaaaaataccatggagatagcgtatgggcaagatttacaataagtagagacaatagtaaaaacacactatttctacaaatgtcaagcttaagagtagaagatacagcattatatttctgtgtaagagaccaaagagaagatgaatgtgaagaatggtggtcagactattacgatttcggaagagaactaccatgcagaaaatttagaggattaggactagcaggaatattcgatatatggggacatggaacaatggtaacagtaagtagt

SEQ ID NO: 47659 - RNA, 432 nt, synthetic construct
  misc_feature 1..432: note = derived and/or modified sequence opt6 from anti-HIV_cap256-119-132663_VR-Chain
  source 1..432: mol_type = other RNA
caagcacaattagtagaaagcggaggaggagtagtacaaccaggaagaagtttaagaataagctgtgcagtaagccaattcacattctcaagatatggaatgcactgggtaagacaagcaccaggaaaaggactagaatgggtagcatcaatatcattcgatggaagagacaaataccatagcccactagtatggggaagactaacaataagcagagacaatagcaaaaatacactatttctagaaatgaatagtttaagagcagaagatacagcagtatattactgtgccagggacctaagagaaagtgaatgcgaagaatggcaatcagactattacgcattctataaaaaactaccatgcgtaaaaccaagaggagtagcaggatcactagatatctggggacaaggaacagtagtaacagtaagctca

SEQ ID NO: 47660 - RNA, 438 nt, synthetic construct
  misc_feature 1..438: note = derived and/or modified sequence opt6 from anti-HIV_cap256-119-132113_VR-Chain
  source 1..438: mol_type = other RNA
caagtacaattagtagaaagcggaggaggactagtaaaaccgggaggaagcttaagattaagctgtgcagcaagccaattcaatttcgcaaactatggaatgcactgggtaagacaagcaccagggaaaggactagaatgggtagcatcaatatcaaacgatggaacaaaaaaataccatgaagaaagcgtatggggaagatttacaataagcaaagacaatagtaaaagcacactatttctacaaatgaatagcttgagaatagaagatacagcattatatttctgtgtaaaagaccaaagagaagacgaatgcgaagaatggtggtcagactattacgatttcggaagagaactaccatgcagaaaatcaagaggattaggattagcaggaatattcgatatgtggggacatggaacaatggtaacagtaagctca

SEQ ID NO: 47661 - RNA, 432 nt, synthetic construct
  misc_feature 1..432: note = derived and/or modified sequence opt6 from anti-HIV_cap256-119-131839_VR-Chain
  source 1..432: mol_type = other RNA
caagtacaattagtagaaagtggaggaggagtagtacaaccaggaagaagtttaagactaagctgtgcagcaagcggatttacatttagtagttatgcaatgcattgggtaagacaagcaccaggaaaaggattagaatgggtagcagtaataagttatgatggaagtaataaatattatgcagatagtgtaaaaggaagatttacaataagtagagataatagtaaaaatacattatatttacaaatgaatagtctaagagcagaagatacagcagtatattattgtgcaagagatcaaagatattatgaatgtgaagaatgggcaagtgattattatgattttggaagagaacaaccatgtcaagatccaagaggagtagtaggagtatttgatatgtggggacaaggaacaatggtaacagtaagtagt

SEQ ID NO: 47662 - RNA, 435 nt, synthetic construct
  misc_feature 1..435: note = derived and/or modified sequence opt6 from anti-HIV_cap256-119-130626_VR-Chain
  source 1..435: mol_type = other RNA
gaagtacaattagtagaaagcggaggaggattaatacatccaggaggatgtttaagactaagttgtgcagtaagtggatttacatttagtgattatccaatgcattgggtaagacaaagtccaggaaaaggattagaatgggtagcagtaataagttatgatggaataaattattattatgcagatagcgtaaaaggaagatttacaataagcagagataatagtaaaaataatttatttttacaaatgaatagtttaagattagaagatacagcactatattattgtgcaagagatttaagagaattagattgtgaagaatggacattatataattattatgattttggaagtagaggaccatgtgtagatccaagaggagtaggaggaagttttgatgtatgggggcaaggaacaatggtaacagtaagtagt

SEQ ID NO: 47663 - RNA, 438 nt, synthetic construct
  misc_feature 1..438: note = derived and/or modified sequence opt6 from anti-HIV_cap256-119-130191_VR-Chain
  source 1..438: mol_type = other RNA
gaagtacaattagtagaaagtggaggaggactaatacaaccaggaagaagtttaagattaagctgtgcagcaagtggatttacagtaagtagtaattttatgacatgggtaagacaagcaccaggaaaaggattagaatgggtagcaagtataagtaatgatggaacaaaaaaatatcatgcagaaagtgtatgggatagatttagtataagtaaagataatagtaaaaatacactatttttacaaatgaatagtttgagagtagaagatacagcattatatttttgtgtaaaagatcaaagagaagatgaatgtgaagaatggtggagtgattattatgattttggaagagaattaccatgtagaaaaagtagaggattaggattagcaggaatatttgatatgtggggacatggaacaatggtaacagtaagtagt

SEQ ID NO: 47664 - RNA, 438 nt, synthetic construct
  misc_feature 1..438: note = derived and/or modified sequence opt6 from anti-HIV_cap256-119-129798_VR-Chain
  source 1..438: mol_type = other RNA
caagtacaattagtagaaagcggaggaggggtagtacaaccaggaaaaagtttaagattaagttgtgcagcaagtggatttatatttagtagttattttatgcattgggtaagacaagcaccaggaaaaggattagaatgggtagcagtagtaacagatgatggaagtaaaaaatattatgcagatagtgtaaaaggaagatttacaataagtagagattatagtaaaaatacattatttttacaaatgaatagattaagagtagaagatacagcattatatttctgtgtaaaagatcaaagagaagatgaatgtgaagaatggtggagtgattattatgattttggaagagaattaccatgtagaaaatttagaggattaggattagcaggaatatttgatatgtggggacatggaacaatggtaacagtaagtagt

SEQ ID NO: 47665 - RNA, 432 nt, synthetic construct
  misc_feature 1..432: note = derived and/or modified sequence opt6 from anti-HIV_cap256-119-128745_VR-Chain
  source 1..432: mol_type = other RNA
caagtacaattagtagaaagcggaggaggagtagtacaaccaggaagaagtttaagattaagctgtgcagcaagcggattcacattttcaaactatgcaatgcactgggtaagacaagcaccaggaaaaggactagaatgggtagcatcaatatcattcgcaggaacaaaaacacactatggaaatagcgtaaaaggaagatttagcataagtagagacaatagcataaacacagtatatctacaaatgaatagcttaagagcagaagatacagcactatattactgtgccaaagacttaagagaatatgaatgcgaagaatggacatcagactattacgatttcggaagaccacaaccgtgcatagactcaagaggagtagtaggaatattagatatatggagccaaggaacaatggtaacagtaagctca

SEQ ID NO: 47666 - RNA, 438 nt, synthetic construct
  misc_feature 1..438: note = derived and/or modified sequence opt6 from anti-HIV_cap256-119-128593_VR-Chain
  source 1..438: mol_type = other RNA
caagtacaattagtagaaagtggaggaggagtggtacaaccaggaagaagtctaagattaagctgtgcagcaagtggatttacatttagtagttatgcaatgcattgggtaagacaagcaccaggtaaaggattagaatgggtggcaagtataagttatgatggaagagatttttatcatgcaagaagtgtatggggaaggtttacaataagtagagataatagtaaaaatacattacatttacaaatgaatagcttaagagtagaagatacagcattatatttttgtgtaaaagatcaaagagaagatgaatgtgaagaatggtggagtgattattatgattttggaagagaattaccatgtagaaaatcaagaggattaggattagcaggaatatttgatatatggggacatggaacaatggtaacagtaagtagt

SEQ ID NO: 47667 - RNA, 438 nt, synthetic construct
  misc_feature 1..438: note = derived and/or modified sequence opt6 from anti-HIV_cap256-119-128152_VR-Chain
  source 1..438: mol_type = other RNA
caagtacaattagtagaaagcggaggaggagtagtacaaccaggaagaagtttaagattaagctgtgcagtaagtggatttacatttacaagttatccaatgcactgggtaagacaagcaccaggaaaaggattagaatgggtagcatcagtatcaaatgatggaacaaaaaaatatcatggagatagcgtatgggatagatttacaataagcagagacaatagcaaaaacacactatttctacaaatgtcaagtttgagagcagaagatacagcagtatatttctgtgtaagagatgaaagagaagatgaatgtgaagaatggtggtcagactattacgatttcggaagagaactaccatgcagaaaatttagaggattaggattagcaggaatatttgatatatggggacatggaacactagtaacagtaagttca

SEQ ID NO: 47668 - RNA, 438 nt, synthetic construct
  misc_feature 1..438: note = derived and/or modified sequence opt6 from anti-HIV_cap256-119-127693_VR-Chain
  source 1..438: mol_type = other RNA
gaagtacaattactagaaagtggaggaggactagtacaaccaggaggaagtttaagattgagctgtgcagcaagtggatttacatttagtagttatgcaatggcatgggtaagacaagcaccaggaaaaggattagaatgggtagcaagtataagtaatgatggaagtaaaaaatatcatggagatagtgtatgggcaagatttataataagtagagataatagtaaaaatacattatttttacaaatgagtagcttaagagtagaagatacagcattatatttttgtgtaagagatcatagagaagatgaatgtgaagaatggtggagtgattattatgattttggaagagaattaccatgtagaaaatttagaggattaggattagcaggaatatttgatatatggggacatggaacaatggtaacagtaagtagt

SEQ ID NO: 47669 - RNA, 432 nt, synthetic construct
  misc_feature 1..432: note = derived and/or modified sequence opt6 from anti-HIV_cap256-119-126684_VR-Chain
  source 1..432: mol_type = other RNA
caagtacaattagtagaaagtggaggaggagcagtaagaccaggaagaagtttaagattaagttgtgcaacaagtggatttacatttagtaattatgcaatgcattgggtaagacaagcaccaggaaaaggattagaatgggtaacaggaatatcatttgcaggaacaaaaacatattatggagatagtgtaagaggaagatttacagtaagtagagatataagtaaaaatacattatttttacaaatgaatagtttaagaccagatgatacagcaatgtattattgtgcaagagatcaaagatattatgaatgtgaagaatgggcaagtgattattatgattttggaagagaacaaccatgtttagatccaagaggagtagtaggaatatttgatttatggggacaaggaacaatggtaacagtaagtagt

SEQ ID NO: 47670 - RNA, 438 nt, synthetic construct
  misc_feature 1..438: note = derived and/or modified sequence opt6 from anti-HIV_cap256-119-126056_VR-Chain
  source 1..438: mol_type = other RNA
gaagtacaattagtagaaagcggaggaggactagtacaaccaggaggaagtttaagattaagttgtgcagatagtggattcacattcagtagctattggatgagctgggtaagacaagcaccaggaaaaggactagaatgggtagcatcaatatcaaacgatggaacaaaaaaataccatgcagaaagcgtatgggatagatttagcataagcaaagacaatagcaaaaacacactatttctacaaatgaatagcttaagagtagaagatacagcactatatttctgtgtaaaagaccaaagagaagacgaatgcgaagaatggtggtcagactattacgatttcggaagagaactaccatgcagaaaatcaagaggactaggattagcaggaatattcgatatgtggggacatggaacaatggtaacagtaagttca

SEQ ID NO: 47671 - RNA, 432 nt, synthetic construct
  misc_feature 1..432: note = derived and/or modified sequence opt6 from anti-HIV_cap256-119-125765_VR-Chain
  source 1..432: mol_type = other RNA
caagtacaattagtacaaagcggaggaggagtagtacaaccaggaagaagtctaagattaagctgtgcagcaagtggattcacattctcaagttatgtaatgcactgggtaagacaagcaccaggaaaaggactcgaaggagtagcagtaatatcattcgatggaaataacgaatactatgcagatagcgtaaaaggaagatttacaataagcagagacaatagcaaaaacacagtatatctacaaatgaatagcctaagagtagaagatacagcattatattactgtgcaaaagacatgagagaatacgaatgcgaagaatggacatcagactattacgatttcggaagaccacaaccatgcatagactcaagaggagtagtaggaatactagatatatggggacaaggaataatggtaacagtaagctca

SEQ ID NO: 47672 - RNA, 438 nt, synthetic construct
  misc_feature 1..438: note = derived and/or modified sequence opt6 from anti-HIV_cap256-119-125106_VR-Chain
  source 1..438: mol_type = other RNA
caagtacaattagtagaaagtggaggaggagtagtacaaccaggaaggagtttaagattaagttgtgcagcaagtggatttatatttagaagttatggaatgcattgggtaagacaagcaccaggaaaaggattagaatgggtggcaagtataagtaatgatggaacaaaaagatatcatgcagaaagtgtatgggatagatttagtataagtaaagataatagtaaaaatacattatttttacaaatgaatagtttgagagtagaagatacagcattatatttttgtgtaaaagatcaaagagaagatgaatgtgaagaatggtggagtgattattatgattttggaagagaattaccatgtagaaaaagtagaggattaggattagcaggaatatttgatatgtggggacatggaacaatggtaacagtaagtagc

SEQ ID NO: 47673 - RNA, 435 nt, synthetic construct
  misc_feature 1..435: note = derived and/or modified sequence opt6 from anti-HIV_cap256-119-124026_VR-Chain
  source 1..435: mol_type = other RNA
caagtacaattagtagaaagtggaggaggagtagtacaaagtggaagaagtttaagattaacatgtagtggaagtgcatttagatttagtagttatacagtacattgggtaagacaagcaccaggaaaaggattagaatggttagcattaataagttatgatggacaaaaaaaacattttgcagatagtgtaaaaggaagatttacaataagtagagataatagcaaaaataatttatttttacaaatgaatagtttaagattagaagatacagcattatattattgtgcaagagatttaagagaattagattgtgaagaatggacattatataattattatgattttggaagtagaggaccatgtgtagacccaagaggagtaggaggaagttttgatgtatggggacaaggaacaatggtaacagtaagtagc

SEQ ID NO: 47674 - RNA, 432 nt, synthetic construct
  misc_feature 1..432: note = derived and/or modified sequence opt6 from anti-HIV_cap256-119-121783_VR-Chain
  source 1..432: mol_type = other RNA
ctaggaagattagtagcaagcggaggaggagtagtaccaccaggaggaagtttaacattaagctgtgtaacaagtcaattcacattcagtggatgtggattacactgggtaagacaagcaccaggaaaaggactagaatgggtagcatcaatatcatttgcaggaacaaaaaaacattatggatcaagtgtaagaggaagatttagcataagtagagacaatagtaaaaatacactatatctacaaatgaatagtttaagaacagaagatacagcgttatatttctgtgcaaaagacttaagagaatatgaatgtgaagaatggacatcagactattatgatttcggaagaccacaaccatgcatagactcaagaggagtagtaggaatactagatatatggggacaaggaacaatggtaacagtaagttca

SEQ ID NO: 47675 - RNA, 432 nt, synthetic construct
  misc_feature 1..432: note = derived and/or modified sequence opt6 from anti-HIV_cap256-119-121208_VR-Chain
  source 1..432: mol_type = other RNA
ttaggaagattagtagcaagcggaggaggagtagtaccaccaggaaaaagtttaacattaagctgtgtagcaagccaattcacattttcaggatgtggattacactgggtaagacaagcaccaggaaaaggactagaatgggtagcatcaatatcatttgcaggaacaaaaaaacactatggaaatttcgtacgaggaagatttacaataagcagagacaatagtaaaaacacactatatttacaaatgaatagcttaagagcagaagatacagcactatattactgtgcaaaagacctaagagaatatgaatgtgaagaatggacaagtgactattacgatttcggaagaccacaaccatgtatagactcaagaggagtagtaggaatattagatatatggggacaaggaacaatggtaacagtgagttca

SEQ ID NO: 47676 - RNA, 432 nt, synthetic construct
  misc_feature 1..432: note = derived and/or modified sequence opt6 from anti-HIV_cap256-119-120945_VR-Chain
  source 1..432: mol_type = other RNA
caagtacaattagtagaaagcggaggaggagtagtacaaccaggaggaagtctaagattaagctgtgtagcaagcggatttacattctcaaattatggaatgcactgggtaagacaagcaccaggaaaagggctagcgtgggtagcatttataagatatgatggatcaaacaaatactatgtagatagcgtatggggaagatttacaataagcagagacaatagcaaaaacacactacatttacaaatgaatagtttaagaccagaagatacagcattatatttctgtgcaagagacttaagagaaagtgaatgtgaagaatgggaatcatactattacgatttcggaaacaaaggaccatgcgtaaaaccaagaggagtagtaggagtattagatatatggggacaaggaacattagtaacagtaagttca

SEQ ID NO: 47677 - RNA, 432 nt, synthetic construct
  misc_feature 1..432: note = derived and/or modified sequence opt6 from anti-HIV_cap256-119-118229_VR-Chain
  source 1..432: mol_type = other RNA
caagtacaagtagtagaaagcggaggaggagtagtacaaccaggaagaagcctaagattaagctgtgcagcaagcggattcacattctcaaactatgcaatacactgggtaagacaagcaccaggaaaaggactagaatgggtagcattaatatcatacgatggatataacaaatactatgcagatagcgtaagaggaagatttacaataagcagagacaatagcaataacacagtatatttacaaatgaatagcttaaaaccagaagatacagcagtctattactgtgcaagagacttaagagaaagcgaatgcgaagaatgggaatcatactattacgacttcggaaaaaaaggaccatgcgtaaaaccaagaggagtagtaggagtactagatatatggggacaaggaacactagtaacagtaagctca

SEQ ID NO: 47678 - RNA, 432 nt, synthetic construct
  misc_feature 1..432: note = derived and/or modified sequence opt6 from anti-HIV_cap256-119-118025_VR-Chain
  source 1..432: mol_type = other RNA
gaagtacaattagtagaaagcggaggaggagtagtacaaccaggaaaaagcctaagattaagttgtacagcaagccaattcacattctcaaactttggaatgcactgggtaagacaagcaccaggaaaaggattagaatgggtagcatcaatatcattcgtaggaataaaaacacactatgcaaatagcgtaagaggaagatttacaataagcagagaccaaagcaaaaacacactatatctacaaatgaatagcgtaagaatagaagatacagcaagatatttctgtgcaagagacatgagagaatacgaatgcgaactatgggcatcggactattacgatttcggaaaaccacaaccatgcgaagacccaagaggagtagtaggaacattcgatatgtggggattaggaacattagtaacagtaagttca

SEQ ID NO: 47679 - RNA, 432 nt, synthetic construct
  misc_feature 1..432: note = derived and/or modified sequence opt6 from anti-HIV_cap256-119-117418_VR-Chain
  source 1..432: mol_type = other RNA
caagtacaattagtagaaagtggaggaggagtagtacaaccaggaagaagtttaagattaagttgtgcagcaagtggatttaattttagaaattatgatataaattgggtaagacaagtaccaggaaaaggactagaatgggtagcagcaatatcatttgatggagcagataaatatcatgcagataatgtatggggaagattaagtataagcagagataatagtaaaagtacattatatttacaaatgaatagtctaagaccagaagatacagcagtatatttctgtgcaaaagatttaagagaagatgaatgtgaagaaagatggagtgattattatgattttggaaaacaattaccatgtagaaaaagtagaggagtagcaggaatatttgataattggggtcaaggaacaatggtaacagtaagtgca

SEQ ID NO: 47680 - RNA, 432 nt, synthetic construct
  misc_feature 1..432: note = derived and/or modified sequence opt6 from anti-HIV_cap256-119-117250_VR-Chain
  source 1..432: mol_type = other RNA
caagtaagattagtagaaagtggaggaggagtagtacaaccaggaggaagtttaagattaagttgtgcagcaagtcaatttacatttagtgcatatggaatgcattgggtaagacaagcaccaggaaaaggattagaatgggtagcaagtataagttttgatggaacagataaatttcatgcagataaagtatggggaagattagtaataagtagagataatagtaaaaatacattatatttacaaatgaatagtttaagaccagaagatacagcagtatattattgtgcaaaagatttaagagaagatgaatgtgaagaaagatggagtgattattatgattttggaaaacaattaccatgtagaaaaagtagaggagtagcaggagtatttgataattggggacaaggaacaatggtaacagtaagtagt

SEQ ID NO: 47681 - RNA, 432 nt, synthetic construct
  misc_feature 1..432: note = derived and/or modified sequence opt6 from anti-HIV_cap256-119-117230_VR-Chain
  source 1..432: mol_type = other RNA
caagtacaattagtagaaagtggaggaggaggagtacaaccaggaagaagcttaagattaagttgtgcagcaagtggatttacattaagtagttatggaatgcattgggtaagacaagcaccaggaaaaggactagaatgggtagcaagtataagttttgatggaagagattattatcatagtccacatgtatggggaagattaacaataagtagggataatagtaaaaatacattatatttacaaatgaatagtttaagagcagaagatacagcattatattattgtgcaagagatttaagagaaagtgaatgtgaagaatgggaaagtgattattatgattttggaaaaaaaggaccatgtgtaaaaccaagaggagtagcaggaagtttagatatgtggggacaaggaacaatggtaatagtaagtagt

SEQ ID NO: 47682 - RNA, 432 nt, synthetic construct
  misc_feature 1..432: note = derived and/or modified sequence opt6 from anti-HIV_cap256-119-116999_VR-Chain
  source 1..432: mol_type = other RNA
caagtacaattagtagaaagcggaggaggagtagtacaaccaggaacaagtttaagaataagctgtgcagcaagccaattcacattctcaagatatggaatgcactgggtaagacaagcaccaggaaaagggctagaatgggtagcatcaataagttatgatggaagagactattaccatgcaggaagagtatggggaagatttacaataagcagagacaatagtaaaaacacattatatttacaaatgaatagtttaagaccagaagatacagcattatatttctgtgtaagagattcaagagaaagtgaatgtgaagaatgggaatcagactattacgatttcggaaaaaaactaccatgtgtaaaaccaagaggagtagtaggagtactagatctatggggacaaggaacactagtaacagtaagctca

SEQ ID NO: 47683 - RNA, 432 nt, synthetic construct
  misc_feature 1..432: note = derived and/or modified sequence opt6 from anti-HIV_cap256-119-116558_VR-Chain
  source 1..432: mol_type = other RNA
caagtacaattagtagaaagcggaggcggagtagtacaaccaggaagaagcctaagattaagctgtgcagcaagcggattcacattcaatagatatagcttacactgggtaagacaagcaccaggaaaaggattagaatgggtagcatttacatcatacgatggatcaaacaaatactatccagatagcgtaaaaggaagatttacaataagcagagattcaagcaaaaacacattatatctagaaatgaatagtttaagaccagaagatacagcactatattactgtgcaaaagacatgagaggatacgaatgcgaagaatggacatcagactattacgatttcggaagaccacaaccgtgcatagactcaagaggagtagtaggaacattcgatgtatggggacaaggaacaatggtaacagtaagttca

SEQ ID NO: 47684 - RNA, 432 nt, synthetic construct
  misc_feature 1..432: note = derived and/or modified sequence opt6 from anti-HIV_cap256-119-116484_VR-Chain
  source 1..432: mol_type = other RNA
gacgtacaactactagaaagtggaggagatctagtacaaccaggaggaagtctacgattaagctgtgcagcaagcggattcacattcacaaaatatgaaatgacatgggtaagacaagcaccaggaaaaggactagaatgggtagcatcaatatcatacgatggatcagacaaataccatacaagctcattatggggaagatttatagtaagcagagacaatagtaaaaacacactatatctacaaatgaatagcctaagaccagaagatacagcactatattactgtgtaagagacagaagagaaagcgaatgcgaagaaagatggtcagactattacgatttcggtaaacaactaccatgcgtaaaaccaagaggagtagcaggaatattcgatatatggggacaaggaacaatggtaacagtaagctca

SEQ ID NO: 47685 - RNA, 438 nt, synthetic construct
  misc_feature 1..438: note = derived and/or modified sequence opt6 from anti-HIV_cap256-119-114844_VR-Chain
  source 1..438: mol_type = other RNA
gaagtacaattagtagaaagcggaggagatttagtacaaccaggaagaagcttaagattaagttgtgcagcaagcggattcacattctcaagttattggatgagctgggtaagacaagcaccaggaaaaggactagaatgggtagcatcaatatcaaacgatggaacaaaaaaataccatgaagaaagcgtatggggaagatttacaataagcaaagacaatagcaaaagcacactatttctacaaatgaatagtttaagagtagaagatacagcattatatttctgtgtaaaagaccaaagagaagacgaatgtgaagaatggtggtcagactattacgatttcggaagagaactaccatgcagaaaatcaagaggactaggactagcaggaatattcgatatgtggggacatggaacaatggtaacagtaagctca

SEQ ID NO: 47686 - RNA, 438 nt, synthetic construct
  misc_feature 1..438: note = derived and/or modified sequence opt6 from anti-HIV_cap256-119-114141_VR-Chain
  source 1..438: mol_type = other RNA
ggaggaagaagtggaggaggaggagtaggaacaacaccaagaagaggaccattaagattaagttgtgcagcaagtggatttacattagatgattatgcaatgcattgggtaagacaagcaccaggaaaaggattagaatgggtagcaagtataagtaatgatggaacaaaaaaatatcatgcagaaagtgtatgggatagatttagtataagtaaagataatagtaaaaatacattatttttacaaatgaatagtttaagagtagaagatacagcattatatttttgtgtaaaagatcaaagagaagatgaatgtgaagaatggtggagtgattattatgtattttgggaaagggcaccatgtagaacagtaccaggaagaggaccaggatggtattttgatatggtaggaagaagaacaatggtaacagtaagtagt

SEQ ID NO: 47687 - RNA, 432 nt, synthetic construct
  misc_feature 1..432: note = derived and/or modified sequence opt6 from anti-HIV_cap256-119-111917_VR-Chain
  source 1..432: mol_type = other RNA
gaagtacatttagtagaaagcggaggaggattagtacaaccaggaggaagtttaagattaagttgtgcagcaagtggatttacatttagtagttatggaatgcattgggtaagacaagcaccaggaaaaggattagaatgggtagcaacaataagttttgatggagcagataaatatcatgcagatgatgtatggggaagatttagtataagtagagataatagtaaaaatacattatatttacaaatgaataatctaagaccagaagatacagcattatattattgtgcaaaagatttaagagaagatgaatgtgaagaaagatggagtgattattatgattttggaaaacaattaccatgtagaaaaagtagaggagtagcaggagtatttgataattggggacaaggaacaatggtaacagtaagtagt

SEQ ID NO: 47688 - RNA, 432 nt, synthetic construct
  misc_feature 1..432: note = derived and/or modified sequence opt6 from anti-HIV_cap256-119-111862_VR-Chain
  source 1..432: mol_type = other RNA
caagtacaattagtagaaagcggaggaggagtagtacaaccaggaggaagtttgagattaagctgtgcagcaagtggattcacatattcagactatggaatgcactgggtaagacaagcaccaggaaaaggactagaatgggtagcaagtatatcatttgcaggaacaaaacaacactatggaaatagcgtaaaagggagatttacaataagcagagacaatagtaaaaacacagtatatctacaaatgaatagtttaagagtagaagatacagcactatattactgtgcaaaagacatgagagaatatgaatgtgaagaatggacatcagactattacgatttcggaagaccacaaccatgtatagactcaagaggagtagtaggaatattagatatatggggacaaggaataatggtaacagtaagttca

SEQ ID NO: 47689 - RNA, 432 nt, synthetic construct
  misc_feature 1..432: note = derived and/or modified sequence opt6 from anti-HIV_cap256-119-110064_VR-Chain
  source 1..432: mol_type = other RNA
ctcggaagattagtagcaagcggaggaggagtagtaccaccaggaagaagtttaagattaagctgtgtagcaagtcaattcacattttcaggatgtggattacactgggtaagacaagcaccaggaaaaggattagaatgggtagcatcaatatcatttgcaggaacaaaacaacattatggaaatagtgtaaaaggaagatttacaataagtagagacaatagcaaaaatacagtatatctacaaatgaatagtttaagagtagaagatacagcattatattactgtgcaaaagatatgagagaatatgaatgtgaagaatggacatcagactattacgatttcggaagaccacaaccatgcatagactcaagaggagtagtaggaatactagatatatggggacaaggaacaatggtaacagtaagtttt

SEQ ID NO: 47690 - RNA, 432 nt, synthetic construct
  misc_feature 1..432: note = derived and/or modified sequence opt6 from anti-HIV_cap256-119-109192_VR-Chain
  source 1..432: mol_type = other RNA
caagtacaattagtcgaaagcggaggaggagtagtacaaccaggaagatcattaagattaagctgtgcagcaagcggattcacattcagcaactatgcaatgcactgggtaagacaagcaccaggaaaaggactagaatgggtagcagtgatagcatacgatggagataacaaatactatgcagatagcgtaaaaggaagatttacaataagcagagacaatagtaaaaacacactatatctacaaatgaatagcttaagagcagaagatacagcgttatattactgtgcaaaagacttaagagaagacgaatgtgaagaatggtggtcagactattacgatctaggaaaacaattaccatgcagaaaatcaagaggagtagcaggagtattagataaatggggattaggaacaatggtaacagtaagctca

SEQ ID NO: 47691 - RNA, 435 nt, synthetic construct
  misc_feature 1..435: note = derived and/or modified sequence opt6 from anti-HIV_cap256-119-108793_VR-Chain
  source 1..435: mol_type = other RNA
caattccaattagtagaatcaggaggaggagtagtacaaccaggaagatcactaagactatcatgcgcagcatcaggatttacatttagctcatacccaatgcattgggtaagacaagcaccaggaaaaggactagaatgggtagcactaataagctatgacggaacagataaatattacgcagactcagtaaaaggaagattcacaatatcaagagataactcgaaaaatacattatacttacaaatgaactcactaagagtagaagacacagcagtataccattgcgcaaaagatctaggaggatcaaaatctgacgaatgggcaacagattactattacgattggtcaaaagcatacccagtacatgacccaagagcagtagtaggagtattcgatatatggggacaaggaacattagtaacagtaagctca

SEQ ID NO: 47692 - RNA, 432 nt, synthetic construct
  misc_feature 1..432: note = derived and/or modified sequence opt6 from anti-HIV_cap256-119-108127_VR-Chain
  source 1..432: mol_type = other RNA
caagtacaattagtagaaagtggaggaggagtagtacaaccaggaagaagtttaagaataagctgtgcagcaagtcaatttacatttaatagatatggaatgcattgggtaagacaagcaccgggaaaaggattagaatgggtagcaagtataagttatgatggaagtgataaatatcatgcaggattagtatggggaagatttataataagtagagataatagtaaaaatacattatatttacaaatgaatagtttgagagcagaagatacagcattatattattgtgtaagagatagaagagaaagtgaatgtgaagaaagatggagtgattattatgattttggaaaacaattaccatgtgtaaaaccaagaggagtagcaggaatatttgatatatggggacaaggaacaatggtaacagtaagtagt

SEQ ID NO: 47693 - RNA, 438 nt, synthetic construct
  misc_feature 1..438: note = derived and/or modified sequence opt6 from anti-HIV_cap256-119-107758_VR-Chain
  source 1..438: mol_type = other RNA
gaagtacaattagtagaaagtggaggaggattagtaaaaccaggaggaagtttaagattaagttgtgcagcaagtggatttacatttagtaatgcatggatgagttgggtaagacaagcaccaggaaaaggattagaatgggtagcaagtataagtaatgatggaacaaaaaaatatcatgaagaaagtgtatggggaagatttacaataagtaaagataatagtaaaaatacattatttttacaaatgaatagtttaagaatagaagatacagcattatatttttgtgtaaaagatcaaagagaagatgaatgtgaagaatggtggagtgattattatgattttggaagagaattaccatgtaggaaaagtagaggattaggattagcaggaatatttgatatgtggggacatggaacaatggtaacagtaagtagt

SEQ ID NO: 47694 - RNA, 432 nt, synthetic construct
  misc_feature 1..432: note = derived and/or modified sequence opt6 from anti-HIV_cap256-119-107209_VR-Chain
  source 1..432: mol_type = other RNA
gaagtacaattagtagaaagcggaggaggattagtacaaccaggaagaagtttaagattaagctgtacagcaagtggatttacatttggagattatggaatgcattgggtaagacaagcaccaggaaaaggattagaatgggtagcagcaataagttttgatggagcagataaatatcatgcagataatgtatggggaagattaagtataagtagagataatagtaaaagtacattatatttacaaatgaatagcttaagaccagaagatacagcagtatatttttgtgcaaaagatttaagagaagatgaatgtgaagaaagatggagtgattattatgattttggaaaacaattaccatgtagaaaaagtagaggagtagcaggaatatttgataattggggacaaggaacaatggtaacagtaagtgca

SEQ ID NO: 47695 - RNA, 432 nt, synthetic construct
  misc_feature 1..432: note = derived and/or modified sequence opt6 from anti-HIV_cap256-119-107184_VR-Chain
  source 1..432: mol_type = other RNA
caagcacaattagtagaaagtggaggaggagtagtacaaccaggaagaagtttaggattaagttgtgcagcaagcaaatttagtttatcaagttatggaatgcattgggtaagacaagcaccaggaagaggattagaatgggtagcaggaataagttttgcaggaacaaaaaaatattatgcagatagtgtaagaggaagatttagtgtaagtacagatataagtaaaaatacattatatttacaaatgaatagtttaagaccagcagatacagcattatatttttgtgcaagagatttaagatattatgaatgtgaagaatgggcaagtgactattatgattttggaaaagaacaaccatgtttagatccaagaggagtagtaggaatatttgatttatggggacaaggaacaatggtaacagtaagtagt

SEQ ID NO: 47696 - RNA, 438 nt, synthetic construct
  misc_feature 1..438: note = derived and/or modified sequence opt6 from anti-HIV_cap256-119-106827_VR-Chain
  source 1..438: mol_type = other RNA
gcagtacaattagtagaaagtggaggaggattagtacaaccaggaggaagtttaagattaagctgtagtgtaagccaatttacgtttggaagatatggaatgtattgggtaagacaagcaccaggaaaaggattagaatgggtagcagtaataagttatgatggagggaatagatattatgcagatagtgtgaaaaatagatttagtataagtagagataatagtaaaaatacattatttttacaaatgtcaagtttaagagcagaagatacagcattatatttttgtgtaagagatcatagagaagatgaatgtgaagaatggtggagtgattattatgattttggaagagaattaccatgtagaaaatttagagggctaggattagcaggaatatttgatatatggggacatggaacaatggtaacagtaagtagt

SEQ ID NO: 47697 - RNA, 432 nt, synthetic construct
  misc_feature 1..432: note = derived and/or modified sequence opt6 from anti-HIV_cap256-119-106511_VR-Chain
  source 1..432: mol_type = other RNA
caagtacaattggtagaaagtggaggaggagtagtacaaccaggaagaagtttaagattaagttgtgtagcaagtcaatttagttttgatagatatggaatgcattgggtaagacaagcaccaggaaaaggattagaatgggtagcaagtatatcatttgatggaacagataaatatcatgcagataaagtatggggaagatttacaataagcagagataatagcaaaaatacattatatttacaaatgaatagtttaagaccagaagatacggcattatattattgtgcaaaagatatgagagaagatgaatgtgaagcatggtggagtgattattatgatttaggaaaacaattaccatgtagagaaagtagaggagtagcaggaatatttgatgaatggggacaaggaacaatggtaacagtaagtagc

SEQ ID NO: 47698 - RNA, 432 nt, synthetic construct
  misc_feature 1..432: note = derived and/or modified sequence opt6 from anti-HIV_cap256-119-106327_VR-Chain
  source 1..432: mol_type = other RNA
caagtacaattagtagaaagtggaggaggagtagtacaaccaggaagaagtttaagattaagttgtgcagcaagcggatttacatttagtagttatgcaatgcattgggtaagacaagcaccaggaaaaggactagaatgggtagcagcaataagcggaggaggaggaaatacatatgtagcagatagcgtaaaaggaagatttacaataagtagagacaatagtaaaaatacagtatacctacaaatgaatagtttaagattagaagatacagcgttatactattgtgcaaaagatttaagagaatatgaatgtgaagaatggacaagtgattattatgattttggaagaccacaaccatgtatagatagtagaggagtagtaggaatattagatatatggggacaaggaacaatggtaacagtaagtagt

SEQ ID NO: 47699 - RNA, 438 nt, synthetic construct
  misc_feature 1..438: note = derived and/or modified sequence opt6 from anti-HIV_cap256-119-105486_VR-Chain
  source 1..438: mol_type = other RNA
caagtacaattagtagaaagtggaggaggagtagtacaaccaggaggaagtttaagattaagttgtgcagcaagtggatttacagtaagtggatatggaatgcattgggtaagacaagcaccagcaaaaggattagattgggtagcatttataagtcatgatggaagtaataaatattatgcagatagtgtaagaggaagatttataataagtagagataatagtaataatacattatatgtacaaatgagtagtttaagagcagaagatacagcattatatttttgtgtaagggatcatagagaagatgaatgtgaagaatggtggagtgattattatgattttggaagagaattaccatgtagaaaatttagaggattaggattagcaggaatatttgatatatggggacatggaacaatggtaacagtaagtagt

SEQ ID NO: 47700 - RNA, 432 nt, synthetic construct
  misc_feature 1..432: note = derived and/or modified sequence opt6 from anti-HIV_cap256-119-105197_VR-Chain
  source 1..432: mol_type = other RNA
caagtacaattagtagaaagcggaggaggagtagtacaaccaggaaggagcttaagattaagctgtgcagtaagccaattcacattcggaagatatggaatgcactgggtaagacaagcaccagggaaaggactagaatgggtaggaagtatatcatacgatggatcagacaaataccatacaaatagcttatggggaagatttatagtaagcagagacaatagtaaaaacacattatatctacaaatgaataacttaagaccagaagatacagcattatattactgtgtaagagacagaagagaaagtgaatgcgaagaaagatggtcagactattacgatttcggaaaacaactaccatgcgtaaaaccaagaggagtagtaggagtactagatatatggggacagggaacattagtaacagtaagctca

SEQ ID NO: 47701 - RNA, 432 nt, synthetic construct
  misc_feature 1..432: note = derived and/or modified sequence opt6 from anti-HIV_cap256-119-104946_VR-Chain
  source 1..432: mol_type = other RNA
caagaacaattagtagaaagcggaggaggagtagtgcaaccaggaagaagtttaagattaagttgtgtagcaagtagatttacatttagtgcatttggaatgcattgggtaaggcaagcaccaggaaaaggattagaatgggtagcaagtataagttttgcaggaataaaaaaatattatggagatagtgtaaaagggagatttacaataagtagagataatagtaaaaatacattatatttacaaatggatggattaagaggagaagatacagcattatattattgtgcaaaagatttaagagaattagaatgtgaagaatgggcaagtgattattatgattttggaagaccacaaccatgtatagatagtagaggagtagtaggaatattagatatatggggacaaggaataatggtaacagtaagtagt

SEQ ID NO: 47702 - RNA, 432 nt, synthetic construct
  misc_feature 1..432: note = derived and/or modified sequence opt6 from anti-HIV_cap256-119-103667_VR-Chain
  source 1..432: mol_type = other RNA
caagtacatttagtagaaagtggaggtggagtagtacaaccaggaaaaagtttaagattaagctgtgcagcaagtcaatttacatttaatagatttggaatgcactgggtaagacaagcgccaggaaaaggactagaatgggtagcaggaatatcatatgatggatcagataaatatcatgcagataaagtatggggaagatttacaataagcagagacaatagtaaaaatacactatatttacaaatgaatagtttaagagcagaagatacagcactatattactgtgcaaaagacctaagagaagatgaatgtgaagaatgggcatcagactattatgatttcggaaaagaacaaccatgtttagacccaagaggagtagtaggaatatttgatatatggggacaaggaacaatggtaacagtaagttca

SEQ ID NO: 47703 - RNA, 438 nt, synthetic construct
  misc_feature 1..438: note = derived and/or modified sequence opt6 from anti-HIV_cap256-119-103385_VR-Chain
  source 1..438: mol_type = other RNA
gaagtacaattagtagaaagtggaggaggattagtacaaacaggaggaagtttaagattaagctgtgcagcaagtggatttacatttagtagatatgatatgaattgggtaagacaagcaccaggaaaaggattagaatgggtagcaagtataagtaatgatggaagtaaaaagtatcatggagatagcgtatgggcaagatttacaataagtagagataatagtaaaaatacattatttttacaaatgagtagtttaagagtagaagatacagcactatatttttgtgtaagagatcaaagagaagatgaatgtgaagaatggtggagtgattattatgattttggaagagaattaccatgtagaaaatttagaggattaggattagcaggaatatttgatatatggggacatgggacaatggtaacagtaagtagt

SEQ ID NO: 47704 - RNA, 438 nt, synthetic construct
  misc_feature 1..438: note = derived and/or modified sequence opt6 from anti-HIV_cap256-119-103267_VR-Chain
  source 1..438: mol_type = other RNA
gaagtaccatcagtagaaagcggaggaggattagtgcaaacaggaggaagtttaacattaagttgtgcagcaagtcaattcacattctcaaattatggaatgcactgggtaagacaagcaccaggaaaaggactagaatgggtagcatcaatatcaaacgatggatcaaaaaaataccatggagatagtgtatgggcaagatttataataagcagagacaatagtaaaaacacactatttctacaaatgtcaagcttaagagcagaagatacagcactatatttttgtgtaagagaccatagagaagacgaatgcgaagaatggtggtcagactattacgatttcggaagagaactaccatgcagaaaatttagaggactaggactagcaggaatattcgatatatggggacatggaacaatggtaacagtaagctca

SEQ ID NO: 47705 - RNA, 432 nt, synthetic construct
  misc_feature 1..432: note = derived and/or modified sequence opt6 from anti-HIV_cap256-119-103011_VR-Chain
  source 1..432: mol_type = other RNA
caagtacaattagtagaaagtggaggaggagtagtacaaccaggaggaagtttaagattaagttgtgcaacaagcggatttacatttggaacatttggaatgcattgggtaagacaagcaccaggaaaaggattagattgggtagcagcaataagttttgcaggaacaaaaaaaaattatgcagatagtgtaagaggaagatttacaataagtagagatagtagtaaaaatacattatatttacaaatgaatagtttaagaccagaagatacagcactatattattgtgtaaaagatatgagaggatatgaatgtgaagaatggacatcagattattatgattttggaagaccacaaccatgtatagatagtagaggagtagtaggaacatttgatgtatggggacaaggaacaatggtaacagtaagtagt

SEQ ID NO: 47706 - RNA, 438 nt, synthetic construct
  misc_feature 1..438: note = derived and/or modified sequence opt6 from anti-HIV_cap256-119-102072_VR-Chain
  source 1..438: mol_type = other RNA
gaagtacaattagtagaaagtggaggaggattagtacaaccgggaggaagtttaagagtaagctgtgcagtaagcggatttacatttagtaattatgaaatgaactgggtaagacaagcgccaggaaaaggactagaatgggtagcaagtataagtaatgatggaacaaaaaaatatcatgcagaaagtgtatgggatagatttagtataagtaaagacaatagtaaaaatacattatttttacaaatgaatagtttaagagtagaagatacagcattatatttctgtgtaaaagatcaaagagaagatgaatgtgaagaatggtggagtgactattatgatttcggaagagaattaccatgtaggaaatcaagaggactaggactagcaggaatatttgatatatggggacatggaacaatggtaacagtaagtagt

SEQ ID NO: 47707 - RNA, 438 nt, synthetic construct
  misc_feature 1..438: note = derived and/or modified sequence opt6 from anti-HIV_cap256-119-101945_VR-Chain
  source 1..438: mol_type = other RNA
gaagtacaattagtagaaagcggaggaggattagtacaaccaggaggaagtttaagattaagctgtgcagcaagtggattcacattttcaagttatgtaatgcactgggtaagacaagcaccaggaaaaggactagaatgggtagcatcaatatcaaacgatggaacaaaaaaataccatgaagaaagcgtatggggaagatttacaataagtaaagacaatagtaaaaacacactatttctacagatgaatagtttaagaatagaagatacagcattatatttctgtgtaaaagaccaaagagaagacgaatgtgaagaatggtggtcagactattacgatttcggaagagaactaccatgcagaaaatcaagaggactaggattagcgggcatattcgatatgtggggacatggaacgatggtaacagtaagttca

SEQ ID NO: 47708 - RNA, 432 nt, synthetic construct
  misc_feature 1..432: note = derived and/or modified sequence opt6 from anti-HIV_cap256-119-101319_VR-Chain
  source 1..432: mol_type = other RNA
caagtacaattagtagaaagtggaggaggagtagtacaaccaggaaaaagtttaagattaagttgtgtaggaagcggatttacatttgatgattatggaatgcattgggtaagacaagcaccagggaaaggattagaatgggtagcaagtataagttatgatggaagagatttttatcatgcaagaagtgtatggggaagatttacaataagcagagataatagcaaaaatacactacatttacaaatgaatagtttaagaccagaagatacagcattatatttttgtgcaagggatttgagagaaagtgaatgtgaagaatgggaaagttattattatgattttggaaaaaaaggaccatgtgtaaaaccaagaggagtagtaggagtattagatatatggggacaaggaacattagtaacagtaagtagt

SEQ ID NO: 47709 - RNA, 432 nt, synthetic construct
  misc_feature 1..432: note = derived and/or modified sequence opt6 from anti-HIV_cap256-119-100871_VR-Chain
  source 1..432: mol_type = other RNA
caagtacaattagtagaaagtggaggaggagtagtacaaccaggagaaagtttaagaataagttgtgcagcaagtcaatttacattttcaagatatggaatgcattgggttagacaagcaccaggaaaaggacttgaatgggtagcatcaatatcatttgatggaagagataaatatcatagttcattagtatggggaagattaacaataagtagagataatagtaaaagcacattatttttacaaatgaatagtttaagagcagaagatacagcattatattattgtgcaagagatttaagagaaagtgaatgtgaagaatgggaatcagattattatgattttggaaaaccacaaccatgtgaagatccaagaggagtagtaggaacatttgatatgtggggattaggaacgttagtaacagtaagttca

SEQ ID NO: 47710 - RNA, 432 nt, synthetic construct
  misc_feature 1..432: note = derived and/or modified sequence opt6 from anti-HIV_cap256-119-100838_VR-Chain
  source 1..432: mol_type = other RNA
gaagtacaattagtagaaagcggaggaggagtagtacaaccaggaggatcattaagattaagctgtgcagcaagcggattcacattcagcagctatggaatgcactgggtaagacaagcaccaggaaaaggactagaatgggtagcatttataagatacgatggatcaaacaaatactatgcagatagcgtaaaaggaagatttacaataagtagggataatagcaatcacacactatatatgcaactagatagtttaagagcagaagatacagcactatattactgtgcaaaagacttaagagaatacgaatgcgaagaatggacatcagactattacgatttcggaagaccacaaccatgcatagactcaagaggagtagtaggaatattagatatatggagccaaggaacaatggtaacagtaagttca

SEQ ID NO: 47711 - RNA, 438 nt, synthetic construct
  misc_feature 1..438: note = derived and/or modified sequence opt6 from anti-HIV_cap256-119-100025_VR-Chain
  source 1..438: mol_type = other RNA
caagtacaattagtagaaagcggaggaggagtagtgcaaccaggaagaagtttaagattaagctgtgcagcaagtgtattcacattctcatattatggaatgcactgggtaagacaagcaccaggaaaaggactagaatgggtggcatttatatcacacgatggatcaaacaaatactatgcagatagcgtaagaggaagatttataataagcagagacaatagcaataacacactatatgtacaaatgaatagtttaagagcagaagatacagcactatatttctgtgtaaaagaccaaagagaagacgaatgcgaagaatggtggtcagactattacgatttcggaagagaactaccatgcagaaaatttagaggattaggactagcaggaacattcgatatatggggacatggaacgatgttgatagtaagctca

SEQ ID NO: 47712 - RNA, 432 nt, synthetic construct
  misc_feature 1..432: note = derived and/or modified sequence opt6 from anti-HIV_cap256-119-100000_VR-Chain
  source 1..432: mol_type = other RNA
caaatgcaattagtagaaagcggaggaggagtagtacaaccaggaagatcattaacattaagttgtgcagcaagtcaattcacattctcaaattatggaatgcactgggtaagacaagcaccaggaaaaggattagaatgggtagcatcaatatcaaacgatggaaataaaaaataccatggagatagcgtatgggcaagatttacaataagcagagacaatagcaaaaacacactatttctacaaatgtcaagtttaagaacagaagatacagcactatatttctgtgtaagagacagaagagaaagcgaatgcgaagaaagatggtcagactattacgatttcggaaaacaactaccatgcgtaaaaccaagaggagtagcgggaatattcgatatatggggacaaggaacaatggtaacagtaagttca

SEQ ID NO: 47713 - RNA, 432 nt, synthetic construct
  misc_feature 1..432: note = derived and/or modified sequence opt6 from anti-HIV_cap256-119-098890_VR-Chain
  source 1..432: mol_type = other RNA
caagtacaattagtagaaagcggaggaggagtagtacaaccaggagaaagtttgagaataagctgtgtagcaagtcaattcacattcggaagatatggaatgcactgggtaaggcaagcaccaggaaaaggactagaatgggtagcatcaatatcatttgatggaagagacaaatatcatagcccattagtatggggaagattaacaataagcagagacaatagtaaaaatacattatttctacaaatgaatagcttaagaacagaagatacagcattatattactgtgcaagagacttaagagaaagtgaatgtgaagaatgggaatcagactattacgcattctggagaaaattaccatgtgtaaaaccaagaggagtagcaggaacactagatatatggggacaaggaacaatggtaagtgtaagtagt

SEQ ID NO: 47714 - RNA, 435 nt, synthetic construct
  misc_feature 1..435: note = derived and/or modified sequence opt6 from anti-HIV_cap256-119-098715_VR-Chain
  source 1..435: mol_type = other RNA
caagtacaattagtagaaagtggaggaggagtagtacaaccaggaagaagtttaagattaagttgtgcagcaagtggatttagttttaataatcatggaatgcattgggtaagacaagcaccaggaaaaggattagaatgggtagcagggataagttttgcaggaataaaaaaatattatggaacaagtgtaaaaggaagatttacaataagtagagataatagtaaaaataatttatttctacaaatgaatagtttaagagtagaagatacagcattatattattgtgcaagagatttaagagaaatggaatgtgaagaatggacattatataattattatgattttggaagtagaggaccatgtgtagatccaagaggagtagtaggaagttttgatgtatggggacaaggaacaatggtaacagtaagcagt

SEQ ID NO: 47715 - RNA, 438 nt, synthetic construct
  misc_feature 1..438: note = derived and/or modified sequence opt6 from anti-HIV_cap256-119-098632_VR-Chain
  source 1..438: mol_type = other RNA
caaatgcaattagtagaaagcggaggaggagtagtacaaccaggaagaagtttaacattaagctgtgcagcaagccaattcaatttcgcaaactatgacatgcactgggtaagacaagcaccaggaaaaggactagaatgggtagcatttataagatacgatggaaataataaatactatgcagatagcgtaaaaggaagatttacaataagcagagacaatagcaaaagcacactatttctacaaatgaatagcttaagaatagaagatacagcactatatttctgtgtaaaagaccaaagagaagacgaatgcgaagaatggtggtcagactattacgatttcggaagagaactaccatgcagaaaatcaagaggactaggactagcaggaatattcgatatgtggggacatggaacaatggtaacagtaagctca

SEQ ID NO: 47716 - RNA, 432 nt, synthetic construct
  misc_feature 1..432: note = derived and/or modified sequence opt6 from anti-HIV_cap256-119-097199_VR-Chain
  source 1..432: mol_type = other RNA
caagtacaattagtagaaagtggaggaggagtagtacaaccaggaagaagtttaagattaagttgtgcagcaagtggatttgcatttagtagttatgcatttcattgggtaagacaagcaccaggaaaaggattagaatgggtagcatatataccatttcatggaaatcaacaatattatggagatagcgtaaaaggaagatttacaataagtagagataatagtagagatacattatttttagaaatgaatagtttaagaccagaagatacagcattatatttttgtgcaagagatcaaagatattatgaatgtgaagaatgggcaagtgattattatgattttggaagagaacaaccatgtttagatccaagaggagtagtaggaatatttgatttatggggacaaggaacaatggtaacagtaagtagt

SEQ ID NO: 47717 - RNA, 432 nt, synthetic construct
  misc_feature 1..432: note = derived and/or modified sequence opt6 from anti-HIV_cap256-119-096189_VR-Chain
  source 1..432: mol_type = other RNA
caagtacaattagtagaaagtggaggaggagtagtacaaccaggaagaagtttaagattaagttgtgcagcaagtggatttaaatttggaagttttggaatgcattgggtaaggcaagcaccaggaaaaggattagaatgggtagcagtaataagttatgatggaagtgataaatattatggatcaagtgtaagaggaagatttagtataagtagagataatagtaaaaatacattatatttacaaatgaatagtttaagaacagaagatacagcattatatttttgtgcaaaagatttaagagaatatgaatgtgaagaatggacaagtgattattatgattttggaagaccacaaccatgtatagatagtagaggagtagtaggaatactagatatatggggacaaggaacaatggtaacagtaagtagt

SEQ ID NO: 47718 - RNA, 432 nt, synthetic construct
  misc_feature 1..432: note = derived and/or modified sequence opt6 from anti-HIV_cap256-119-094581_VR-Chain
  source 1..432: mol_type = other RNA
caagtacatttagtagaaagtggaggaggagtagtacaaccaggaagaagtctaagattaagttgtgcagcaagtggatttaatttcagtaattatgcaatacattgggtaagacaaacaccaggaaaaggattagaatgggtaacattaataagtaatgatggaagtaataaatattatgcagatagtttaaaaggaagatttacaataagtagagataatagtaaaaatacattatatttacaaatgaatagtttaagagcagaagatacagcattatattattgtgcaaaagatttaagagaagatgaatgtgaagaatggtggagtgattattatgattttggaaaacaattaccatgtagaaaaagtagaggagtagcaggaatatttgatggatggggacaaggaacaatggtaacagtaagtagt

SEQ ID NO: 47719 - RNA, 432 nt, synthetic construct
  misc_feature 1..432: note = derived and/or modified sequence opt6 from anti-HIV_cap256-119-094200_VR-Chain
  source 1..432: mol_type = other RNA
gaagtgcaattggtagaaagcggaggaggactagtacaaccaggaggaagtttaagattaagctgtgcagcaagtggattcatattctcaagctatgcattacactgggtaagacaagcgccaggaaaaggactagaatgggtagcatcaatatcattcgcaggaacaaaaaatcactatggaaatagcgtaaaaggaagatttacaataagcagagacaatagcaaaaacacagtatatctacaaatgaatagcttaagagcagaagatacagcactatattactgtgcaaaagacttaagagaatacgaatgcgaagaatggacatcagactattacgatttcggaagaccacaaccatgcatagactcgagaggagtagtaggaatactagatatatggagccaaggaacaatggtaacagtaagctca

SEQ ID NO: 47720 - RNA, 432 nt, synthetic construct
  misc_feature 1..432: note = derived and/or modified sequence opt6 from anti-HIV_cap256-119-094158_VR-Chain
  source 1..432: mol_type = other RNA
caaatgcaattagtagaaagcggaggaggagtagtacaaccaggatcaagcttaacattatcatgtgcagcaagtcaattcacattctcaaactatggaatgcactgggtaagacaagcaccaggaaaaggactagaatgggtagcatcaatatcaaatgatggaacaaaaaaataccatggagatagcgtatgggatagatttacaataagtagagacaatagtaaaaacacactatttctacaaatgaatagcttaagagcagaagatacagcattatatttctgtgtaaaagaccaaagagaagacgaatgcgaagaatggtggtcagactattacgatttcggaaaacaattaccatgcagaaaatcaagaggagtagcaggaatattcgatagctggggacaaggaacgatggtaacagtaagctca

SEQ ID NO: 47721 - RNA, 432 nt, synthetic construct
  misc_feature 1..432: note = derived and/or modified sequence opt6 from anti-HIV_cap256-119-092814_VR-Chain
  source 1..432: mol_type = other RNA
caagtacaattagtagaatttggaggaggagtagtacaaccaggaggaagtttaagattaagttgtgcagcaagtggattctattttacagattatggaatgcactgggtaagacaagcaccaggagaaggattacaatgggtagcattcataagctatgatggaaatacaaaaacaacagcagatagtgtaagaggaagatttacattaagcagagacaatagtaaaaatacactatatttacaaatgaatagcgtaagagtagaagatacagcaagatatttctgtgcaagagacatgagagaatatgaatgtgaattatgggcatcagattattatgatttcggaaaaccacaaccatgtgaagacccaagaggagtagtaggaacatttgatatgtggggattaggaacattagtaacagtaagttca

SEQ ID NO: 47722 - RNA, 432 nt, synthetic construct
  misc_feature 1..432: note = derived and/or modified sequence opt6 from anti-HIV_cap256-119-092808_VR-Chain
  source 1..432: mol_type = other RNA
caagtacaattggtagaaagcggaggaggagtagtacaaccaggaagaagtttaagattaagctgtgcagcaagccaattctcattcggaaattatggaatgcactgggtaagacaagcaccaggaaaaggactagaatgggtagcagcaatatcattcgcaggaacaaaaacaaactatgcagatagtgtaaaaggaagatttacaataagcagagacaatagcaaaaacacagtatatctacaaatgaatagtttaagagcagaagatacagcattatatttctgtgcaaaagacataagagaatacgaatgcgaatactggacatcagactattacgatttcggaagaccacaaccatgcatagactcaagaggagtagtaggaacattcgatgtctggggacaaggaacaatggtaacagtaagctca

SEQ ID NO: 47723 - RNA, 432 nt, synthetic construct
  misc_feature 1..432: note = derived and/or modified sequence opt6 from anti-HIV_cap256-119-092573_VR-Chain
  source 1..432: mol_type = other RNA
caagaacaattagtagaaagtggaggaggagtagtacaaccaggaacaagtttaagattaagttgtagtgcaagcggattcacattctcaaattttgcaatgaactgggtaagacaagcaccaggaaaaggattagaatgggtaagctttatatcaagtgatggaaaaaataaaaactatgtagatagtgtaaaaggaagatttacaataagcagagacaattacaaaaacacgctatatttacaaatgaatagcttaagaacagaagatacagcagtatattactgtgcaaaagacttaggaggaacaaaagacgatgaatgggcaacagattattacgattggtcaacagcatacccagtacaagacccaagagcagtagcaggaggattcgatctatggggattaggaacaatggtaacagtaagttca

SEQ ID NO: 47724 - RNA, 432 nt, synthetic construct
  misc_feature 1..432: note = derived and/or modified sequence opt6 from anti-HIV_cap256-119-090815_VR-Chain
  source 1..432: mol_type = other RNA
caagtacaattagtagaaagtggaggaggagtagtagaaccaggaagaagtttaagattaagttgtgcagcaagtcaatttagttttagtagttatggaatgcattgggtaagacaagcaccaggaaaaggattagaatgggtagcagcaataagttttgatggagcagataaatatcatgcagataatgtatggggaagattgagtataagtagagataatagcaaaagtacactgtatctacaaatgaatagtttaagaccagaagatacagcagtatatttttgtgcaaaagatttaagagaagatgaatgtgaagaaagatggagtgattattacgattttggaaaacaattaccatgtagaaaatcaagaggagtagcaggaatatttgataattggggacaaggaacaatggtaacagtaagtgca

SEQ ID NO: 47725 - RNA, 438 nt, synthetic construct
  misc_feature 1..438: note = derived and/or modified sequence opt6 from anti-HIV_cap256-119-090368_VR-Chain
  source 1..438: mol_type = other RNA
caagtacaattagtagaaagcggaggaggagtagtacaaccaggaagatcgttaagattaagctgtgcagcaagcggattcgcattcagccactatggaatattctgggtaagacaagcaccaggaaaaggactagaatgggtagcatcaatatcaaacgatggaacaaagaaataccatgcagaaagcgtatgggatagatttagcataagcaaagacaatagcaaaaacacactatttctacaaatgaatagtttaagagtggaagatacagcactatatttctgtgtaaaagaccaaagagaagacgagtgcgaagaatggtggtcagactattacgatttcggaagagaactaccatgcagaaaatcaagaggactaggactagcaggaatattcgatatgtggggacatggaacaatggtaacagtaagctca

SEQ ID NO: 47726 - RNA, 432 nt, synthetic construct
  misc_feature 1..432: note = derived and/or modified sequence opt6 from anti-HIV_cap256-119-089710_VR-Chain
  source 1..432: mol_type = other RNA
caagtacaattagtagaaagtggaggaggagtagtacaaccaggaagaagtttaagattaagttgtacagcaagtggatttggatttagtaattatgcaatgcattgggtaagattagcgccaggaaaaggattagaatgggtagcatcaataagttatgatggaagagattatcatcatgcaggagcagtatggggaagatttataataagtagagataatagtaaaaatagtttacatttacaaatgaatagtttaagaccagaagatacagcattatatttttgtgcaagagatttgagagaaagtgaatgtgaagaatgggaaagcgattattataatttttggaaaaaattaccatgtgtaaaaccaagaggagtagtaggaatattagatatatggggacaaggaacagtagtaacagtaagtagt

SEQ ID NO: 47727 - RNA, 432 nt, synthetic construct
  misc_feature 1..432: note = derived and/or modified sequence opt6 from anti-HIV_cap256-119-088555_VR-Chain
  source 1..432: mol_type = other RNA
caagtacaattagtagaaagcggaggaggagtagtacaagcaggaagaagtctaagattaagttgtgcagcaagtcaatttacatttagtagatatggaatgcattgggtaagacaagcaccaggaaaaggactagaatgggtagcaggaataagttatgatggaagagataaatatcatgcacattttgtatggggaagatttataataagtagagataatagtaaaaatacattatatttacaaatgaatagtctaagagcagaagatacagcattatattattgtgtaagagatttaagagaaagtgaatgtgaattatgggaatcagattattatgattttggaaaaagattaccatgtgtaaaaccaagaggagtagcaggaacatttgatctatggggacaaggaacaatggtaacagtaagttca

SEQ ID NO: 47728 - RNA, 432 nt, synthetic construct
  misc_feature 1..432: note = derived and/or modified sequence opt6 from anti-HIV_cap256-119-087962_VR-Chain
  source 1..432: mol_type = other RNA
gaaatgcaattagtagaaagtggaggaggattagtaaaaccaggaagaagtttaagattaagttgtgcagcaagtggatttacatttagtagttatgcaatacattgggtaagacaagcaccaggaaaaggattagaatgggtagcagtaataagttatgatggaagtaataaatattatgcagatagtgtaaaaggaagatttacaataagtagagataatagtaaaaatacagtatatttacaaatgaatagtttaagagtagaagatacagcattatattattgtgcaaaagatttaagagaatatgaatgtgaagaatggacaagtgattattatgattttggaaaaccacaaccatgtatagatagtagaggagtagtaggaatattagatatatggggacaaggaataatggtaacagtaagtagt

SEQ ID NO: 47729 - RNA, 432 nt, synthetic construct
  misc_feature 1..432: note = derived and/or modified sequence opt6 from anti-HIV_cap256-119-086903_VR-Chain
  source 1..432: mol_type = other RNA
caagtacatttagtagaaagtggaggaggagtagtacaaccaggaaaaagtttaagattaagctgtgcagcaagtcaatttacatttgatagatatggaatgcattgggtaagacaagcaccaggaaaaggattagaatgggtagcaagtataagtaatgatggaacagataaatatcatgcagataatgtatggggaagatttacaataagtagagataatagtaaaaatacattatatttagaaatgaatagtttaagaggagaagatacagcattatattattgtgcaaaagatatgagagaagatgaatgtgaagaatggtggagtgattattatgattttggaagaccacaaccatgtatagatagtagaggagtagtaggaacatttcatgtatggggacaaggaacaatggtaacagtaagtagt

SEQ ID NO: 47730 - RNA, 432 nt, synthetic construct
  misc_feature 1..432: note = derived and/or modified sequence opt6 from anti-HIV_cap256-119-086804_VR-Chain
  source 1..432: mol_type = other RNA
gaagtacaattagtagaaagtggaggaggagtagtgcaaccaggaagaagtctaagattattttgtgcagggagtggatttacatttagtagttatggattacattgggtaagacaagcaccaggaaaaggattagaatgggtaagttttataagttatgatggaagtacaacaaaatatgcagatagcttaaaaggaaggtttacagtaagtagagataatagtaaaaatacagtatatttagaaatgaatagtttaagagcagaagatacagcgttatattattgtgcaaaagatttaagagaatatgaatgtgaagaatggacaagtgattattatgattttggaagaccacaaccatgtatagatagtagaggagtagtaggaatattagatatatggggacaaggaacaatggtaacagtaagtagt

SEQ ID NO: 47731 - RNA, 432 nt, synthetic construct
  misc_feature 1..432: note = derived and/or modified sequence opt6 from anti-HIV_cap256-119-085910_VR-Chain
  source 1..432: mol_type = other RNA
gaagtacaattattagaaagtggaggaggattagtacaaccaggaggaagtttaagattaagttgtgcagcaagcggatttacatttagtagttatggaatgcattgggtaagacaagcagcaggaaaaggattagaatgggtagcaagtataagttatgatggaagagattatcatcatgcaggagcagtatggggaagatttataataagtagagataatagtaaaaatagtttacatttacaaatgaatagtttaagaccagaagatacagcattatatttttgtgcaagagatttaagagaaagtgaatgtgaagaatgggaaagtgattattataatttttggaaaaaattaccatgtgtaaaaccaagaggagtagtaggaatattagatatatggggacaaggaacagtagtaacagtaagcagc

SEQ ID NO: 47732 - RNA, 432 nt, synthetic construct
  misc_feature 1..432: note = derived and/or modified sequence opt6 from anti-HIV_cap256-119-085772_VR-Chain
  source 1..432: mol_type = other RNA
gaagtaagattagtagaaagcggaggaggattaatacaaccaggaggaagtttaagattaagctgtgcagcgagtggactaacagtatcaagtaatcacatgagctgggtaagacaagcaccaggaaaaggactagaatgggtagcagtaatatcatatgatggatcaaatacgttttatggagatagtgtaaaaggaagatttacagtaagcagggacataagtaaaaatacactatatttacaaatgaatagtttaagaccagaagatacagcgatgtattactgtgcaagagatcaaagatattatgaatgtgaagaatgggcatcagactattacgatttcggaagagaacaaccatgtcaagacccaagaggagtagtaggagtatttgatatgtggggacaaggaacaatggtaacagtaagttca

SEQ ID NO: 47733 - RNA, 432 nt, synthetic construct
  misc_feature 1..432: note = derived and/or modified sequence opt6 from anti-HIV_cap256-119-084603_VR-Chain
  source 1..432: mol_type = other RNA
caagtacaattagtagaaagtggaggaggagttgtacaaagtggaaggagtttaagattaagttgtgcagcaagtggatttccatttagtgattttgcaatgcattgggtaagacaagcaccaggaaaaggattagaatgggtagcaagtataagttttgtaggaataaaaacacattatgcaaatagtgtaagaggaagatttacaataagtagagatcaaagtaaaaatacattatatttacaaatgaatagtgtaagagtagaagatacaggaagatattattgtgcaagagatatgagagaatatgaatgtgaattatgggcaagtgattattatgattttggaaaaccacaaccatgtgaagatccaagaggagtagtaggaacatttgatatgtggggattaggaacattagtaacagtaagttca

SEQ ID NO: 47734 - RNA, 432 nt, synthetic construct
  misc_feature 1..432: note = derived and/or modified sequence opt6 from anti-HIV_cap256-119-084276_VR-Chain
  source 1..432: mol_type = other RNA
caagtacaattagtagaaagtggaggaggagtagtacaaccaggaagaagtttaagattaagctgtgcagcaagtagatttacattttcaagttatgcaatgcactgggtaaggcaagcaccaggaaaaggattagaatgggtagcagtaatatggtatgatggatcaaataaatattatgcagatagtgtaagaggaagatttagtgtaagtacagacataagtaaaaatacattatatttacaaatgaatagtctaagaccagcagatacagcattatatttttgtgcaagagatttaagatattatgaatgtgaagaatgggcatcagactattatgatttcggaaaagaacaaccatgtttagatccaagaggagtagtaggaatatttgatttatggggacaaggaacaatggtaacagtaagttca

SEQ ID NO: 47735 - RNA, 432 nt, synthetic construct
  misc_feature 1..432: note = derived and/or modified sequence opt6 from anti-HIV_cap256-119-082288_VR-Chain
  source 1..432: mol_type = other RNA
caagtatacttagtagaaagcggaggaggagtagtacaaccaggaagatcattaagactaagcagcgcagcaagtcatttctcactatcaagttatggaatgcactgggtaagacaagcaccaggaaaaggactagaatgggtagcaggaatatcatttgcaggaacaaaaacatactatggagatagcgtaaaaggaagatttacagtaagtacagacataagtaaaaacacattatatctacaagtaaatagcttaagaccagaagatacagcaatgtattactgtgcaagagatcaaagatattatgaatgcgaagaatgggcatcagactattacgatttcggaaaagaacaaccatgcttagacccaagaggagtagtaggaatattcgatatatggggacaaggaacaatggtaacagtaagttca

SEQ ID NO: 47736 - RNA, 432 nt, synthetic construct
  misc_feature 1..432: note = derived and/or modified sequence opt6 from anti-HIV_cap256-119-080383_VR-Chain
  source 1..432: mol_type = other RNA
caagtacaattagtagaaagcggaggaggagtagtacaaccaggaagaagcttaagaataagctgtgcagcaagccaattcacattctcaagatatggaatgcactgggtaagacaagcaccaggaaaaggactagaatgggtagcatcaatatcatacgatggaacagacaaataccatgcaagattagtatggggaagatttacaataagcagagacaatagtaaaaacacactatatctacaaatgaatagcctaagagcagaagatacagcactatattactgtgtaagagacgaaagagaaagtgaatgcgaattatgggaatcagactattacgatttcggaaaaaaactaccatgcgtaaaaccaagaggagtaacaggatcactagatatgtggggacaaggaacacaagtaacagtaagctca

SEQ ID NO: 47737 - RNA, 438 nt, synthetic construct
  misc_feature 1..438: note = derived and/or modified sequence opt6 from anti-HIV_cap256-119-079333_VR-Chain
  source 1..438: mol_type = other RNA
gaagtacaattagtagaaagcggaggaagactagtacaaccaggatcaccattaagattaagttgtgcagcaagtcaattcaatttcgcaagttatggaatgcactgggttagacaagcaccaggaaaaggactagaatgggtagcatcaatatcaaacgatggaacaaaaaaataccatgcagaaagcgtatgggatagatttagcataagcaaagacaatagcaaaaacacactatttctacaaatgaatagtttaagagtagaagatacagcattatatttctgtgtaaaagaccaaagagaagacgaatgcgaagaatggtggtcagactattacgatttcggaagagaactaccatgcagaaaatcaagaggactaggactagcaggaatattcgatatgtggggacatggaacaatggtaacagtaagcagt

SEQ ID NO: 47738 - RNA, 441 nt, synthetic construct
  misc_feature 1..441: note = derived and/or modified sequence opt6 from anti-HIV_cap256-119-078618_VR-Chain
  source 1..441: mol_type = other RNA
caaatgcaattagtagaaagcggaggaggagtagtacaaccaggaagaagtttaacattaagctgtgcagcaagccaattcaatttcgcaagctatggaatgcactgggtaagacaagcaccaggaaaaggactagaatgggtagcatcaatatcaaacgatggaacaaaaaaatatcatgccgaaagtgtatgggatagatttagcataagtaaagacaatagtaaaaacacactatttctacaaatgaatagcttaagagtagaagatacaacactatatttctgtgtaaaagaccaaagagaagacgaatgcgaagaatggtggtcagactattacgatttcggaagagaactaccatgcagaaaatcaagaggactaggattagcaggaaatttctgtatatgtggagcagacggaacaatggtaacagtatcaagt

SEQ ID NO: 47739 - RNA, 432 nt, synthetic construct
  misc_feature 1..432: note = derived and/or modified sequence opt6 from anti-HIV_cap256-119-077466_VR-Chain
  source 1..432: mol_type = other RNA
caagtacaattagtagaaagcgggggaggagtagtacaaccaggatcaccactaagaataagctgtgcagtaagccaattcacattctcaagatatggaatgcactgggtaagacaagcaccaggaaaaggactagaatgggtagcatcaatatcattcgatggaagagacaaataccatagcagcctagtatgggggagattaacaatatcaagagacaatagcaaaagtacattatttctacaaatgaatagcttaagagcagaagatacagcactatattactgtgcaagagacttaagagaaagtgaatgcgaagaatgggaatcagactattacgcattctatagaaaattaccatgcgtaaaaccaagaggagtagcaggaacattagatatatggggacaaggaacaatggtaacagtaagttca

SEQ ID NO: 47740 - RNA, 423 nt, synthetic construct
  misc_feature 1..423: note = derived and/or modified sequence opt6 from anti-HIV_cap256-119-076284_VR-Chain
  source 1..423: mol_type = other RNA
caagtacaattagtagaatcaggaggaggagtagtacaaccaggaagatcactaagactatcatgcgcagcatcaaacacatacgcaatgcattgggtaagacaagcaccaggaaaaggactagaatggatggcactaataagctatgaaggaagcgataaatattacgtagactcagtaaaaggaagattcacaatatcaagagataactcaaaatcaacattatacttacaaatgaactcactatcagcagaagacacagcagtatacttttgcgcaaaagatctaggaggaaataaagatgacgaatggacaacagattactattacgattggtcaaaagcaagaccagtacaagacccaagagtagtagcaggaacattcgatatatggggacaaggaacaatggtaacagtaagctca

SEQ ID NO: 47741 - RNA, 432 nt, synthetic construct
  misc_feature 1..432: note = derived and/or modified sequence opt6 from anti-HIV_cap256-119-074680_VR-Chain
  source 1..432: mol_type = other RNA
gaagtacaattagtagaaagtggaggaggattagtacaaccaggaagaagtctaagattaagttgtgcaggaagtggatttacatttgtagattatgcaatgcactgggtaagacaagtaccaggaaaaggattagaatgggtaggaagtataagttatgatggaagtgataaatatcatacaaatagtgtatggggaagatttatagtaagtagagataatagcaaaaatacattatatttacaaatgaatagtttaagaccagaagatacagcattatattattgtgtaagagatagaagagaaagtgaatgtgaagaaagatggagtgattattatgattttggaaaacaattaccatgtgtaaaaccaagaggagtagcaggaatatttgatatatggggacaaggaacaatggtaacagtaagtagt

SEQ ID NO: 47742 - RNA, 432 nt, synthetic construct
  misc_feature 1..432: note = derived and/or modified sequence opt6 from anti-HIV_cap256-119-074081_VR-Chain
  source 1..432: mol_type = other RNA
gaagtacaattagtagaaagtggaggaggattagtacaaccaggaggaagtctaagattgagttgtgtagtaagcggagtaacagtatcaagcaattacatgagctgggtaagacaagcaccaggaaaaggattagaatgggtagcatcaatatcatatgatggaagtgacaaataccatgcagatagagtatggggaagatttacaataagcagagacaatagcaaaaacacactatatctacaaatgaatagcttaagagcagaagatacagcactatattactgtgtaagagacgcaagagaaagtgaatgtgaactatgggaatcagactattacaatttcggaagaaaattaccatgcgtaaaaccaagaggagtagcgggaacactagatatatggggacaaggaacaatggtaacagtaagttca

SEQ ID NO: 47743 - RNA, 432 nt, synthetic construct
  misc_feature 1..432: note = derived and/or modified sequence opt6 from anti-HIV_cap256-119-071704_VR-Chain
  source 1..432: mol_type = other RNA
caaatgcaattagtagaaagcggaggaggagtagtacaaccaggaggaagtttaagattaagctgtgcagtaagccaattcacattcacaagttatggaatgcactgggtaagacaagcaccaggaaaaggattagaatgggtagcaacaatatcaagtgatggatcaaaaaaataccatggagatagtgtatggggaagattaacaataagcagggacaatagtaaaaacacattatttttacaaatgaataacttaagagcagaagatacagcactatatttctgtgtaaaagaccagagagaagacgaatgcgaagaatggtggtcagactattacgatttcggaaaaaaattaccatgcagaaaatcaccaggattagcaggaatattcgatgtatggggacatggaacaatggtaacagtaagtcca

SEQ ID NO: 47744 - RNA, 432 nt, synthetic construct
  misc_feature 1..432: note = derived and/or modified sequence opt6 from anti-HIV_cap256-119-071266_VR-Chain
  source 1..432: mol_type = other RNA
caagtacaattagtagaaagtggagggggagtagtacaaccaggagaaagtctaagattaagttgtgcagcaagtggattcacatttagtagttttggaatgcattgggtaagacaagcaccaggaaaaggattagaatgggtaggaagtataagttatgatggaagtgataaatatcatacaaatagtgtatggggaagatttatagtaagtagagataatagtaaaaatacattatatctacaaatgaatagtttaagaccagaagatacagcattatattattgtgtaagagatagaagagaaagtgaatgtgaagaaagatggagtgactattatgattttggaaaacaattaccatgtgtaaaaccaagaggagtagcaggaatatttgatatatggggacaaggaacaatggtaacagtaagtagt

SEQ ID NO: 47745 - RNA, 432 nt, synthetic construct
  misc_feature 1..432: note = derived and/or modified sequence opt6 from anti-HIV_cap256-119-069667_VR-Chain
  source 1..432: mol_type = other RNA
gaagtacaattagtagaaagtggaggaggattagtacaaccaggaagaagtctaagattaagttgtgcagcaagtggatttagttttaatacatatggaatgcattgggtaagacaagcaccaggaaaaggattagaatgggtagcatttataagatatgatgggagtaataaatattatgcagatagtgtaaaaggaagatttacaataagtagagataatagtaaaaatacactatatctacaaatggatggattaagaggagaagatacagcattatattattgtgcaaaagatttaagagaattagaatgtgaagaatgggcaagtgattattatgattttggaagaccacaaccatgtttagatccaagaggggtaagtggaataagtaatgtatggggacaaggaacaatggtaacagtaagtagt

SEQ ID NO: 47746 - RNA, 432 nt, synthetic construct
  misc_feature 1..432: note = derived and/or modified sequence opt6 from anti-HIV_cap256-119-069591_VR-Chain
  source 1..432: mol_type = other RNA
caagtacaattagtagaaagtggaggaggagtagtacaaccaggaagaagtttaagattaagttgtgcagcaagtggatttacgtttagtagctatgcaatgcattgggtaagacaagcaccaggaaaaggattagaatgggtagcaggaataagttatgatggaagtgataaatatcatgcagataaagtatggggaagatttacaataagtagagataatagtaaaaatacattatatttacaaatgaacagtttaagagcagaagatacagcattatattattgtgcaaaagatttaagagaagatgaatgtgaagaatggtggagtgattattatgattttggaaaaagattaccatgtagaaaaagcagaggagtagcaggagtatttgataaatggggacaaggaacaatggtaacagtaagtagt

SEQ ID NO: 47747 - RNA, 432 nt, synthetic construct
  misc_feature 1..432: note = derived and/or modified sequence opt6 from anti-HIV_cap256-119-068691_VR-Chain
  source 1..432: mol_type = other RNA
caaggacatctagtagcaagtggaggaggagtagtaccaccaggaagaagcttaacattaagttgtctagcaagtcaatttacattttcaggatatggatttcattgggtaagacaagcaccaggaaaaggattagaatgggtagcctcaatatcatttgcaggaacaaaaaaacattatggaaatagtgtaaaaggaagatttacaataagtagagataatagtaaaaatacattatatttagaaatgaatagtttaagaccagaagatacagcattatattattgtgcaaaagatagaagagaatatgaatgtgaagaatggacatcagactattatgattttggaagaccacaaccatgtatagattcaagaggagtagtaggaatattagatatatggggaagaggaacaatggtaacagtaagtagt

SEQ ID NO: 47748 - RNA, 432 nt, synthetic construct
  misc_feature 1..432: note = derived and/or modified sequence opt6 from anti-HIV_cap256-119-068488_VR-Chain
  source 1..432: mol_type = other RNA
caaatgcaattagtagaaagcggaggaggagtagtacaaccaggaatgagcttaacattaagttgtgcagcaagccaattcacattctcaaactatggaatgcactgggtaagacaagcaccaggaaaaggactagaatgggtagcatcaatatcaaacgatggatcaaaaaaataccatggagatagtgtaaaaggaagatttacaataagtagagacaatagcaaaaacacactatatctacaaatggatggattaagaggagaagatacagcactatattactgtgcaaaagacttaagagaactagaatgcgaagaatgggcatcagactattacgatttcggaagaccacaaccgtgcttagacccaagaggagtatcaggaataagcaatgtatggggacaaggaacaatggtaacagtaagctca

SEQ ID NO: 47749 - RNA, 432 nt, synthetic construct
  misc_feature 1..432: note = derived and/or modified sequence opt6 from anti-HIV_cap256-119-067536_VR-Chain
  source 1..432: mol_type = other RNA
caagtacaattagtagaaagtggaggaggagtagtacaaccaggaagaagtttaagaataagttgtgcaagtagtcaatttacattttcaagatatggaatgcattgggtgagacaagcaccaggaaaaggattagaatgggtagcaagtataagttatgatggaagagattatcatcatgcaggagcagtatggggaagatttataataagtagagataatagcaaaaatagtttacatttacaaatgaatagcttaagaccagaagatacagcattatatttttgtgctagagatttaagagaaagtgaatgtgaagaatgggaaagtgattattatgcattttatagaaaattaccatgtgtgaaaccaagaggagtagcaggaacactagatatatggggacaaggaacaatggtaacagtaagtagt

SEQ ID NO: 47750 - RNA, 432 nt, synthetic construct
  misc_feature 1..432: note = derived and/or modified sequence opt6 from anti-HIV_cap256-119-065852_VR-Chain
  source 1..432: mol_type = other RNA
caagtacatttagtagaaagtggaggaggagcagtaccatcaggaagaagtttaagattaagttgtgtagcaagtggattcacatttggagtatatgatatacattgggtaagacaagcaccaggaaaaggattagaatgggtagcaagtatatcatatgatggaagagataaatatcatagttcattagtatggggaagattaacaataagtagagataatagtaaaagtacattatttttacaaatgaatagcttaagagcagaagatacagcattatattattgtgcaagagatttgagagaaagtgaatgtgaagaatggcaatcagattattatgcattttataaaaaattaccatgtgtaaaaccaagaggagtagcaggaacattagatatatggggacaaggaacaatggtaacagtaagttca

SEQ ID NO: 47751 - RNA, 432 nt, synthetic construct
  misc_feature 1..432: note = derived and/or modified sequence opt6 from anti-HIV_cap256-119-065457_VR-Chain
  source 1..432: mol_type = other RNA
ctaggaagattagtagcaagtggaggaggagtagtaccaccaggaagaagtccaagattaagttgtgtagcaagtcaatttacattttcaggatgtggattacattgggtaagacaagcaccaggaaaaggattagaatgggtagcagcaataagttttgatggaacagataaatatcatagtgatgatgtatggggaaggtttacaataagcagagataatagcaaaaatacattatatttacaaatgaatagtttaagaccagaagatacagcattatattattgtgcaaaagatctacaagaagatgaatgtgaagaatggtggagtgattattatgattttggaaaacaattaccatgtagaaaaagtagaggagtagcaggaatatttgatgattggggacaaggaacaatggtaacagtaagtagt

SEQ ID NO: 47752 - RNA, 432 nt, synthetic construct
  misc_feature 1..432: note = derived and/or modified sequence opt6 from anti-HIV_cap256-119-064501_VR-Chain
  source 1..432: mol_type = other RNA
caagtacaattagtagaaagcggaggaggagtagtacaaccaggaagaagtttaagattaagttgtgcagcaagcggatttacatttagtagttatgcaatgcattgggtaagacaagcaccaggaaaaggattagaatgggtagcaggaatatcatatgatggaagagataaatatcatgcacatagtgtatggggaagattaagtataagcagagataatagtaaaaatacattatatttacaaatgaatagtttaagaacagaagatacagcattatatcattgtgtaagagatttaagagaaagtgaatgtgaattatgggaatcagattattatgattttggaaaaaaactaccatgtgtgaaaccaagaggagttgcaggaacatttgatctatggggacaaggaacaatggtaacagtgagtagt

SEQ ID NO: 47753 - RNA, 432 nt, synthetic construct
  misc_feature 1..432: note = derived and/or modified sequence opt6 from anti-HIV_cap256-119-063568_VR-Chain
  source 1..432: mol_type = other RNA
caagtacaaccagtagaaagtggaggaggagtagtatggccaggaagaagtttaagattaagttgtacaacaagtggatttacatttagtaattatgcaatacattgggtaagacaagcaccaggaaaaggattacaatgggtagcagtaatatcatatgatggatcaaataaattttatgcagatagtgtaaaaggaagatttacaataagtagagataatagtaaaaatacattatatttacaaatgaatagtttaagaccagaagatacagcattatattattgtgcaaaagatttaagagaagatgaatgtgaagaaagatggagtgattattatgattttggaaaacaattaccatgcagaaaaagtagaggagtagcaggagtatttgataattggggacaaggaacaatggtaacagtaagttca

SEQ ID NO: 47754 - RNA, 435 nt, synthetic construct
  misc_feature 1..435: note = derived and/or modified sequence opt6 from anti-HIV_cap256-119-063103_VR-Chain
  source 1..435: mol_type = other RNA
caagtacaattagtagaaagtggaggaggattagtacaaccaggaaaatcattaagactaagctgtgcagcaagcggattcacattcagcacatatggaatgcactgggtaagacaagcaccaggaaaaggactagaatgggtagcattaatatcatacgatggatcatacacatactatgcagatagcgtaaaaggaagatttacaataagcagagacaatagcaaaagcacactagatctacaactaaatacattaagaccagaagatacagcactatattactgtgcaagagacctaagagaaatggaatgcgaagaatggaaattatacaattattatgactttagaacaagaggaccatgtgtagatccaagaggagtagtaggaagttttgacgtatggggacaaggaacagtagtaacagtatcaagt

SEQ ID NO: 47755 - RNA, 432 nt, synthetic construct
  misc_feature 1..432: note = derived and/or modified sequence opt6 from anti-HIV_cap256-119-061027_VR-Chain
  source 1..432: mol_type = other RNA
caagtgcaattagtagaaagcggaggaggagtagtacaaccaggaaggagtttaagattaagttgtagtgcaagtggatttacattatcaagttatggaatacactgggtaagacaagcaccaggaaaaggactagaatgggtagcagtaatgtcaaatgatggatcaaatcaattttatggagatagtgtaaaaggaagatttacaataagcagagacataagtaaaaatacattatatttacaaatgaatagcttaagaccagaagatacagcaatgtattattgtgcaagagatcaaagatattatgaatgtgaagaatgggcatcagactattatgatttcggaagagaacaaccatgtcaagacccaagaggagtagtaggagtatttgatatgtggggacaaggaacaatggtaacagtaagttca

SEQ ID NO: 47756 - RNA, 432 nt, synthetic construct
  misc_feature 1..432: note = derived and/or modified sequence opt6 from anti-HIV_cap256-119-058232_VR-Chain
  source 1..432: mol_type = other RNA
caagtacaattagtagaaagcggaggaggagtagtacaaccaggaaaaagtttaagattaagctgtaaagcaagtcaatttacatttaatagatatggaatgcactgggtaagacaagcaccaggaaaaggactagaatgggtagcagcaataagttttgatggaacagataaatatcatgccgataaagtatggggaagatttacaataagtagggacgatagtaaaagtacattatatttacaaatgaatagtttaagagcagaagatacagcattatattattgtgcaaaagatttaagagaagatgaatgtgaagaatggtggagtgactattatgatttcggaaaacaactaccatgtagaaaatcaagaggagtagcaggaatatttgatggatggggacaaggaacaatggtaacagtaagtagt

SEQ ID NO: 47757 - RNA, 432 nt, synthetic construct
  misc_feature 1..432: note = derived and/or modified sequence opt6 from anti-HIV_cap256-119-057341_VR-Chain
  source 1..432: mol_type = other RNA
caagtacaattagttgaaagtggaggaggagtagtacaaccaggaagaagtttaagattaagctgtgcagcaagtcatttttcactatcaagttatggaatgcactgggtaagacaagcaccaggaaaaggactagaatgggtagcaggagaatcatttgcagcaacaaataaatattatgcagatagtgtaaaaggaagatttatagtaagtagagacataagtaaaaatacattatatctagaagtaaatagtttaagagcagaagatacagcactatattattgtgcaagagatcaaagatattatgaatgtgaagaatgggcatcagactattatgatttcggaagagaacaaccatgtcaagacccaagaggagtagcaggaatatttgatatatggggacaaggaacaatggtaacagtaagttca

SEQ ID NO: 47758 - RNA, 438 nt, synthetic construct
  misc_feature 1..438: note = derived and/or modified sequence opt6 from anti-HIV_cap256-119-056895_VR-Chain
  source 1..438: mol_type = other RNA
caaatgcaattagtagaaagtggaggaggagtagtacaaccaggaagaagtctaagattaagctgtgcagcaagccaattcacattcggaagttatggaatgcactgggtaagacaaataccaggaaaaggactagaatgggtagcaacaatatcatacgatggaacaaaaaaataccatgcagatagcgtatgggatagatttataataagcagagacaatagcaaaaacacactatttttacaaatgaatagcttaagaccagaagatacagcactatatttctgtgtaaaagaccaaagacaagacgaatgtgaagaatggtggtcagactattacgatttcggaagagaactaccatgcagaaaatcaagaggactaggactagcaggaatattcgatatgtggggacatggaacaatggtaacagtaagctca

SEQ ID NO: 47759 - RNA, 432 nt, synthetic construct
  misc_feature 1..432: note = derived and/or modified sequence opt6 from anti-HIV_cap256-119-056402_VR-Chain
  source 1..432: mol_type = other RNA
caagtaaaattagtagaaagcggaggaggagtagtacaaccaggaaaaagcttaagattaagctgtacagcaagccaattcacattctcaaactttggaatgcactgggtaagacaagcaccaggaaaaggactagaatgggtagcatcaatatcattcgtaggaataaaaaaacactatgcaaatagcgtaagaggaagatttacaataagcagagaccaaagcaaaaacacactatatttacaaatgaatagcgtaagagtagaagatacagcaagatatttctgtgcaagagacatgagagaatacgaatgcgaactatgggcatcagactattacgatttcggaaaaccacaaccatgcgaagacccaagaggagtagtaggaacattcgatatgtggggattaggcacactagtaacagtaagctca

SEQ ID NO: 47760 - RNA, 432 nt, synthetic construct
  misc_feature 1..432: note = derived and/or modified sequence opt6 from anti-HIV_cap256-119-056034_VR-Chain
  source 1..432: mol_type = other RNA
caagtacaattagtagaaagcggaggaggagtagtacaaccaggaagaagtttaagattaagctgtgcagcaagcggattcacattctcaagttatgcaatgcactgggtaagacaagcgccaggaaaagggctagagtgggtagcagcaatatcattcgcaggaacaaaaacacactatgcagatagcgtaaaaggaagatttacaataagcagagacaatagcaaaaacgcactatatctacaaatgaataacttaagagcagaagatacagcactatattactgtgcaaaagacttaagagaagacgaatgtgaagaaagatggtcagactattacgatttcggaaaacaactaccatgcagaaaatcaagaggagtagcaggagtattcgataactggggacaaggaacaatggtaacagtaagttca

SEQ ID NO: 47761 - RNA, 432 nt, synthetic construct
  misc_feature 1..432: note = derived and/or modified sequence opt6 from anti-HIV_cap256-119-055042_VR-Chain
  source 1..432: mol_type = other RNA
caagtacaattagtagaaagtggaggaggagtagcacaaccaggaagaagtttaagattaagttgtgcagcaagtggatttacatttagaagttatggaatgcattgggtaagacaagcaccaggaaaaggattagaatgggtagcagtaataagtttagatggaagtaataaatattatgcagatagtgtaaaaggaagatttagtataagtagagataatagtaaaaatacattatatctacaaatgaatagcttaagaccagaagatacagcagtatattattgtgcaaaagatttaagagaagatgaatgtgaagaaagatggagtgattattatgattttggaaaacaattaccgtgtagaaaaagtagaggagtagcaggagtatttgataattggggacaaggaacaatggtaacagtaagtagt

SEQ ID NO: 47762 - RNA, 438 nt, synthetic construct
  misc_feature 1..438: note = derived and/or modified sequence opt6 from anti-HIV_cap256-119-054776_VR-Chain
  source 1..438: mol_type = other RNA
caagtacaattaatggaaagcggaggaggagtagtacaaccgggaagatcattaagattaagctgtacagcaagcggattcacattcagcagttatagtatgcactgggtaagacaagcaccaggaaaaggactagaatgggtagcaataatatcatatgatgaatcaaataaatactatgcagatagcgtacaaggaagatttacaataagcagagacaatagcaaaaatacactatttttacaaatgtcaagtttaagagcagaagatacagcactctatttctgtgtaagagatcatagagaagacgaatgtgaagaatggtggtcagattattacgatttcggaagagaactaccatgcagaaaatttagaggactaggactagcaggaatattcgatatatggggtcatggaacaatggtaacagtaagctca

SEQ ID NO: 47763 - RNA, 432 nt, synthetic construct
  misc_feature 1..432: note = derived and/or modified sequence opt6 from anti-HIV_cap256-119-054539_VR-Chain
  source 1..432: mol_type = other RNA
caaatgcaattagtagaaagtggaggaggagtagtacaaccaggaggaagtttaagattaagttgtgcagcaagtcaatttacgtttggaagttatgcaatgcattgggtaagacaaccaccaggagaaagaccagaatgggtagcaacaatatcatttgatggaacaaaaaaatatcatgcagatagtgtatggggaagatttacaataagtagagataatagtaaaaatacattatttttacaaatgaatagtctaagaccagaagatacagcattatatttttgtgtaaaagatcaaagagaagatgcatgtgaagaatggtggagtgattattatgattttggaaaaaattgtttagcagaaagtccaggagcatggttagaatttttttatgtatggggacatggaacaatggtaacagtaagtagt

SEQ ID NO: 47764 - RNA, 432 nt, synthetic construct
  misc_feature 1..432: note = derived and/or modified sequence opt6 from anti-HIV_cap256-119-054112_VR-Chain
  source 1..432: mol_type = other RNA
caagtacaattagtagaaagtggaggaggagtagtacaagcaggaagaagtttaagattaagctgtgcagcaagcggattcacattctcaacatatgcaatgcactgggtaagacaagcaccaggaaaaggactagaatgggtagcagtaatatcatacgatggatcaaataaatactatgcagatagcgtacgaggaagatttacaataagcagagacaatagcaaaaacacactatatctacaaatgaatagcttaagagcagaagatacagcactatattactgtgcaaaagacatgagagaatatgaatgcgaagaatggacatcagattattatgatttcggaagaccacaaccatgcatagactcaagaggagtagtaggaacatttcatgtatggggacaaggaacaatggtaacagtaagctca

SEQ ID NO: 47765 - RNA, 432 nt, synthetic construct
  misc_feature 1..432: note = derived and/or modified sequence opt6 from anti-HIV_cap256-119-053339_VR-Chain
  source 1..432: mol_type = other RNA
caagtacatttagtagaaagcggaggaggagtagtacaaccaggaagaagtttaagattaagttgtgcagcaagtcatttcagtctatcaagttatggaatgcactgggtaagacaagcaccaggaaaaggactagaatgggtaacaggaatatcatttgcaggaacaaaaacatactatggagatagcgtaagaggaagatttacagtaagcagagacataagtaaaaacacactattactacaaatgaatagcttaagaccagacgatacagcaatatattactgtgcaagagaccaaagatattatgaatgtgaagaatgggcatcagactattacgattttggaaaagaacaaccatgtttagacccaagaggagtagtaggaatattcgatttatggggacaaggaacaatggtaacagtaagttca

SEQ ID NO: 47766 - RNA, 432 nt, synthetic construct
  misc_feature 1..432: note = derived and/or modified sequence opt6 from anti-HIV_cap256-119-052404_VR-Chain
  source 1..432: mol_type = other RNA
caaatgcaattggtagaaagtggaggaggggtagtacaaccaggaagaagcttaacattgagctgtatagcaagccaattcaatttcgcgagctatggaatgcactgggtaagacaagcaccaggaaaaggactagaatgggtagcatcaatatcacacgatggaacaaaaaaataccatgcagaaagtgtatggggaagatttacaataagcaaagacaatagcaaaaacacactatttctacaaatgaatagcttaagagtagaagatacagcactatatttctgtgtaaaagaccaaagagaagacgaatgcgaagaatggtggtcagactattacgatttcggaaaacaactaccatgcagaaaatcaagaggagtagcaggagtattcgataactggggacaaggaacaatggtaacagtaagctca

SEQ ID NO: 47767 - RNA, 432 nt, synthetic construct
  misc_feature 1..432: note = derived and/or modified sequence opt6 from anti-HIV_cap256-119-051123_VR-Chain
  source 1..432: mol_type = other RNA
caagtacaattagtagaaagtggaggaggagtagtacaaccaggaggaagtttaagattaagttgtgtaggaagtcaatttatattatatagatatggaatgcattgggtaagacaagcaccaggaaaaggattagaatgggtagcagcagtaagttttgatggaacagataaatatcatgcagatgatgtatggggaagatttacaataagtagagataatagtaaaaatatactatatttacaaatgaatagtttaagagcagaagatacagcattatattattgtgcaaaagatttaagagaagatgaatgtgaagaatggtggagtgattattatgatttaggaaaacaactaccatgtagaaaaagcagaggagtagcaggagtatttgataaatggggattaggaacaatggtaacagtaagtagt

SEQ ID NO: 47768 - RNA, 438 nt, synthetic construct
  misc_feature 1..438: note = derived and/or modified sequence opt6 from anti-HIV_cap256-119-051077_VR-Chain
  source 1..438: mol_type = other RNA
gaagtacaattagtagaaagcggaggaggagtagtacaaagtgggaggagtctaagattaagttgtgcagcaagccattttacatttagtagatatggaatgcattgggtaagacaagcaccaggaaaaggattagaatgggtagcaagtataagctatgatggaagagatttttatcatgcaagaagtgtatggggaagatttacaataagtagagataatagcaaaaatacattatttttacaaatgaatagtttaagaatagaagatacagcattatatttttgtgtaaaagatcaaagagaagatgaatgtgaagaatggtggagtgattattatgattttggaagagaattaccatgtaggaaaagtagaggattaggattagcaggaatatttgatatgtggggacatggaacaatggtaacagtaagtagt

SEQ ID NO: 47769 - RNA, 432 nt, synthetic construct
  misc_feature 1..432: note = derived and/or modified sequence opt6 from anti-HIV_cap256-119-050442_VR-Chain
  source 1..432: mol_type = other RNA
caagcacaaatggtagaaagtggaggaggagtagtacaaccaggaagaagtttaagattaagttgtgcagcaagtggatttagttttagttattttgcaatgcattgggtaagacaagcaccaggaaaaggattagaatgggtagcaggaataagttttgcagcaacaaaaacatattatggaggaagtgtaaaaggaagatttacagtgagtagagatataagcaaaaatacattatatttacaaatgaatagtttaagaccagaagatacagcaatgtattattgtgcaagagatcaaagatattatgaatgtgaagaatgggcaagtgattattatgattttggaagagaacaaccatgtcaagatccaagaggagtagtaggagtatttgatatgtggggacaaggaacaatggtaacagtaagtagt

SEQ ID NO: 47770 - RNA, 432 nt, synthetic construct
  misc_feature 1..432: note = derived and/or modified sequence opt6 from anti-HIV_cap256-119-049433_VR-Chain
  source 1..432: mol_type = other RNA
caagtacaattagtagaaagtgggggaggagtagtacaaccaggaagaagtttaagagtaagctgtagagcaagtggatttgcatttagtagttatgcaatgcattgggtaagacaagcaccagtaaaaggattagaatgggtagcattaacaagtagtgatggagcagataaatatcatgcagatgatgtatggggaagatttacaataagtagagataatagtaaaaatacattatatttacaaatgaatagtttaagaccagaagatacagcattatattattgtgcaaaagatttaagagaagatgaatgtgaagaaagatggagtgattattatgattttggaaaacaattaccatgtagaaaaagtagaggagtagcaggagtatttgataattggggacaaggaacaatggtaacagtaagtagt

SEQ ID NO: 47771 - RNA, 432 nt, synthetic construct
  misc_feature 1..432: note = derived and/or modified sequence opt6 from anti-HIV_cap256-119-047532_VR-Chain
  source 1..432: mol_type = other RNA
ttaggaagattagtagcaagtggaggaggagtagtaccaccaggaagaagtttaacattaagttgtgtagcaagtcaatttacatttagtggatgtggattacattgggtaagacaagcaccaggaaaaggattagaatgggtagcaagtataagttttgcaggaacaaaaaaacattatacaaatagcgtaagaggaagatttacaataagtagagataatagtaaaaatacagtatatttacaaatgaatagtttaagagcagaagatacagcattatattattgtgcaaaagatatgggagaatatgaatgtgaagaatggacaagtgattattatgattttggaagaccacaaccatgtatagatagtagaggagtagtaggaatattagatatatggggacaaggaacaatggtaacagtaagtagt

SEQ ID NO: 47772 - RNA, 432 nt, synthetic construct
  misc_feature 1..432: note = derived and/or modified sequence opt6 from anti-HIV_cap256-119-047489_VR-Chain
  source 1..432: mol_type = other RNA
caagtacatttagtagaaagtggaggaggagtagtacaaccaggaaaaagtttaagattaagttgtgcagcaagtcaatttacatttaatagatttggaatgcattgggtaagacaagcaccaggaaaaggattagaatgggtagcaggaataagttatgatggaagtgataaatatcatgcagataaagtatggggaagatttacaataagtagagataatagtaaaaatacattatatctacaaatgaatagtttgagagcagaagatacagcattatattattgtgcaaaagatttaagagaagatgaatgtgaagaatggtggagtgattattatgattttggaaaaagattaccgtgtagaaaatcaagaggagtagcgggagtatttgataaatggggacaaggaacaatggtaacagtaagtagt

SEQ ID NO: 47773 - RNA, 438 nt, synthetic construct
  misc_feature 1..438: note = derived and/or modified sequence opt6 from anti-HIV_cap256-119-046020_VR-Chain
  source 1..438: mol_type = other RNA
gaagtacaattactacaaagcggaggaggactagtacaaccaggaggaagcttaagattaagctgtgcagcaagcggattctcattctcaagctatgcaatgagctggataagacaagcaccaggaaaaggactagaatgggtagcatcaatatcacacgatggaacaaaaaaataccatgcagaaagcgtatggggaagatttacaataagcaaagacaatagcaaaaacacactatttctacaaatgaatagcttaagagtagaagatacagcactatatttctgtgtaaaagaccaaagagaagacgaatgcgaagaatggtggtcagactattacgatttcggaagagaactaccatgcagaaaatcaagaggactaggactagcaggaatattcgatatgtggggacatggaacaatggtaacagtaagctca

SEQ ID NO: 47774 - RNA, 432 nt, synthetic construct
  misc_feature 1..432: note = derived and/or modified sequence opt6 from anti-HIV_cap256-119-044746_VR-Chain
  source 1..432: mol_type = other RNA
caagtacaattagtagaaagcggaggaggagtagtacaaccaggaagaagtttaagattaagttgtgcagcaagtggatttacatttagtagttatgcaatgcattgggtaagacaagcaccaggaaaaggattagaatgggtagcagtaataagttatgatggaagtaataaatattatgcagatagtgtaaaaggaagatttacaataagtagggataatagtaaaaatacagtatatttagaaatgaatagtttaagagcagaagatacagcattatattattgtgcaaaagatttaagagaatatgaatgtgaagaatggacaagtgattattatgattttggaagaccacaaccatgtatagatagtagaggagtagtaggaatattagatatatggggacaaggaacaatggtaacagtaagtagt

SEQ ID NO: 47775 - RNA, 432 nt, synthetic construct
  misc_feature 1..432: note = derived and/or modified sequence opt6 from anti-HIV_cap256-119-044740_VR-Chain
  source 1..432: mol_type = other RNA
caaatgcatttagtagaaagcggaggaggagtagtacaaccaggaatgagcttaagattaagctgtgcagcaagtcaattcaatttcggaagttttggaatgcactgggtaagacaagcaccaggaaaaggactagaatgggtagcaacaataagttatgatggaacaaaaaaataccatagtgatagcgtatggggaagattaagcataagcagagacaatagcaaaaacacactatttctacaaatgaatagcttaagaacagaagatacagcactatatttctgtgtaagagaccaaagagaagacgattgtgaagaatggtggtcagactattacgatttcggaaaaaaactaccatgcagaaaatcaagaggactagcaggaatatttgatatatggggacatggaacaatggtaacagtaagttca

SEQ ID NO: 47776 - RNA, 432 nt, synthetic construct
  misc_feature 1..432: note = derived and/or modified sequence opt6 from anti-HIV_cap256-119-043790_VR-Chain
  source 1..432: mol_type = other RNA
ctactacaattagtagaaagcggaggaggagtagtacaaccaggaaatagtttaagattaagttgtgcagcagcaggattcacattcagtgattatagtttacactgggtaagacaagcaccaggaaaaggactagaatgggtagcaatgatatcagacgatggaaatctagatttctatgcagcaagtgtaaaaggaagatttacaataagtagagacaatagcataaacacagtatatttacaaatgaatagtttaagagcagaagatacagcactatattactgtgcaaaagatctaagagaatatgaatgtgaagaatggacatcagactattacgatttcggaagaccacaaccatgtatagactcaagaggagtagtaggaatactagatatatggagtcaaggaacaatggtaacagtaagcagt

SEQ ID NO: 47777 - RNA, 432 nt, synthetic construct
  misc_feature 1..432: note = derived and/or modified sequence opt6 from anti-HIV_cap256-119-042880_VR-Chain
  source 1..432: mol_type = other RNA
gaagtaagattagtagaaagcggaggaggactagtacaaccaggaggaagcttgagattaagctgtgcagcaagcgggttcacattatcggactattacatgagctggataagacaagcaccaggaaaaggactagaatgggtagcagcaatatcattcgcaggaacaaaaaaacactatggaaatagtgtaaaaggaagatttacaataagcagagacaatagcaaaaacacactatatttagaaatgaatagcttaagagtagaagatacagcattatattactgtgcaaaagacttaagagaatacgaatgcgaagaatggacatcagactattacgatttcggaagaccacaaccatgcatagactcaagaggagtagtaggaatattagatatatggggacaaggaacaatggtgacagtaagctca

SEQ ID NO: 47778 - RNA, 432 nt, synthetic construct
  misc_feature 1..432: note = derived and/or modified sequence opt6 from anti-HIV_cap256-119-042606_VR-Chain
  source 1..432: mol_type = other RNA
caaatgcaattagtagaaagtggaggaggagtagtacaaccaggaagaagtttaagattaagctgtgcagcaagtcaatttacattcggaagttatggaatgcactgggtaagacaaataccaggaaaaggactagaatgggtaacaggaatatcatttgcagcaacaaaaacatactatggagatagcgtaagaggaagatttacagtaagcagagacataagtaaaaacacattatatctacaaatgaatagcttaagaccagaagatacagcaatgtattactgtgcaagagaccaaagatattatgaatgcgaagaatgggcatcagactattacgatttcggaagagaacaaccatgtcaagacccaagaggagttgtaggaatattagatctatggggacaaggaacaatggtaacagtaagttca

SEQ ID NO: 47779 - RNA, 432 nt, synthetic construct
  misc_feature 1..432: note = derived and/or modified sequence opt6 from anti-HIV_cap256-119-042444_VR-Chain
  source 1..432: mol_type = other RNA
caagtacaattagtagaaagcggaggagatgtagtacatccaggaggaagtttaagattaagctgtgcagcaagtggattcacattttcaagttatggaatacactgggtaagacaagcaccaggaaaaggactagaatgggtagcagcaatatcatatgatggatcagataaatatcatacaaatagtgtatggggaagatttacagtaagcagagacaatagtaaaaatacggtatatttacaaatgaatagtttaagagcagaagatacagcattatatttctgtgtaagagacagaagagaaagtgaatgtgaattatgggaatcagactattatgatttcggaaaaagattaccatgtgtaaaaccaagaggagtagcaggagtatttgatatatggggacaaggaacgatggtaacagtaagctca

SEQ ID NO: 47780 - RNA, 432 nt, synthetic construct
  misc_feature 1..432: note = derived and/or modified sequence opt6 from anti-HIV_cap256-119-040328_VR-Chain
  source 1..432: mol_type = other RNA
caagtacaattagtagaaagtggaggaggagtagtacaaccaggaggatcattaagattaagctgtgcagcaagcggattcacattcagcagttatagtatgaactgggtaagacaagcacccggaaaaggattagaatgggtagcaagtatatcattcgcaggaacaaaacaacactatggaaatagcgtaaaaggaagatttacaataagcagggacaatagcaaaaacacagtatatctacaaatgaatagcttaagattagaagatacagcactatattactgtgcaaaagacttaagagaatacgaatgcgaagaatggacatcagactattacgatttcggaagaccacaaccatgcatagactcaagaggagtagtaggaatactagatatatggggacaaggaacaatggtaacagtaagttca

SEQ ID NO: 47781 - RNA, 432 nt, synthetic construct
  misc_feature 1..432: note = derived and/or modified sequence opt6 from anti-HIV_cap256-119-040164_VR-Chain
  source 1..432: mol_type = other RNA
caaatgcacttagtagaaagcggaggaggagtagtacaaccaggaatgagcttaagattaagctgtgcagcaagtcaattcaatttcggaagctttggaatgcactgggtaagacaagcaccaggaaaaggactagaatgggtagcaacaatatcatacgatggaacgaaaaaataccatagcgatagcgtatggggaagatttagcataagcagagacaatagcaaaaacacactatatctacaaatgaatagcttaagaacagaagatacagcactatatttctgtgcaaaagacttaagagaatacgaatgcgaagaatggacatcagactattacgatttcggaagaccacaaccatgcatagactcaagaggggtagtaggaatactagatatatggggacaaggaacaatggtaacagtaagctca

SEQ ID NO: 47782 - RNA, 432 nt, synthetic construct
  misc_feature 1..432: note = derived and/or modified sequence opt6 from anti-HIV_cap256-119-039130_VR-Chain
  source 1..432: mol_type = other RNA
gaagaacaattagtagaaagcggaggaggattagtacaaccaggaagaagcttaagattaagttgtacaggaagcggattcagattcggagactatgcaatgaactgggtaagacaagcaccaggaaaaggattagaatgggtaacatttatatcatacgatggatcaaacaaacactatgcagatagcgtaaaaggaagatttacagtaagcagagacaatagcaaaaacacactacatctacaaatgaatagcttaagaccagaagatacagcattatatttctgtgcaagagacttaagagaaagcgaatgcgaagaatgggaatcatactattacgatttcggaaaaaaaggaccatgcgtaaaaccaagaggagtagtaggagtactagatatatggggacaaggaacactagtaacagtaagttca

SEQ ID NO: 47783 - RNA, 432 nt, synthetic construct
  misc_feature 1..432: note = derived and/or modified sequence opt6 from anti-HIV_cap256-119-038138_VR-Chain
  source 1..432: mol_type = other RNA
caagtacaattagtagaaagcggaggaggagtagtacaaacaggaagaagtttaagattaagttgtacaggaagtcaattcacatttggaagatatggaatgtattgggtaagacaagcaccaggaaaaggattagaatgggtagcaagtataagttatgatggaagagatttttatcatgcaagaagtgtatggggaagatttacaataagtagagataatagtaaaaatacattacatttacaaatgaatagtttaagaccagaagatacagcattatatttttgtgcaagagatttaagagaaagtgaatgtgaagaatgggaaagttattattatgattttggaaaaaaaggaccatgtgtaaaaccaagaggagtagtaggagtattagatatatggggacaaggaacattagtaacagtaagtagt

SEQ ID NO: 47784 - RNA, 432 nt, synthetic construct
  misc_feature 1..432: note = derived and/or modified sequence opt6 from anti-HIV_cap256-119-037868_VR-Chain
  source 1..432: mol_type = other RNA
caagtacaattagtagaaagcggaggaggagtagtacaaccaggaagaagtttaagattaagttgtgcagcaagtcaatttacatttagtaaatatggaatgcattgggtaagacaagcaccaggaaaaggattacaatgggtagcaggaataagttatgatggaagtgataaatatcatgcacattttgtatggggaagatttagtataagtagagataacagtaaaaatgcattatatttacaaatgaatagcttaagaacagaagatacagcattatatttttgtgtaagagatttaagagaaagcgaatgtgaagaatggaaaagtgattattatgattttggaagaaaaggaccatgtctaaaaccaagaggagtagcaggaagttttgatatatggggacaaggaacagtagtaacagtaagtagt

SEQ ID NO: 47785 - RNA, 432 nt, synthetic construct
  misc_feature 1..432: note = derived and/or modified sequence opt6 from anti-HIV_cap256-119-037102_VR-Chain
  source 1..432: mol_type = other RNA
caagtaaaattagtagaaagcggaggaggagtagtacaaccaggaaaaagcttaagattaagctgtacagcaagtcaattcacattctcaaactttggaatgcactgggtaagacaagcaccaggaaaaggattagaatgggtagcatcaatatcattcgtaggaataaaaaaacactatgcaaatttcgtaagagggagatttacaataagcagagaccaaagcaaaaacacactatatctacaaatgaatagcgtaagagtagaagatacagcaagatattactgtgcaagagacatgagagaatacgaatgcgaactatgggcatcagactattacgatttcggaaaaccacaaccatgcgaagacccaagaggagtagtaggaacattcgatatgtggggattaggaacactagtaacagtaagctca

SEQ ID NO: 47786 - RNA, 438 nt, synthetic construct
  misc_feature 1..438: note = derived and/or modified sequence opt6 from anti-HIV_cap256-119-036683_VR-Chain
  source 1..438: mol_type = other RNA
ggagtacaattagtagaaagcggaggagcagtagtaagaccaggaggaagcttaacattaagctgtgcagcaagccaattcatactatcaagttatggaatgcactgggtaagacaagcaccaggaaaaggactagaatgggtagcatcaatatcaaacgatggaacaaaaaaataccatgcagaaagtgtatgggatagatttagcataagcaaagacaatagcaaaaacacactatttctacaaatgaatagcttaagagtagaagatacagcattatatttctgtgtaaaagaccaaagagaagacgaatgcgaagaatggtggtcagactattacgatttcggaagagaattaccatgcagaaaatcaagaggactaggactagcgggaatattcgatatgtggggacatggaacaatggtaacagtaagctca

SEQ ID NO: 47787 - RNA, 432 nt, synthetic construct
  misc_feature 1..432: note = derived and/or modified sequence opt6 from anti-HIV_cap256-119-036495_VR-Chain
  source 1..432: mol_type = other RNA
caagtacaattagtagaaagtggaggaggagtagtacaaccaggaagaagtttaagattaagttgtgcagcaagtggattttcatttagtagttatggaatgcattgggtaagacaagcaccaggaaaaggattagaatgggtagcatcaataagttttgtaggaataaaaacacattatgcaaatagtgtaagaggaagatttacaataagtagagatcaaagtaaaaatacattatatttacaaatgaatagtgtaagaatagaagatacagcaagatatttttgtgcaagagatatgagagaatatgaatgtgaattatgggcaagtgattattatgattttggaaaaccacaaccatgtgaagatccaagaggagtagtaggaacatttgatatgtggggattaggaacattagtaacagtaagtagt

SEQ ID NO: 47788 - RNA, 438 nt, synthetic construct
  misc_feature 1..438: note = derived and/or modified sequence opt6 from anti-HIV_cap256-119-035375_VR-Chain
  source 1..438: mol_type = other RNA
gaagtacaattagtagaaagcggaggaggattagtacaaccgggaagaagtttaagattaagttgtgcagcaagcggattcacactagaagactatggaatgcactgggtaagacaagcacccggaaaaggactagaatgggtagcatcaatatcaaatgatggaacaaaaaaatatcatgcagaaagtgtatgggatagatttagtataagcaaagacaatagcaaaaacacactatttctacaaatgaatagtttaagagtagaagatacagcattatatttctgtgtaaaagatcaaagagaagatgaatgtgaagaatggtggtcagactattacgatttcggaagagaactaccatgcagaaaaagtagaggactaggactagcaggaatattcgatatgtggggacatggaacaatggtaacagtaagttca

SEQ ID NO: 47789 - RNA, 438 nt, synthetic construct
  misc_feature 1..438: note = derived and/or modified sequence opt6 from anti-HIV_cap256-119-035165_VR-Chain
  source 1..438: mol_type = other RNA
caagtacatttagtagaaagtggagggggagtaggacaaccagcaagaagtctaagattaagttgtgcagcaagtggatttatattaagtagttatggattacattgggtaagacaagcaccaggaaaaggattagaatgggtggcattaatatcatatgatggaaataatgaatattatgcagaaagtgtatggggaagatttacaataagtaaagataatagtaaaaatacattatttctacaaatgaatagcttaagagtagaagatacagcattatatttttgtgtaaaagatcaaagagaagatgaatgtgaagaatggtggagtgattattatgattttggaagagaattaccatgtagaaaatcaagaggattaggactagcaggaatatttgatatgtggggacatggaacaatggtaacagtaagtagt

SEQ ID NO: 47790 - RNA, 432 nt, synthetic construct
  misc_feature 1..432: note = derived and/or modified sequence opt6 from anti-HIV_cap256-119-035109_VR-Chain
  source 1..432: mol_type = other RNA
caagtacaattagtagaaagtggaggaggagtagtacaaccaggaagaagtttaagattaagttgtgcaacagcaggatttacatttagtagttatgcaatgcattgggtaagacaagcaccaggaaaaggattagaatgggtagcaagtattagttatgatggatcagataaatatcatgcagatttagtatggggaagatttacaataagtagagataatagtaaaaatacattatatttacaaatgaatagtttaagagcagaagatacagcattatattattgtgtaagagatgcaagagaaagtgaatgtgaattatgggaatcagattattataattttggaagaaaattaccatgtgtaaaaccaagaggagtagcaggaacattagatatatggggacaaggaacaatggtaacagtaagttca

SEQ ID NO: 47791 - RNA, 339 nt, synthetic construct
  misc_feature 1..339: note = derived and/or modified sequence opt6 from anti-HIV_cap256-119-033789_VR-Chain
  source 1..339: mol_type = other RNA
caagtatatttagtagaaagtggaggaggagtagtacaaccaggaagaagtttaagattaagttgtgcagcaagtcatttttcattatcaagttatggaatgcattgggtaagacaagcaccagatataagtaaaaatacattatatttacaagtaaattcattaagaccagaagatacagcaatgtattattgtgcaagagatcaaagatattatgaatgtgaagaatgggcatcagattattatgattttggaaaagaacaaccatgtttagatccaagaggagtagtaggaatatttgatatatggggacaaggaacaatggtaacagtatcaagt

SEQ ID NO: 47792 - RNA, 432 nt, synthetic construct
  misc_feature 1..432: note = derived and/or modified sequence opt6 from anti-HIV_cap256-119-033641_VR-Chain
  source 1..432: mol_type = other RNA
caagtacaattagtagaaagcggaggaggagtagtacaaacaggaagaagtttaagattaagctgtacaggaagccaatttacatttggaagatatggaatgtactgggtaagacaagcaccaggaaaaggactagaatgggtagcagcaataagttatgatggatcagataaatatcatacaaatagtgtatggggaagatttacagtaagcagggacaatagcaaaaatacagtatatttacaaatgaatagtttgagagcagaagatacagcattatatttttgtgtaagagacagaagagaaagtgaatgtgaattatgggaatcagactattatgattttggaaaaaggctaccatgtgtaaaaccaagaggagtagcaggagtatttgatatatggggacaaggaacaatggtaacagtaagttca

SEQ ID NO: 47793 - RNA, 432 nt, synthetic construct
  misc_feature 1..432: note = derived and/or modified sequence opt6 from anti-HIV_cap256-119-032113_VR-Chain
  source 1..432: mol_type = other RNA
caagtacaattagtagaaagtggaggaggagtagtacaaccaggaagaccactaagattaagttgtgtaggaagcggatttagttttataacaagtgcgatgcattgggtaagacaagcaccagataaaggattagaatgggtagcaataataagtgatggaggaaataatagacattatgcagatagtgtaaaaggaagatttacaataagtagagataatagtaaaaatacagtatttttagaagtaaataatttaagaccagaagatacagcaatgtattattgtgcaagagatcaaagatattatgaatgtgaagaatgggcaagtgattattatgattttggaagagaacaaccatgtcaagatccaagaggagtagtaggagtatttgatatgtggggacaaggaacaatggtaacagtaagtagt

SEQ ID NO: 47794 - RNA, 432 nt, synthetic construct
  misc_feature 1..432: note = derived and/or modified sequence opt6 from anti-HIV_cap256-119-031739_VR-Chain
  source 1..432: mol_type = other RNA
caagtacaattagtagaaagcggaggaggagtagtacaaccaggaagaagtttaagaataagctgtgcagcaagccaattcacattcaatagatatggaatgcactgggtaaggcaagcaccaggaaaaggactagaatgggtagcatcaatatcatacgatggatcagacaaataccatgcaggactagtatgggggagattcataataagcagagacaatagcaaaaacacactatatctacaaatgaatagcttaagagcagaagatacagcactatattactgtgtaagagacgaaagagaaagtgaatgcgaactatgggaatcagactattacgatttcggaaaaaaattaccatgcgtaaaaccaagaggagtagcaggaacactagatatatggggacaaggaacaagagtaacagtaagttca

SEQ ID NO: 47795 - RNA, 432 nt, synthetic construct
  misc_feature 1..432: note = derived and/or modified sequence opt6 from anti-HIV_cap256-119-030932_VR-Chain
  source 1..432: mol_type = other RNA
gaagtacaattattagaaagcggaggaggagtagtacaaccaggaagaagtctaagactaagctgtgcagcaagtggatttgcattttcacattatggaatattttgggtaagacaagcaccaggaaaaggattagaatgggtaacagtaatatcaggagatggaagtacacaatggtatgcagatagtgtacaagggagatttacgataagtagagatagtagtaaaaatacattatatttacaaatggatggattaagaggagaagatacagcattatattattgtgcaaaagatttaagagaattagaatgtgaagaatgggcaagtgattattatgattttggaagaccacaaccatgtctagatccaagaggagtatcaggaataagtaatgtatggggacaaggaacaatggtaacagtaagtagt

SEQ ID NO: 47796 - RNA, 438 nt, synthetic construct
  misc_feature 1..438: note = derived and/or modified sequence opt6 from anti-HIV_cap256-119-030740_VR-Chain
  source 1..438: mol_type = other RNA
caagtacaattagtagaatttggaggaggagtagtacaaacaggaagaagtttaagattaagttgtgcagcaagtgggtttacattttcagattatggaatgcattgggtaagacaagcgccaggaaaaggattagaatgggtagcaagtatatcaaatgatggaagtaaaaaatatcatggagatagtgtatgggcaagatttataataagtagagataatagtaaaaatacattatttttacaaatgagtagtttaagagcagaagatacagcattatatttttgtgtaagagatcatagagaagatgaatgtgaagaatggtggagtgattattatgattttggaagagaattaccatgtagaaaatttagaggattaggattagcaggaatatttgatatatggggacatggaacaatggtaacagtaagtagt

SEQ ID NO: 47797 - RNA, 438 nt, synthetic construct
  misc_feature 1..438: note = derived and/or modified sequence opt6 from anti-HIV_cap256-119-030197_VR-Chain
  source 1..438: mol_type = other RNA
caagtacatttagtagaaagtggaggaggagtagtacaaccaggaaaaagtttaagattaagttgtgcagcaagtcaatttacattttgtagatatggaatgcattgggtaagacaagcaccaggaaaaggattagaatgggtagcatcgataagtaatgatggaacagataaatatcatgcagataatgtatggggaagatttacaataagcagagataatagtaaaaatacactatatttagaaatgaatagtttaagaggagaagatacagcattatattattgtgcaaaagatatgagagaagatgaatgtgaagaatggtggagtgattattatgattttggaaaagaattaccatgtagaaaatggaaaacaaggggagtagcaggaatattagataattggggacaaggaacaatggtaacagtaagtagt

SEQ ID NO: 47798 - RNA, 438 nt, synthetic construct
  misc_feature 1..438: note = derived and/or modified sequence opt6 from anti-HIV_cap256-119-027047_VR-Chain
  source 1..438: mol_type = other RNA
caaatgcaattagtagaaagtggaggaggagtagtacaaccaggaagaagcttaacattaagttgtgcagcaagtcaatttacatttagaaattatggaatgcattgggtaagacaagcaccaggaaaaggattagaatgggtagcaagtataagtaaagatggaacaaaaaaatatcatggagatagtgtatggggaagatttataataagtagagataatagtaaaaatacattatttttacaaatgagtagtttaagagcagaagatacagcattatatttttgtgtaagagatcaaagagaagcagaatgtgaagaatggtggagtgattattatgattttggaagagaattaccatgtagaaaatttagaggattaggattagcaggaatatttgatatatggggacatggaacaatggtaacagtaagtagt

SEQ ID NO: 47799 - RNA, 432 nt, synthetic construct
  misc_feature 1..432: note = derived and/or modified sequence opt6 from anti-HIV_cap256-119-026950_VR-Chain
  source 1..432: mol_type = other RNA
caagtacaattagtagaaagcggaggaggagtagtacaaccaggaaaaagtttaagaataagctgtgcagcaagcagattcacattcggaagatttggaatgcactgggtaagacaagcaccaggaaaaggactagaatgggtagcatcaatatcatacgatggatcagacaaataccatgcaggattagtatggggaagatttataataagcagagacaatagtaaaaatacactatatctacaaatgaatagcttaagagcggaagatacagcactatattactgtgtaagagacgaaagagaaagcgaatgtgaactatgggaatcagactattacaatttcgggaaaaattacccatgcgtaaaaccgagaggagtagcaggaacactagatatatggggacaaggaacaacagtaatagtaagctca

SEQ ID NO: 47800 - RNA, 438 nt, synthetic construct
  misc_feature 1..438: note = derived and/or modified sequence opt6 from anti-HIV_cap256-119-026279_VR-Chain
  source 1..438: mol_type = other RNA
caaatgcaattagtagaaagtggaggaggagtagtacaaccaggaacaagcttaacattaagctgtgcagcaagtcaattctcattcacaagttatggaatgcactgggtaagacaagcaccaggaaaaggattagaatgggtggcatcaatatcaaacgatggaacaaaaaaataccatgcagaaagcgtatggggaagatttacaataagcaaagacaatagcaaaaacacactatttctacaaatgaatagcttaagagtagaagatacagcactatatttctgtgtaaaagaccaaagagaagatgaatgcgaagaatggtggtcagactattacgatttcggaagagaactaccatgcagaaaatcaagaggactaggactagcaggaatattcgatatatggggacatggaacagtagtaatagtaagttca

SEQ ID NO: 47801 - RNA, 432 nt, synthetic construct
  misc_feature 1..432: note = derived and/or modified sequence opt6 from anti-HIV_cap256-119-025355_VR-Chain
  source 1..432: mol_type = other RNA
gaagtacaattagtagaaagtggaggaggactagtacaaccaggaagaagtttaagactaagttgtgcagcaagtgggtttagttttagtgattatgcaatgcattgggtaagacaagcaccaggacaaggattagaatgggtagcatttataagttatgatggaacaaaaaaatatcatagtgatagtgtatggggaagattaacaataagtagagataatagtagaaatacattatttttacaaatgaatagtttaagaacagaagatacagcattatatttttgtgtaagagatcaaagagaagatgattgtgaagaatggtggagtgattattatgattttggaaaaaaattaccatgtagaaaatcaagaggattagcaggaatatttgatatatggggacatggaacgatggtaacagtaagtagt

SEQ ID NO: 47802 - RNA, 432 nt, synthetic construct
  misc_feature 1..432: note = derived and/or modified sequence opt6 from anti-HIV_cap256-119-025301_VR-Chain
  source 1..432: mol_type = other RNA
caagtacacttagtagcaagcggaggaggagtagtaccaccaggaagaagcttaagattaagctgtgtagcaagccaattcacattctcaggatttggattatactgggtaagacaagcaccaggaaaaggattagaatgggtagcagcaatatcattcgcaggaacaaaaaaacactatgcaaatagcgtaaaaggaagatttacaataagcagagacaatagtaaaaacacactatatctacaaatgaatagcttaagaccagacgatacagcattatattactgtgcaaaagacttaagagaatacgaatgcgaagaatggacatcagactattacgatttcggaagaccacaaccatgcatagactcaagaggagtagtaggaatactagatatatggagccaaggaacaatggtaacagtaagttca

SEQ ID NO: 47803 - RNA, 438 nt, synthetic construct
  misc_feature 1..438: note = derived and/or modified sequence opt6 from anti-HIV_cap256-119-025010_VR-Chain
  source 1..438: mol_type = other RNA
caagtacaattagtagaaagcggaggaggagtagtacaaccaggaagaagtttaagattaagctgtccagcaagcggattctcattctcaacatatggaatgcactgggtaagacaagcaccaggaaaaggactagaatgggtagcatcaatatcaaacgatggaaataaaaaataccatggagaaagtgtatgggatagatttacaataagcagagacaatagcaaaaatacactatttctacaaatgaatagattgagagtagaagatacagcactatatttctgtgtaaaagaccaaagagaagacgaatgcgaagaatggtggtcagactattacgatttcggaagagaactaccatgcagaaaatttagaggactaggactagcaggaatattcgatgtatggggacatggaacaatggtaacagtaagctca

SEQ ID NO: 47804 - RNA, 432 nt, synthetic construct
  misc_feature 1..432: note = derived and/or modified sequence opt6 from anti-HIV_cap256-119-024631_VR-Chain
  source 1..432: mol_type = other RNA
caagtacaattaatggaaagtggaggaggggtagtacaaccaggaggaagtttaagattaagttgtgcggcaagtggatttacatttagtagttatggaatgcattgggtaagacaagcaccaggaaaaggattagaatgggtagcaggaataagttatgatggaagtgataaatatcatgcacattttgtatggggaagatttataataagtagagataatagtaaaaatgcattatatttacaaatgaatagcttaagaccagaagatacagcattatatttttgtgtaagagatttaagagaaagtgaatgtgaagaatggcaaagttattattatgattttgggagaaaaggaccatgtttaaaaccaagaggagtagcaggaagttttgatatatggggacaaggaacagtagtaacagtaagtagt

SEQ ID NO: 47805 - RNA, 432 nt, synthetic construct
  misc_feature 1..432: note = derived and/or modified sequence opt6 from anti-HIV_cap256-119-024467_VR-Chain
  source 1..432: mol_type = other RNA
gaagtacaattagtagaaagtggaggaggattagtacaaccaggaggaagtctaaatgtaagctgtgcagcaagtggattcacattcagaacatatgcaatgcactgggtaagacaagcaccaggaaaaggactagaatgggtagcagcaatatcatatgatggagataataaatattcagcagatagtgtaaaaggaagatttacaataagcagagaccaaagcaaaaacacactatatttacaaatgaatagcgtaagagtagaagatacagcaagatattactgtgcaagagacatgagagaatatgaatgtgaattatgggcatcagactattatgatttcggaaaaccacaaccatgtgaagacccaagaggagtagtaggaacattcgatatgtggggattaggaacattagtaacagtaagttca

SEQ ID NO: 47806 - RNA, 432 nt, synthetic construct
  misc_feature 1..432: note = derived and/or modified sequence opt6 from anti-HIV_cap256-119-023805_VR-Chain
  source 1..432: mol_type = other RNA
caagtacaattagtagaaagtggaggaggagtagtacaaccaggaaaaagtttaagattaagttgtgcagcaagtcaatttggatttggaagttatggaatgcattgggtaagacaagcaccaggaaaaggattagaatgggtagcaacaataagttttgatggagcagataaatatcatgcagatgatgtatggggaagatttagtataagtagagataatagtaaaaatacattatatttacaaatgaataatttaagaccagaagatacagcattatattattgtgcaaaagatttaagagaagatgaatgtgaagaaagatggtcagattattatgattttggaaaacaattaccatgtagaaaatcaagaggagtagcaggagtatttgataattggggacaaggaacaatggtaacagtaagtagt

SEQ ID NO: 47807 - RNA, 432 nt, synthetic construct
  misc_feature 1..432: note = derived and/or modified sequence opt6 from anti-HIV_cap256-119-021736_VR-Chain
  source 1..432: mol_type = other RNA
caagtacaattagtagaaagtggaggaggagtagtacaaccaggaagaagtgtaagattaagttgtgtagcaagtcaatttagttttgatagatatggaatgcattgggtaagacaagcaccaggaaaaggattagaatgggtagcaagtataagttatgatggtacagataaatatcatgcagataaagtatggggaagatttacaataagcagagataatagtaaaaaaacattatatttacaaatgaatagtttaagaccagaagatgcagcattatattattgtgcaaaagatttaagagaagatgaatgtgaagaatggtggagtgattattatgattttggaaaacaattaccatgtagaaaaagtagaggagtagcaggaatatttgatagttggggacaaggaacaatggtaacagtaagtagt

SEQ ID NO: 47808 - RNA, 438 nt, synthetic construct
  misc_feature 1..438: note = derived and/or modified sequence opt6 from anti-HIV_cap256-119-021203_VR-Chain
  source 1..438: mol_type = other RNA
caaatgcaattagtagaaagtggaggaggagtagtacaaccaggaagaagtttaacattaagttgtgctgcaagtcaatttacattttcaaattatggaatgcattgggtaagacaagcaccaggaaaaggattagaatgggtagcatcagtaagtaatgatggaacaaaaaaatatcatggagatagtgtatgggatagatttacaataagtagagataatagcaaaaatacattatttttacaaatgagtagcttaagagcagaagatacagcagtatatttttgtgtaagagatgaaagagaagatgaatgtgaagaatggtggtcggattattatgattttggaagagaattaccatgtagaaaatttagaggattaggattagcaggaatatttgatatatggggacatggaacattagtaacagtgagtagt

SEQ ID NO: 47809 - RNA, 432 nt, synthetic construct
  misc_feature 1..432: note = derived and/or modified sequence opt6 from anti-HIV_cap256-119-020569_VR-Chain
  source 1..432: mol_type = other RNA
caagtacaattagtagaaagcggaggaggagtagtacaaccaggagaatcattaagaataagctgtgcagcaagccaattcacattctcaagatatggaatgcactgggtaagacaagcgccaggaaaaggactagaatgggtagcatcaatatcattcgatggaagagacaaataccatagcagcctagtgtggggaagattaacaataagcagagacaatagcaaaagcacactatttctacaaatgaatagcttaagaccagaagatacagcactatattactgtgcaagagacgtaagagaaagcgaatgcgaagaatggcaatcagattattacgcattctatagaaaattaccatgcgtaaaaccaagaggagtagcaggaacactagatatatggggacaaggaacaatggtaacagtaagctca

SEQ ID NO: 47810 - RNA, 432 nt, synthetic construct
  misc_feature 1..432: note = derived and/or modified sequence opt6 from anti-HIV_cap256-119-019432_VR-Chain
  source 1..432: mol_type = other RNA
caagtacaattagtacaaagtggaggaggagtagtgcaaccaggaagaagcttaagaataagttgtgcagcaccatattttacatttggaagatatggatttcattgggtaagacaagcaccaggaaaaggattagaatgggtagcaagtataagttttgatggaagagattattatcatagtccacatgtatggggaagattaacaataagtagagataatagtaaaaatacattatatctacaaatgaatagcttaagagcagaagatacagcactatattattgtgcaagagatttaagagaaagtgaatgtgaagaatgggaatcagattattatgattttggaaaaaaaggaccatgtgtaaaaccaagaggagtagcaggatcattagatatgtggggacaaggaacaatggtaacagtaagtagt

SEQ ID NO: 47811 - RNA, 432 nt, synthetic construct
  misc_feature 1..432: note = derived and/or modified sequence opt6 from anti-HIV_cap256-119-018827_VR-Chain
  source 1..432: mol_type = other RNA
caagcacaattagtagaaagtggaggaggagtagtacaaccaggaagaagtttaagattaagttgtgcagcaagtcattttagttttaataggtatggaatgcattgggtaagacaagcaccaggaaaaggattagaatgggtagcaggaataagttatgatggaagagatttttatcatgcagatatagtatgggggagattaacaataagtagggataatagtaaaaatacagtatatttacaaatgaatagtttaagagcagatgatacaggattatattattgtgcaagagatgtaagagaaagcgaatgtgaagaatgggaaagttattattatgattttggaagaaaaggaccatgtttaaaaccaagaggagtagcaggaacatttgatatgtggggacaaggaacaatagtaagtgtaagtgca

SEQ ID NO: 47812 - RNA, 432 nt, synthetic construct
  misc_feature 1..432: note = derived and/or modified sequence opt6 from anti-HIV_cap256-119-018483_VR-Chain
  source 1..432: mol_type = other RNA
ctagtacaattagtagaaagtggaggaggagtagtacaaccaggaaaaagtttaagattaagctgtgtagcaagccaattcacatttaatagatatggaatgcactgggtaagacaagcaccaggaaaaggactagaatgggtagcaggaatatcatatgatggaagagacaaataccatgcacatttcgtatggggaagaataacaataagcagagacaatagcaaaaacacactatatttacaaatgaatagtctaagagcagaagatacagcactatatcactgtgtaagagacttaagagaaagtgaatgtgaactatgggaatcagactattacgatttcggaaaaaaattaccatgcgtgaaaccaagaggagtagcaggaatattcgatttatggggacaaggaacaatggtaacagtaagttca

SEQ ID NO: 47813 - RNA, 432 nt, synthetic construct
  misc_feature 1..432: note = derived and/or modified sequence opt6 from anti-HIV_cap256-119-018118_VR-Chain
  source 1..432: mol_type = other RNA
caagtacacttagtagcaagcggaggaggagtagtaccaccaggaagaagtttaacattaagctgtgtagcaagccaattcacattctcaggatgtggattacactgggtaagacaagcaccaggaaaaggactagaatgggtagcatcaatatcattcgcaggaacaaaaaaacactatggaaatagcgtaaaaggaagatttacaataagcagagacaatagtaaaaacacactatatttacaaatgaatagcttaagaccagaagatacagcactatattactgtgcaaaagacttaagagaatacgaatgcgaagaatggacatcagactattacgatttcggaagagatcaaccatgcatagactcaagaggagtagtaggaatactagatatatggggacaaggaacaatggtaacagtaagctca

SEQ ID NO: 47814 - RNA, 432 nt, synthetic construct
  misc_feature 1..432: note = derived and/or modified sequence opt6 from anti-HIV_cap256-119-017782_VR-Chain
  source 1..432: mol_type = other RNA
caagtacaattagtagaaagcggaggaggagtagtacaaccaggaaaaagcttaagattaagctgtgcagcaagcggattcccattctcaaactatgcaatgcactgggtaagacaaacaccaggaagaggactagaatgggtagcagggatatcattcgcagcaacaaaaaaatactatagaccaagcgtaagaggaagatttacagtaagcacagacataagcaaaaacacactatatttagaaatgaatagcttaagaccagaagatacagcactatatttctgtgcaagagaccaaagatattacgaatgcgaagaatgggcatcagactattacgatttcggaagagaacaaccatgcttagacccaagaggagtagtaggaatattcgatctatggggacaaggaacaatggtaacagtaagctca

SEQ ID NO: 47815 - RNA, 432 nt, synthetic construct
  misc_feature 1..432: note = derived and/or modified sequence opt6 from anti-HIV_cap256-119-017669_VR-Chain
  source 1..432: mol_type = other RNA
caagtacaattagtagaaagcggaggaggagtagtacaaccaggatcaagtttaagattaagttgtgcagcaagtcattttgcatttaatagatatggaatgcactgggtaagacaagcaccaggaaaaggattagaatgggtagcaggaatatcatttgatggagcagacaaatttcatgcagataaagtatggggaagatttacaataagcagagacaatagtaaaaatacattatcattacaaatgaatagcttaagaccagaagatacagcattatattattgtgcaaaagatttaagagaagatgaatgcgaagaatggtggtcagactattatgatttcggaagaagactaccatgtagaaaatcaagaggagtatcaggaatatttgataattggggacaaggaacaatggtaacagtaagttca

SEQ ID NO: 47816 - RNA, 432 nt, synthetic construct
  misc_feature 1..432: note = derived and/or modified sequence opt6 from anti-HIV_cap256-119-016976_VR-Chain
  source 1..432: mol_type = other RNA
caagtacaattagtagaaagtggaggaggagtagtacaaccaggaagaagtttaagattaagttgtgcagcaagtcaattttcatttggagattttggaatgcattgggtaagacaagcaccaggaaaaggattagaatgggtagctgcaatatcatttgcaggaacaaaaaaaaattatgcagatagtgtaagaggaagatttacaataagtagagattcaagtaaaaatacattatatttacaaatgaatagtttaagaccagaagatacagcattatattattgtgtaaaagatatgagaggatatgaatgtgaagaatggacatcagattattatgattttggaagaccacaaccatgtatagattcaagaggagtagtaggaacatttgatgtatggggacaaggaacaatggtaacagtaagttca

SEQ ID NO: 47817 - RNA, 432 nt, synthetic construct
  misc_feature 1..432: note = derived and/or modified sequence opt6 from anti-HIV_cap256-119-015432_VR-Chain
  source 1..432: mol_type = other RNA
gaagtacaattactagaaagcggaggaggattagtacaaccaggaggaagcctaagattaagctgtgcagctagcggattcacattttcaggatatagtttaaactgggtaagacaagcaccaggaaaaggattagaatgggtagcatcaatatcgtacgatggatcagacaaataccatgcagatagagtatggggaagatttacaataagtagagacaatagtaaaaacacactatatctacaaatgaatagcttaagagcagaagatacagcactatattactgtgtaagagacgcaagagaaagcgaatgcgaactatgggaaagtgactattacaatttcggaagaaaactaccatgtgtaaaaccaagaggagtagcaggaacactagatatatggggacaaggaacaatggtaacagtaagctca

SEQ ID NO: 47818 - RNA, 432 nt, synthetic construct
  misc_feature 1..432: note = derived and/or modified sequence opt6 from anti-HIV_cap256-119-015281_VR-Chain
  source 1..432: mol_type = other RNA
ctaggaagattagtagcgagcggaggaggagtagtaccaccaggaagaagcttaagattaagctgtgtagcaagtcaatttacattttcaggatgtggattacactgggtaagacaagcaccaggaaaaggactagaatgggtagcatcaataagttttgcaggaacaaaaaaacattatggaaatagcgtaaaaggaagatttacaataagtagagacaatagtaaaaatacagtatatttagaaatgaatagcttaagagcagaagatacagcactatattactgtgctaaagatttaagagaatatgaatgtgaagaatggacatcagactattatgatttcggaagaccacaaccatgtatagactcaagaggagtagtaggaatattagatatatggggacaaggaacaatggtaacagtaagttca

SEQ ID NO: 47819 - RNA, 432 nt, synthetic construct
  misc_feature 1..432: note = derived and/or modified sequence opt6 from anti-HIV_cap256-119-014957_VR-Chain
  source 1..432: mol_type = other RNA
caagtacaagtagtagaaagtggaggaggagtagtacaaccaggaacaagcctaagattaagctgtacagtaagcggattctcattctcaaactatgacttacactgggtaagacaaacaccagcaaaaggactagaatgggtagcagtagtatcatacgatggatcaagagaatactatacagatagcgtaaaaggaagatttataataagcagagaccaaagcaaaaacacactatatttacaaatgaatagtgtaagattagaagatacagcacgatattactgtgcaagagacatgagagaatacgaatgcgaactatgggcatcagactattacgatttcggaaaaccacaaccatgcgaagacccaagaggagtagtaggaacattcgatatgtggggattaggaacattagtaacagtaagctca

SEQ ID NO: 47820 - RNA, 432 nt, synthetic construct
  misc_feature 1..432: note = derived and/or modified sequence opt6 from anti-HIV_cap256-119-014777_VR-Chain
  source 1..432: mol_type = other RNA
caagtacatttagtagaaagtggaggaggagtagtacaaccaggaagaagtttaagattaagttgtgcagcaagtcattttagtctatcaagttatggaatgcattgggtaagacaagcaccaggaaaaggattagaatgggtagcaggaataagttttgcagcaacaaaaacatattatggaggaagtgtgaaaggaagatttacagtaagtagagatataagtaaaaatacattatatttacaaatgaatagtttaagaccagaagatacagcaatgtattattgtgcaagagatcaaagatattatgaatgtgaagaatgggcaagtgattattatgattttggaagagaacaaccatgtcaagatccaagaggagtagtaggagtatttgatatgtggggacaaggaacaatggtaacagtaagtagt

SEQ ID NO: 47821 - RNA, 432 nt, synthetic construct
  misc_feature 1..432: note = derived and/or modified sequence opt6 from anti-HIV_cap256-119-014313_VR-Chain
  source 1..432: mol_type = other RNA
caagtacaattagtagaaagcggaggaggagtagtacaaccaggaagaagtttaagaataagttgtgcagcaagccaatttacatttagcagatatggaatgcattgggtaagacaagcaccaggaaaaggattagaatgggtagcaagtataagttatgatggaagagattatcatcatgcaggagcagtatggggaagatttataataagtagagataatagcaaaaatagtttacatctacaaatgaatagtttaagaccagaagatacagcattatatttttgtgcaagagatttaagagaaagtgaatgtgaagaatgggaaagtgattattataatttttggaaaaaattaccatgtgtaaaaccaaggggagtagtaggaatattagatatatggggacaaggaacagtagtaacagtaagtagt

SEQ ID NO: 47822 - RNA, 438 nt, synthetic construct
  misc_feature 1..438: note = derived and/or modified sequence opt6 from anti-HIV_cap256-119-014219_VR-Chain
  source 1..438: mol_type = other RNA
caaatgcaattagtagaaagcggaggaggagtagtgcaaccaggatcaagcttgacattaagttgtgcagcaagccaattcacattctcaaactatggaatgcactgggtaagacaagcaccaggaaaaggactagaatgggtagcatcaatatcaaacgatggaacaaaaaaataccatggagatagcgtatgggatagatttacaataagcagagacaatagtaaaaacacactatttctacaaatgaatagcttaagagcagaagatacagcactatatttctgtgtaaaagaccaaagagaagacgaatgcgaagaatggtggtcagactattacgatttcggaagagaactaccatgcagaaaatttagaggactaggactagcaggaacatttgatatatggggacatggaacaatgttaatagtaagctca

SEQ ID NO: 47823 - RNA, 432 nt, synthetic construct
  misc_feature 1..432: note = derived and/or modified sequence opt6 from anti-HIV_cap256-119-013631_VR-Chain
  source 1..432: mol_type = other RNA
caagtacaattagtagaaagcggaggaggagtagtacaaccaggaagaagtttaagattaagttgtgcagcaagtcaattcacattcggaagttatggaatgcactgggtaagacaaataccagggaaaggactagaatgggtagcaacaatatcatatgatggaacaaaaaaataccatgcagatagtgtatgggatagatttataataagcagagacaatagcaaaaacacattatttctacaaatgaatagtttaagaccagaagatacagcattatatttctgtgtaaaagaccaaagacaagacgaatgcgaagaatggtggtcagactattatgatttcggaagaagactaccatgcagaaaatcaagaggactagcaggaatattcgatgtatggggacatggaacaatggtaacagtaagctca

SEQ ID NO: 47824 - RNA, 432 nt, synthetic construct
  misc_feature 1..432: note = derived and/or modified sequence opt6 from anti-HIV_cap256-119-012924_VR-Chain
  source 1..432: mol_type = other RNA
caagtaacattagtagaaagtggaggaggatttgtacaaccaggaggaagtttaagattaagttgtgcaacaagtggatttacatttagtagttatgcaatgcattgggtaagacaagcaccaggaaaaggattagaatgggtagcagcgatatcatttgatggagcagataaatatcatgcagataatgtatggggaagattaagtataagtagagataatagtaaaagtacattatatttacaaatgaatagtttaagaccagaagatacagcagtatatttttgtgcaaaagatttaagagaagatgaatgtgaagaaagatggagtgattattatgattttggaaaacaattaccatgtagaaaaagtagaggagtagcaggaatatttgataattggggacaaggaacaatggtaacagtaagtgca

SEQ ID NO: 47825 - RNA, 432 nt, synthetic construct
  misc_feature 1..432: note = derived and/or modified sequence opt6 from anti-HIV_cap256-119-011793_VR-Chain
  source 1..432: mol_type = other RNA
caagtacaattagtagaaagtggaggaggagtagtacaaccgggaggaagtttaagattaagttgtgtagcaagtcaatttacatttagtagatatggaatgcattgggtaagacaagcaccaggaaaaggattagaatgggtagcaagtataagttatgatggaagagataaatatcatgcagattttgtatggggaagattaacaataagtagagatgatagtaaaaaaacattatatctacaaatggatagtttaagagtagatgatacagcattatattattgtgtaagagatatgagagaaagtgaatgtgaattatgggaatcagattattatgattttggaaaaagattaccatgtgtaaaaccaagaggagtagcaggaatatttgatatatggggacaaggaacaatggtaacagtaagttca

SEQ ID NO: 47826 - RNA, 432 nt, synthetic construct
  misc_feature 1..432: note = derived and/or modified sequence opt6 from anti-HIV_cap256-119-011413_VR-Chain
  source 1..432: mol_type = other RNA
caagtacaattagtagaaagcggaggagatgtagtacaaccaggaagaagtttaagattaagctgtgcagcaagcggattcacattttcaacatatggaatgcactgggtaagacaagcaccagggaaaggattagaatgggtagcagcaatatcatttgcaggaacaaaaaaaaattatgcagatagtgtaagaggaagatttacaataagcagagacagtagtaaaaatacactatatttagaaatgaatagtttgagaccagaagatacagcattatattattgtgcaaaagacatgagaggatatgaatgtgaagaatggacatcagactattatgatttcggaagaccacaaccatgtatagacagtagaggagtcgtaggaacatttgatgtatggggacaaggaacaatggtaacagtaagttca

SEQ ID NO: 47827 - RNA, 432 nt, synthetic construct
  misc_feature 1..432: note = derived and/or modified sequence opt6 from anti-HIV_cap256-119-011323_VR-Chain
  source 1..432: mol_type = other RNA
caagtaaaattagtagaaagcggaggaggagtagtaccaccaggaaaaagtctaagattaagctgtacagcaagccaattcacattctcaaactttggaatgcactgggtaagacaagcaccaggaaaaggactagaatgggtagcatcgatatcattcgtaggaataaaaacacactatgcaaatagcgtaagaggaagatttacaataagtagagaccaaagcaaaaacacactatatctacaaatgaatagtgtaagagtagaagatacaggaagatattactgtgcaagagacatgagagaatacgaatgcgaactatgggcatcagactattacgatttcggaaaaccacaaccatgcgaagacccaagaggagtagtaggaacattcgatatgtggggattaggaacattagtaacagtaagttca

SEQ ID NO: 47828 - RNA, 432 nt, synthetic construct
  misc_feature 1..432: note = derived and/or modified sequence opt6 from anti-HIV_cap256-119-011233_VR-Chain
  source 1..432: mol_type = other RNA
caagtacatttagtagaaagcggaggaggagtagtacaaccaggaagaagtgtaagattaagttgtgcagcaagccatttttcattatcaagttatggaatgcactgggtaagacaagcaccaggaaaaggattagaatgggtaacaggaatatcatttgcaggaacaaaaacatattatggagatagcgtaagaggaagatttacagtaagcagagacataagtaaaaatacattatttttacaaatgaatagtttaagaccagacgatacagcaatgtattattgtgcaagagatcaaagatattatgaatgtgaagaatgggcaagtgattattatgatttcggaagagaacaaccatgtctagatccaagaggagtagtaggaatatttgatttatggggacaaggaacaatggtaacagtaagttca

SEQ ID NO: 47829 - RNA, 432 nt, synthetic construct
  misc_feature 1..432: note = derived and/or modified sequence opt6 from anti-HIV_cap256-119-009038_VR-Chain
  source 1..432: mol_type = other RNA
caagaacaattagtagaaagtggaggaggagtagtacaaccaggaagaagtttaagattaagttgtgtagcaagtagatttacatttagtgcatttggaatgcattgggtgagacaagcaccaggaaaaggattagaatgggtagcaagcataagttttgcaggaataaaaaaatattatggagatagtgtaaaaggaagatttacaataagtagagataatagcaaaaatacattatatttacaaatggatggattaagaggagaagatacagcactatattattgtgcaaaagatttaagagaattagaatgtgaagaatgggcaagtgattattatgattttggaagaccacaaccatgtttagatccaagaggagtaagtggaataagtaatgtatggggacaaggaacaatggtaacagtaagtagt

SEQ ID NO: 47830 - RNA, 432 nt, synthetic construct
  misc_feature 1..432: note = derived and/or modified sequence opt6 from anti-HIV_cap256-119-008756_VR-Chain
  source 1..432: mol_type = other RNA
caagtacaattagtagaaagcggaggaggagtagtacaaccaggaaaaagtttaagattaagttgtgtagtaagtcaattcacatttggaagatatggaatgcactgggtaagacaagcaccagggaaaggattagaatgggtagcatcaatatcgtatgatggatcagacaaatatcatacatcaagtttatggggacgatttatagtaagcagagacaatagcaaaaacacattatatctacaaatgaatagtttaagaccagaagatacagcattatattactgtgtaagagacagaagagaaagtgaatgtgaagaaagatggtcagactattacgattttggaaaacaattaccgtgtgtaaaaccaagaggagtagcaggaatatttgatatatggggacaaggaacaatggtaacagtaagttca

SEQ ID NO: 47831 - RNA, 438 nt, synthetic construct
  misc_feature 1..438: note = derived and/or modified sequence opt6 from anti-HIV_cap256-119-008055_VR-Chain
  source 1..438: mol_type = other RNA
caaatgcaattagtagaaagcggaggaggagtagtacaaccaggaagaagtttaacattaagctgtgcagcaagccaattctcattcgcaaactatggaatgcactgggtaagacaagcaccaggaaaaggactagaatgggtagcatcaatatcaaacgatggaacaaaaaaataccatgaagaaagcgtatggggaagatttacaataagcaaagacaatagcaaaaacacactatttctacaaatgaatagtttaagaatagaagatacagcactatatttctgtgtaaaagaccaaagagaagacgaatgcgaagaatggtggtcagactattacgattttggaagagaactaccatgcagaaaatcaagaggactaggactagcaggaatattcgatatgtggggacatggaacaatggtaacagtaagctca

SEQ ID NO: 47832 - RNA, 435 nt, synthetic construct
  misc_feature 1..435: note = derived and/or modified sequence opt6 from anti-HIV_cap256-119-006949_VR-Chain
  source 1..435: mol_type = other RNA
caagtacatctagtagaaagtggaggaggagtagtacaaccaggaagaagtttaagattaagttgtgcagcaagcggattcagtgtaagtaataattatatgaattgggtaagacaagcaccaggagaaggactagaatgggtagcattaataagttttgatggaagacaaaaagatttagcagatagtgtaaaaggaagatttgcaataagtagagataatagtaaaaatacattatatttacaaatgaatagtttaagattagaagatacagcattatattattgtgcaagagatttaagagaattagattgtgaagaatggacattatataattattatgattttggaagtagaggaccatgtgtagatccaaggggagtaggaggaagttttgatgtatggggacaaggaacaatggtaacagtaagtagt

SEQ ID NO: 47833 - RNA, 432 nt, synthetic construct
  misc_feature 1..432: note = derived and/or modified sequence opt6 from anti-HIV_cap256-119-006685_VR-Chain
  source 1..432: mol_type = other RNA
caagtacaattagtagaaagcggaggaggggtagtacaaccaggaagaagtttaagagtaagctgtgcagcaagtcatttcacgttttcaagatatggaatgcattgggtaagacaagcaccaggaaaaggactagaatgggtagcatcaatatcatatgatggaagagacttttatcatgcaagaagcgtatggggaagatttacaataagcagagacaatagcaaaaacacactacatttacaaatgaatagtttaagaccagaagatacagcactatatttctgtgcaagagacttaagagaaagcgaatgtgaagaatgggaatcatattattacgatttcggaaaaaaaggaccatgtgtaaaaccgagaggagtagtaggagtattagatatatggggacaaggaacactagtaacagtaagttca

SEQ ID NO: 47834 - RNA, 432 nt, synthetic construct
  misc_feature 1..432: note = derived and/or modified sequence opt6 from anti-HIV_cap256-119-006015_VR-Chain
  source 1..432: mol_type = other RNA
caagtacaattagtagaaagtggaggaggagtagtacaaccaggaaaaagtttaagattaagctgtgcagcaagtagatttacatttaatagatatggaatgcattgggtaagacaagcaccaggaaaagggttagaatgggtagcagcaataagttttgatggaacagataaatatcatagcgatgatgtatggggaagatttacaataagtagagataatagtaaaaatacattatatctacaaatgaatagtttaagaccagaagatacagcattatattattgtgcaaaagatttacaagaagatgaatgtgaagaatggtggtcagattattatgattttggaaaacaattaccatgtagaaaaagtagaggagtagcaggaatatttgatgattggggacaaggaacaatggtaacagtaagtagt

SEQ ID NO: 47835 - RNA, 432 nt, synthetic construct
  misc_feature 1..432: note = derived and/or modified sequence opt6 from anti-HIV_cap256-119-005841_VR-Chain
  source 1..432: mol_type = other RNA
caagtacaattagtagaaagtggaggaggagtagtacaaccaggaagaagtttaagattaagttgtgcagcaagccaattctcattcggaaactttggaatgcactgggtaagacaagcaccaggaaaaggactagaatgggtagcagcaatatcattcgcaggaacaaaagaaaactatgcaaatagtgtaagaggaagatttacaataagcagagacaatagcaaaaacacactatatctacaaatgaatagcttaagagcagaagatacagcactatattactgtacaaaagacatgagagaatacgaatgcgaagaatggacatcagactattacgatttcggaagaccacaaccatgcatagactcaagaggagtagtaggaacattcgatgtatggggacaaggaacaatggtaacagtaagttca

SEQ ID NO: 47836 - RNA, 432 nt, synthetic construct
  misc_feature 1..432: note = derived and/or modified sequence opt6 from anti-HIV_cap256-119-005824_VR-Chain
  source 1..432: mol_type = other RNA
caagtacaattagtagaaagtggaggaggagtagtacaaccaggaggaagtttaagattaagttgtgcagcaagtggatttacatttagaagatatgcaatgcattgggtaagacaagcaccaggaaaaggattagaatgggtagcatcaatatcatatgatggaagtgataaatatcacacatcaagtttatggggaaggtttatagtaagtagagataatagtaaaaatacattatatttacaaatgaatagtttaagaccagaagatacagcattatattattgtgtaagagatagaagagaaagtgaatgtgaagaaagatggagtgattattatgattttggaaaacaattaccatgtgtaaaaccaagaggagtagcaggaatatttgatatatggggacaaggaacaatggtaacagtaagtagt

SEQ ID NO: 47837 - RNA, 432 nt, synthetic construct
  misc_feature 1..432: note = derived and/or modified sequence opt6 from anti-HIV_cap256-119-005494_VR-Chain
  source 1..432: mol_type = other RNA
caagtaagattagtagaaagcggaggaggagtagtacaaccaggaaggagcttaagaataagctgtgcagcaagccaattcatgttcaataaatatggaatgcactgggtaagacaagcaccaggaaaaggactagaatgggtagcatcaatatcatatgatggatcagacaaataccatgcagatctagtatggggaagatttacaataagcagagacaatagcaaaaacacattatatttacaaatgaatagcttaagagcagaagatacagcactatattactgtgtaagagacgcaagagaaagcgaatgcgaactatgggaatcagactattacaatttcggaagaaaactaccatgtgtaaaaccaagaggagtagcaggaacattagatatatggggacaaggaacaatggtaacagtaagctca

SEQ ID NO: 47838 - RNA, 432 nt, synthetic construct
  misc_feature 1..432: note = derived and/or modified sequence opt6 from anti-HIV_cap256-119-004949_VR-Chain
  source 1..432: mol_type = other RNA
caagtacaattagtagaaagcggaggaggagtagtacaaccaggaagaagcttaagattaagctgtgcagcaagcaaattctcactatcaagctatggaatgcactgggtaagacaagcaccaggaagaggactagaatgggtagcaggaatatcattcgcagcaacaaaaaaatactatagaccgagcgtaagaggaagatttacagtaagcacagacataagtaaaaacacattatatctagaaatgaatagcttaagaccagaagatacagcactatatttctgtgcaagagatcaaagatattacgaatgcgaagaatgggcatcagactattacgatttcggaagagaacaaccatgcttagacccgagaggagtagtaggaatattcgatctatggggacaaggaacaatggtaacagtaagttca

SEQ ID NO: 47839 - RNA, 432 nt, synthetic construct
  misc_feature 1..432: note = derived and/or modified sequence opt6 from anti-HIV_cap256-119-004422_VR-Chain
  source 1..432: mol_type = other RNA
cacgtacaattagtagaaagtggaggaggagtagtacaaccaggaagaagtttacgattaagttgtgcagcaagtggactatcattctcaagttatgcaatgcactgggtaagacaagcaccaggaaaaggactagaatgggtagcagtagtatcatatgatggaacaacaaaattctatgcagatagcgtaaaaggaagatttacaataagtagagacaatagtaaaaacacattatatttacaaatgaatagcttaagaggagaagatacagcactatattactgtgcaaaagacttaagagaatatgaatgcgaagaatggacatcagactattatgatttcggaagaccacaaccatgcatagactcaagaggagtagtaggcatactagatatatggagtcaaggaacaatggtaacagtaagttca

SEQ ID NO: 47840 - RNA, 432 nt, synthetic construct
  misc_feature 1..432: note = derived and/or modified sequence opt6 from anti-HIV_cap256-119-003932_VR-Chain
  source 1..432: mol_type = other RNA
caagtacaattattagaaagtggaggaggagtagtacaaccaggaggaagtttaagattaagttgtaaagcaagtcatttcagttttgatagatatggaatgcattgggtaagacaagcaccaggaaaaggactagaatgggtagcagcaataagttttgatggagcagacaaatatcatgcagataatgtgtgggggagattgagtataagtagagataatagtaaaagtacattatatttacaaatgaatagtttaagaccagaagatacagcagtatatttttgtgcaaaagatttaagagaagatgaatgtgaagaaagatggtcagactattatgattttgggaaacaattaccatgtagaaaatcaagaggagtagcaggaatatttgataattggggacaaggaacaatggtaacagtaagtgca

SEQ ID NO: 47841 - RNA, 438 nt, synthetic construct
  misc_feature 1..438: note = derived and/or modified sequence opt6 from anti-HIV_cap256-119-003577_VR-Chain
  source 1..438: mol_type = other RNA
caagtacaattagtagaaagcggaggaggaggagtacaaccaggaagaagtttaagattaagttgtgcggcaagtggatttacatttagaagttatgcaatgcattgggtaagacaagcaccaggaaaaggattagaatgggtagcagtaataagtaatgatggaacaaaaaaatatcatgcagaaagtgtatgggatagatttagtataagtaaagataatagtaaaaatacattatttttacaaatgaatagtttaagagtagaagatacagcattatatttttgtgtaaaagatcaaagagaagatgaatgtgaagaatggtggagtgattattatgattttggaagagaattaccatgtagaaaaagtagaggactaggattagcaggaatatttgatatgtggggacatggaacaatggtaacagtaagtagt

SEQ ID NO: 47842 - RNA, 432 nt, synthetic construct
  misc_feature 1..432: note = derived and/or modified sequence opt6 from anti-HIV_cap256-119-002155_VR-Chain
  source 1..432: mol_type = other RNA
ctaggaagattagtagcaagcggaggaggagtagtaccaccaggaagaagtttaagattaagctgtgtagcaagtcaattcacattttcaggatgtggattacactgggtaagacaagtaccaggaaaaggactagaatgggtagcatcaatatcatttgcaggaacaaaaacacactacggaaatagcgtaaaaggaagatttagtataagcagagacaatagtataaacacagtatatctacaaatgaatagcttaagagcagaagatacagcactatattactgtgcaaaagacttaagagaatatgaatgtgaagaatggacatcagactattacgatttcggaagaccacaaccatgtatagactcaagaggagtagtaggaatactagatatatggagtcaaggaacaatggtaacagtaagttca

SEQ ID NO: 47843 - RNA, 432 nt, synthetic construct
  misc_feature 1..432: note = derived and/or modified sequence opt6 from anti-HIV_cap256-119-002017_VR-Chain
  source 1..432: mol_type = other RNA
caagtacaattagtagaaagtggaggaggagtagtacaaccaggaagaagtttaagattaagttgtgcagcaagtggatttacatttagttattatggaatacattgggtaagacaagcaccaggaaaaggactagaatgggtagcaagtataagttatgatgaaagagatttttatcatgcaagaagtgtatggggaagatttgcaataagtagagataatagtaaaaatacattacatctacaaatgaatagtttaagaccagaagatacagcattatatttttgtgcaagagatttaagagaaagtgaatgtgaagaatgggaaagttattattatgattttggaaaaaaaggaccatgtgtaaaaccaagaggagtagtaggagtattagatatatggggacaaggaacattagtaacagtaagtagt

SEQ ID NO: 47844 - RNA, 432 nt, synthetic construct
  misc_feature 1..432: note = derived and/or modified sequence opt6 from anti-HIV_cap256-119-001312_VR-Chain
  source 1..432: mol_type = other RNA
caagtacaattaatggaaagtggaggaggagtagtacaaccaggaagaagtttaagattagcatgtgcagcaagtggatttacattttcaagttatgcaatacactgggtaagacaagcaccagggaaaggattagaatgggtagcagcaataagttttgcaggaacaaaaaaaaattatgcagatagtgtgagaggaagatttacaataagcagagattcaagtaaaaatacattatatttagaaatgaatagtttaagaccagaagatacagcattatattactgtgcaaaagatatgcgaggatatgaatgtgaagaatggacatcagattattatgattttggaagaccacaaccatgtatagattcaagaggagtagtaggaacatttgatgtatggggacaaggaacaatggtaacagtaagttca

SEQ ID NO: 47845 - RNA, 438 nt, synthetic construct
  misc_feature 1..438: note = derived and/or modified sequence opt6 from anti-HIV_cap256-119-001017_VR-Chain
  source 1..438: mol_type = other RNA
caaatgcaattagtagaaagcggaggaggggtagtacaaccaggaagaagcttaacattaagctgtgcagcaagccaattctcattcacgaactatggaatgcactgggtcagacaagcaccaggaaaaggactagaatgggtagcatcaatatcaaacgatggaaataaaaaataccatggagaaagcgtatgggatagatttacaataagcagagacaatagtaaaaacacactatttctacaaatgaatagattaagagtagaagatacagcactatatttctgtgtaaaagaccaaagagaagacgaatgcgaagaatggtggtcagactattacgatttcggaagagaactaccatgcagaaaatttagaggactaggactagcaggaatatttgatgtatggggacatggaacaatggtaacagtaagttca

SEQ ID NO: 47846 - RNA, 432 nt, synthetic construct
  misc_feature 1..432: note = derived and/or modified sequence opt6 from anti-HIV_cap256-119-000594_VR-Chain
  source 1..432: mol_type = other RNA
caagtacaactagtagaaagcggaggaggattagtacaaccaggaacaagcttaagattaagctgtgcagcaagcgcattcacattcaaaaactatggaatgcactgggtaagacaagcaccaggaaaaggactagattgggtagcatcgatatcatacgatggaagagacaaataccatagctcactagtatggggaagactaacaataagcagagacaatagcaaaagtacattatttctacaaatgaatagcttaagagcagaagatacagcactatattactgtgcaagagacttaagagaaagcgaatgcgaagaatggcaatcagactattacgcattctataaaaaactaccatgcgtaaaaccaagaggagtagcaggaacactagatatatggggacaaggaacaatggtaacagtaagctcg

SEQ ID NO: 47847 - RNA, 432 nt, synthetic construct
  misc_feature 1..432: note = derived and/or modified sequence opt6 from anti-HIV_cap256-059-241099_VR-Chain
  source 1..432: mol_type = other RNA
caagtacaattagtagaaagtggaggaggagtagtacaaccaggaagaagtttaagattaagttgtgcagcaagtggatttacatttagtagttatggaatgcactgggtaagacaagcaccaggaaaaggattagaatgggtagcagtaataagttatgatggaagtaataaatattatgtagatagtgtacaaggaagatttacaataagtagagataatagtaaaaatacaatgtttttacaaatgaatagtttaagaacggaagatacagcagtatattattgtgcaagagatttaggagaaagtgaagtagaagaatgggcaacagattattatgattttagtatagcatatccagtagaaggaccaagaggagtagtaggaatatttgatatatggggacaaggaacaatggtaacagtaagtagt

SEQ ID NO: 47848 - RNA, 432 nt, synthetic construct
  misc_feature 1..432: note = derived and/or modified sequence opt6 from anti-HIV_cap256-059-207529_VR-Chain
  source 1..432: mol_type = other RNA
caagtacaattagtagaaagtggaggaggagtagtacaaccaggaagaagtttaagattaagttgtgcagcaagtggatttacatttagtagttatggaatgcattgggtaagacaagcaccaggaaaaggattagagtgggtagcaggaatatcatttgcaggaataaataaatattatggaaatagtgtaaaaggaagatttacaataagcagggataatagtaggaatacattatatctacaaatgaatagtttgagagcagaagatacagcattatattattgtgcaagagatttaagagaaatggaatgtgaagaatgggcaagtgattattatgattttggaagaggaggaccatgtcaagatccaagaggagtagtaggaacatttgatatatggggacaaggaacaatggtaacagtaagctca

SEQ ID NO: 47849 - RNA, 435 nt, synthetic construct
  misc_feature 1..435: note = derived and/or modified sequence opt6 from anti-HIV_cap256-059-205541_VR-Chain
  source 1..435: mol_type = other RNA
caaatgcaattagtagaaagtggaggaggagtagtacaaccaggaggaagtttaagattaagttgtgcagcaagtggatttagttttagttattatgcaatggattgggtaagacaagcaccaggaaaaggattagaatgggtagcatttataagtagtgatggaagcgataaaaattatgcagatagtgtaaaaggaagatttacaataagtagagataatagtaaaaatacattatatttacaaatgaatagtttaagagcagaagatacagcagtatattattgtgcaaaagatgtaggaggacataaaaatgatgaatgggcaacaaattattattatgatataagcatagcatatccaatacaagatccaagagcagtagcaggagcatttgatgtatggggacaaggaacaatggtaacagtaagtagt

SEQ ID NO: 47850 - RNA, 432 nt, synthetic construct
  misc_feature 1..432: note = derived and/or modified sequence opt6 from anti-HIV_cap256-059-188439_VR-Chain
  source 1..432: mol_type = other RNA
caagtacaattagtagaaagcggaggaggagtagtacaaccaggaaggagcttaagattaagctgtgcagcaagtcaattcacattctcaaattatggcatgcactgggtaagacaagcaccaggaaaaggattagaatgggtagcagcaatatcattcgcaggaataaacaaatactatacagatagcgtaaaaggaagatttacaataagcagagacaatagtaaaaacacactatatctacaaatgaatagtttaagagcagaagatacagcactatattactgtgcaaaagacttaagaggatttgaatgcgaagaatgggcatcagactattacgatttcggaagagatctaccatgccaagacccgagaggagtagtaggaacattcgatgtatggggacaaggaacaaaagtaacagtaagcagt

SEQ ID NO: 47851 - RNA, 432 nt, synthetic construct
  misc_feature 1..432: note = derived and/or modified sequence opt6 from anti-HIV_cap256-059-187234_VR-Chain
  source 1..432: mol_type = other RNA
caagtacaattagtagaaagcggaggaggagtagtacaagcaggaagaagtttgagattaagctgtgcagcgagtcaattcacattcggaagttatggaatgcactgggtaagacaagcaccaggaaaaggactagaatgggtagcagcaatatcattcgcaggaacaaaaatacactatgcagatagcgtaaaaggaagatttacaataagcagagacaatagcaaaaacgcactatatctacaaatgcatagcttaagagcagaagatacagcattatattactgtgcaaaagacttaagagaatacgaatgcgaagaatgggcatcggactattacgatttcggaagagatcaaccatgccaagacccaagaggagtagtaggaatattcgatatatggggacaaggaacaatggtaacagtaagctca

SEQ ID NO: 47852 - RNA, 432 nt, synthetic construct
  misc_feature 1..432: note = derived and/or modified sequence opt6 from anti-HIV_cap256-059-187047_VR-Chain
  source 1..432: mol_type = other RNA
caagtgcaattggtagaaagcggaggaggagtagtacaaccaggaagaagcttaagattaagctgtgcagtaagccaactaacattctcaagctatggaatgcactgggtaagacaagcaccaggaaaaggattagaatgggtagcagcaatatcattcgtaggaataaaaaaatactatgcagatagcgtgaaaggaagatttacaataagcagagacaatagtaaaaacacactatatctacaaatgaatagcttaagagtagaagatacagcactatattactgtgcaaaagacttaagagaatacgaatgcgaagaatgggcatcagactattacgatttcggaagagatcaaccatgccaagacgcaagaggagtagtaggaacaagcgatatatggggacaaggaacaatggtaacagtaagctca

SEQ ID NO: 47853 - RNA, 432 nt, synthetic construct
  misc_feature 1..432: note = derived and/or modified sequence opt6 from anti-HIV_cap256-059-186068_VR-Chain
  source 1..432: mol_type = other RNA
caagtacaattagtagaaagcggaggaggagtagtacaaccaggaagaagcttaagattaagctgtgcagcaagtcaattctcattttcaaattatggaatgcactgggtaagacaagcaccaggaaaaggattagaatgggtagcaggaatatcatttgcagcaacaaaaaaatattatgcagatagtgtaaaaggaagatttagtgtaagcagagacaatagtaaaaatgcattatatttacaaatgaatagcttacgagcagaagatacagcactttattactgtgcaagagacttaagagattatgaatgtgaagaatgggcatcagactattatgatttcggaagagaatacccatgtcaagacccaagaggagtagtaggaacatttgatatatggggacaaggaacaatggtaacagtaagtaca

SEQ ID NO: 47854 - RNA, 435 nt, synthetic construct
  misc_feature 1..435: note = derived and/or modified sequence opt6 from anti-HIV_cap256-059-182835_VR-Chain
  source 1..435: mol_type = other RNA
caagtacaattagtagaaagtggaggaggattagtacaaccaggaagaagtttaagattaagttgtgcagcaagcggatttagttttaataattttgcaatggattgggtaagacaagcaccaggaaaaggattagaatgggtagcatttgtaagtagtgatggaagtaataaaaattatgcagatagtgtaaaaggaagatttataataagtagagataatagtaaaaatacagtatatttacaaatgaatagtttaagagtagaagatacagcagtatattattgtgcaaaagatttaggagcaaataaagatgatgaatgggcaacagattattattatgatctatcagtagcaagaccagtaccagatccaagagcagtagtaggagcatttgatgtatggggacaaggaacaatggtaacagtaagtagt

SEQ ID NO: 47855 - RNA, 432 nt, synthetic construct
  misc_feature 1..432: note = derived and/or modified sequence opt6 from anti-HIV_cap256-059-176659_VR-Chain
  source 1..432: mol_type = other RNA
agagtacaattagtagaaagcggaggaggagtagtacaaccaggaagaagcctaagattaagttgtgcagcaagccaattctcattctcaaactatggaatgcactgggtaagacaagcaccaggaaaaggactagaatgggtagcaggaatatcattcgcagcaataaaaaaatactatgcagatagcgtaaaaggaagatttacaataagtagagacaatagcaaaaacgcactatatttacaaatgaatagcctaagagcagaagatacagcactatattactgtgcaagagacttaagagaatacgaatgcgaagaatgggcatcagactattacgatttcggaagagaactaccatgccaagacccaagaggagtagtaggaacattcgatacatggggacaaggaacaatggtaacagtaagcaca

SEQ ID NO: 47856 - RNA, 432 nt, synthetic construct
  misc_feature 1..432: note = derived and/or modified sequence opt6 from anti-HIV_cap256-059-172956_VR-Chain
  source 1..432: mol_type = other RNA
caagtacaattagtagaaagtggaggaggagtagtacaaccaggaagaagcctaagattaagttgtgcagcaagtcaattttcattttcaagctatggaatgcattgggtaagacaagcaccaggaaaaggattagaatgggtagcagcaatgagttttgcaggaacaaatcaatattatgcagcaagtgtaaaaggaagatttacaataagtagggataatagtaaaaatacattatatttacatatgaatagtttaagaccagaagatacagcattatattattgtgcaagagatttaagagaatatgaatgtgaagaatgggcagcagattattatgattttggaagagaatatccatgtcaagatccaagaggagtagtaggaatatttgatgtatggggacaaggaacattagtaacagtaagttca

SEQ ID NO: 47857 - RNA, 432 nt, synthetic construct
  misc_feature 1..432: note = derived and/or modified sequence opt6 from anti-HIV_cap256-059-171272_VR-Chain
  source 1..432: mol_type = other RNA
caagtactattagtagaaagtggaggaggagtagtacaaccaggaaggagcttaagattaagctgtgcagcgagccaattcacattctcaaactatggaatgcactgggtaagacaagcaccaggaaaaggactagaatgggtagcagcaatatcattcgcaggaatgaaaaaatactatgcagatagcgtaaaaggaagatttacaataagcagagacaatagcaaaaacacactatatctacaaatgaatagcttaagagcagaagatacagcactatattactgtgcaaaagacttaagagaattcgaatgcgaagaatgggcatcagactattacgatttcggaagagcacaaccatgccaagacccaagaggagtagtaggaacattcgatttatggggacaaggaacaatggtaacagtaagctca

SEQ ID NO: 47858 - RNA, 432 nt, synthetic construct
  misc_feature 1..432: note = derived and/or modified sequence opt6 from anti-HIV_cap256-059-168734_VR-Chain
  source 1..432: mol_type = other RNA
caagtacaattagtagaaagcggaggaggagtagtacaaccaggaagaagcttaagattaagttgtacagcaagccaattctcattctcaagttatggaatgcactgggtaagacaagcaccagggaaaggattagaatgggtagcagcaatatcattcgcaggaacaaaaaaatactatgtaggaacagtaaaaggaagatttacaataagcagagacaatagcaaaaacacactatatctacaaatgaatagcttaagagcagaagatacagcattatattactgtgcaaaagacatgagagaatacgaatgcgaagaatgggcatcagactattacgatttcggaagagaatacccatgccaagacccaagaggagtagtaggaacattcgatatatggggacaaggaacaatggtaacagtaagctca

SEQ ID NO: 47859 - RNA, 432 nt, synthetic construct
  misc_feature 1..432: note = derived and/or modified sequence opt6 from anti-HIV_cap256-059-155838_VR-Chain
  source 1..432: mol_type = other RNA
caagtacaattagtagaaagcggaggaggagtagtacaaccaggaagaagtttaagattaagctgtgcagtaagccaattcacattctcaaactatggaatgcactgggtaagacaagcaccaggaaaaggactagaatgggtagcagcaatatcattcgcaggaacaaaaaaaagctatgcagcaagcgtaaaaggaagatttacaataagcagagacaatagcaaaaacacactatatctacaaatgaatagcttaagaccagaagatacagcgttatattactgtgcaaaagacatgagaggattcgaatgcgaagaatgggcatcagactattacgatttcggaagagaacaaccatgccaagacccaagaggagtagtaggaatattcgatctatggggacaaggaacaatggtaagcgtaagctca

SEQ ID NO: 47860 - RNA, 432 nt, synthetic construct
  misc_feature 1..432: note = derived and/or modified sequence opt6 from anti-HIV_cap256-059-149799_VR-Chain
  source 1..432: mol_type = other RNA
caagtacatttagtagaaagtggaggaggagtagtacaaccaggaagaagcttaagattaagctgtgcagcaagccaattcacattctcgaactatggatttcactgggtaagacaagcaccaggaaaaggactagaatgggtagcagcaatatcattcgcaggagtaaaaaaacactatgcagatagcgtaaaaggaagatttacaataagcagagacaatagtaaaaacacattatatctacaactaaatagcttaagagcagaagatacagcactatattactgtgcaaaagacttaagagaatacgaatgcgaagaatgggcaagtgactattacgatttcggaagagatttcccatgccaagacccaagaggagtagtaggaacattcgatatatggggacaaggaacaatggtaacagtaagctca

SEQ ID NO: 47861 - RNA, 432 nt, synthetic construct
  misc_feature 1..432: note = derived and/or modified sequence opt6 from anti-HIV_cap256-059-148168_VR-Chain
  source 1..432: mol_type = other RNA
caagtacaattagtagaaagcggaggaggagtagtacaaccaggaagaagcttaagactaagctgtacagcaagccaattcacattctcaaactatggaatgcactgggtaagacaagcaccaggaaaaggactagaatgggtagcaggaatatcattcgcagcaacaaaaaaatactatagtgatagcgtaaaaggaagatttacaataagcagagacaatagcaaaaacgcactatatctacaaatgaatagcttaagagcagaagatacagcactatatcactgtgcaaaagacttaagagaatacgaatgcgaagaatgggcatcagactattacgatttcggacgagaacaaccatgccaagacccaagaggagtagtaggaacattcgatatatggggacaaggaacaatggtaacagtaagtaca

SEQ ID NO: 47862 - RNA, 435 nt, synthetic construct
  misc_feature 1..435: note = derived and/or modified sequence opt6 from anti-HIV_cap256-059-144685_VR-Chain
  source 1..435: mol_type = other RNA
caagtacatttagtagaaagtggaggaggagtagtacaaccaggaagaagtttaagattaagttgtgcagcaagtggatttacattttcaaattttgcaatggattgggtaagacaagcaccaggaaaaggattagaatgggtagcatttgtaagtagtgatggaaataataaaaattatggagatagtgtaaaaggaagatttacaataagtagagataatagcaaaaatacattatttttacaaatgaatagtttaagagcagaagatacagcattatattattgtgtaaaagatgtaggagattataaaagtgatgaatgggcaacacattattattatgatttaagtatagcagatccaatacaagatcctagggcagtagtaggagcatttgatatatggggaagaggaacaatggtagcagtaagtagt

SEQ ID NO: 47863 - RNA, 432 nt, synthetic construct
  misc_feature 1..432: note = derived and/or modified sequence opt6 from anti-HIV_cap256-059-140017_VR-Chain
  source 1..432: mol_type = other RNA
caagtacaattagtagaaagcggaggaggagtagtacaaccaggaagaagtttaagattaagctgtgcagcaagtcaattttcattcggaaattttggaatgcactgggtaagacaagcaccaggaaaaggactagaatgggtagcaggaatatcatttgcgggaacaaaaaaatattatgcagatagtgtaaaaggaagatttacaataagcagagacaatagtaaaagtgcattatttttacaaatgaatagtttgagagcagaagatacagcactatattactgtgcaaaagacttaagatattatgaatgtgaagaatgggcatcagactattatgatttcggaagagatcaaccatgtcaagatccaagaggagtagtaggaacatttgatatgtggggacaaggaacgatggtaacagtaagttca

SEQ ID NO: 47864 - RNA, 432 nt, synthetic construct
  misc_feature 1..432: note = derived and/or modified sequence opt6 from anti-HIV_cap256-059-137547_VR-Chain
  source 1..432: mol_type = other RNA
caagtacaattagtagaaagcggaggaggagtagtacaaccaggaagaagcttaagattaagttgtgcagcaagccaattcacattctcaagatatggaatgcactgggtaagacaagcaccaggaaaaggactagaatgggtagcagcaatatcattcgcaggaataaaaaaaaactatgcagatagcgtaaaagggagatttacaataagcagagacaatagtaaaaacacattatatctacaaatgaatagcttaagagcagaagatacagcactatattactgtgcaagagacttgagagaatttgaatgcgaagaatgggcatcagactattacgatttcggacgagatttcccatgccaagacccaagaggagtagtaggaatattcgatatatggggacaaggaacaatggtaacagtaagctca

SEQ ID NO: 47865 - RNA, 435 nt, synthetic construct
  misc_feature 1..435: note = derived and/or modified sequence opt6 from anti-HIV_cap256-059-131908_VR-Chain
  source 1..435: mol_type = other RNA
caagtacaattagtagaaagtggaggaggagtagtacaaccaggaagaagtctaaggttaagttgtacagcaagtggatttacgtttagtaattatggaatacattgggtaagacaagcaccaggaaaaggattagaatgggtagcagcaataagttatgaaggaagtataaaatattatgtagatagtgtaaaaggaagatttacaataagtagagatgatagtaaaaatacattatttctacaaatgaatagtttaagaacagaagatacagcagtatattattgtacaagagatgtaagagaatgggaaacagaagaatgggcaacaaattattattatgatttaagcatagcatatccaataagacatccaagaggagtagtaggaatatttgatgtatggggattaggaacaagagtaacagtatcaagt

SEQ ID NO: 47866 - RNA, 432 nt, synthetic construct
  misc_feature 1..432: note = derived and/or modified sequence opt6 from anti-HIV_cap256-059-116006_VR-Chain
  source 1..432: mol_type = other RNA
caagcacaattagtagaaagcggaggaggagtagtacaaccaggaagaagtttacgattaagttgtgcagcaagtcaattctcattctcaagctatggaatgcactgggtaagacaagcaccaggaaaaggactagaatgggtagcatcaatatcattcgcaggagtaaaaaaaacaaatgcagatagtgtaaaaggaagatttacaataagcagagacaatagcaaaaacacattacatctacaaatgaatggattaagaaatgacgatacagcattatattactgtgcaagagacttaagagatttcgaatgcgaagaatgggcaagtgactattacgatttcggaagagaattcccatgccaagacccaagaggagtagtaggaacattcgatatatggggacaaggaacaaaagtaacagtaagctca

SEQ ID NO: 47867 - RNA, 411 nt, synthetic construct
  misc_feature 1..411: note = derived and/or modified sequence opt6 from anti-HIV_cap256-059-115783_VR-Chain
  source 1..411: mol_type = other RNA
caagtacaattagtagaaagtggaggaggagtagtacaaccaggaagaagtctaagattaagttgtgcagcaagtcaatttacgtttagtagttatggaatgcattgggtaagacaagcaccaggaaaaggattagaatgggtagcagcaataagttatgcagatagtgtaaaaggaagatttacaataagtagagataatagtaaaaatacattatatttacaaatgaatagtttaagagcagaagatacagcattatattactgtgcaaaagatttaagagaaatggaatgtgaagaatgggcaagcgattattatgattttggaagagatttaccatgtcaagatccaagaggagtagtaggaacattagatatatggggacaaggaacaatggtaacagtaagtagt

SEQ ID NO: 47868 - RNA, 432 nt, synthetic construct
  misc_feature 1..432: note = derived and/or modified sequence opt6 from anti-HIV_cap256-059-114609_VR-Chain
  source 1..432: mol_type = other RNA
caagtacaattagtagaaagcggaggaggagtagtacaaccaggaagaagcttaagattaagctgtgcagcaagtcaactaacattctcaaactttggaatgcactgggtaagacaagcaccaggaaaaggactagaatgggtagcaggaatatcattcgcaggaacaaaaaaatactatgcagatagtgtaaaaggaagatttacaataagcagagacaatagcaaaaacgcactatatctacaaatgaatacattaagagcagaagatacagcattatatttctgtgcaaaagacttaagagaatacgaatgcgaagaatgggcatcagactattacgatttcggaagagatcaaccatgccaagacccaagaggagtagtaggaatattcgatatatggggacaaggaacaatggtaacagtaagctca

SEQ ID NO: 47869 - RNA, 432 nt, synthetic construct
  misc_feature 1..432: note = derived and/or modified sequence opt6 from anti-HIV_cap256-059-113952_VR-Chain
  source 1..432: mol_type = other RNA
caagcacaattagtagaaagtggaggaggagtagtacaaccaggaagaagtttaagattaagctgtgcagcaagtcattttacattcagtagttatggatttcattgggtaagacaagcaccaggaaaaggattagaatgggtagcaggaataagttttgcagcaacgaaaaaatattatgcagatagtgtaaaaggaagatttacaataagtagggataatagtaaagatgcattatatttacaaatgaatagtttaagagcagaagatacagcattatattattgtgcaagagatttaagaggatatgaatgtgaagaatgggcaagtgattattatgattttggaagagatcaaccatgtcaagatccaagaggagtagtaggaatatttgatttatggggacaaggaacaatggtaacagtaagtagt

SEQ ID NO: 47870 - RNA, 432 nt, synthetic construct
  misc_feature 1..432: note = derived and/or modified sequence opt6 from anti-HIV_cap256-059-113878_VR-Chain
  source 1..432: mol_type = other RNA
caagtacaattagtagaaagtggaggaggagtagtacaaccaggaagaagtttaagattaagttgtgcagcaagcggatttacatttagtacatatgcaatgcattgggtaagacaagcaccaggaaaaggattagaatgggtagcattaataagctatgatgcaacaaataaatattatgtagacagtgtaaaaggaagatttacaataagtagagataatagtaaaaatacattatatttacaaatgtcaagtttaacagcagaagatacagcagtatattattgtgcaaaagatttaggaggaataaaaatagatgaatggggaacagattattatgatataagtgtaagttatccagtacaagatccaagagcagtagcaggaatatttgatgtatggggacatggaacaatggtaagtgtaagtagt

SEQ ID NO: 47871 - RNA, 432 nt, synthetic construct
  misc_feature 1..432: note = derived and/or modified sequence opt6 from anti-HIV_cap256-059-113622_VR-Chain
  source 1..432: mol_type = other RNA
caagtacaattagtagaaagcggaggaggagtagtacaaccaggaagaagtttaagattaagctgtgcagcaagccaattcacattcacaagttatggaatgcactgggtaagacaagcaccaggaaaaggattagaatgggtagcaggaatatcattcgcaggaacaaaaaaacactatgcagatagcgtaaaaggaagatttacaataagcagagacaatagcaaaagcacactatatttacaaatgaatagtttaagagcagaagatacagcattatattactgtgcaaaagacatgagagaatacgaatgcgaagaatgggcatcagactattacgatttcggaagagatcaaccatgccaagacccaagaggagtagtaggaatattcgatctatggggacaaggaacaatggtaacagtaagcagc

SEQ ID NO: 47872 - RNA, 432 nt, synthetic construct
  misc_feature 1..432: note = derived and/or modified sequence opt6 from anti-HIV_cap256-059-109427_VR-Chain
  source 1..432: mol_type = other RNA
caagtacaattagtagaaagcggaggaggagtagtacaaccaggaagaagcttaagattaagctgtgcagcaagccaattcacattctcaaactatggaatgcactgggtaagacaagcaccaggaaaaggactagaatgggtagcatcaatatcattcgcaggaataaaaaaacactatacagatagcgtaaaaggaagatttacaataagcagagacaatagcaaaaacacactatttctacaaatgaatagcctaagagcagaagatacagcactatattactgtgcaagagacttaagagaatacgaatgcgaagaatgggcatcagactattacgatttcggaagagatcaaccatgccaagacccaagaggagtagtaggaacaagcgatatatggggacaaggaacaaaagtaacagtaagctca

SEQ ID NO: 47873 - RNA, 432 nt, synthetic construct
  misc_feature 1..432: note = derived and/or modified sequence opt6 from anti-HIV_cap256-059-109081_VR-Chain
  source 1..432: mol_type = other RNA
caagaacaattagtagaaagtggaggaggagtagtacaaccaggaagaagtttaagattaagctgtgcagcaagtcaatttagttttagtgcatacggaatgcattgggtaagacaagcaccaggaaaaggattagaatgggtagcaggaataagttttgcagcaacaaaaaaatattatgaagatagtgtaaaaggaagatttacaataagcagagataatagtaaaaatacattatatttacaaatgaatagtttaagaggagaagatacagcattatattattgtgcaaaagatatgagagaaatggaatgtgaagaatgggcaagtgattattatgattttggaagaccacaaccatgtcaagatccaagaggagtagtaggaatatttgatatgtggggacaaggaacaatggtaacagtaagtagt

SEQ ID NO: 47874 - RNA, 432 nt, synthetic construct
  misc_feature 1..432: note = derived and/or modified sequence opt6 from anti-HIV_cap256-059-107590_VR-Chain
  source 1..432: mol_type = other RNA
caagaacaattagtagaaagtggaggaggagtagtacaaccaggaagaagtttaagattaagttgtgcagcgagtcaatttagtataagtgcatatggaatgcattgggtaagacaagcaccaggaaaaggattagaatgggtagcaggaataagttttgcaggaacaaaaaaatattatgcagatagtgtaaaaggaagatttacaataagtagagataatagtaaaaatacattatatttacaaatgaatagtttaagaggagaagatacagcattatattattgtgcaaaagatatgagagaaatggaatgtgaagaatgggcaagtgactattatgattttggaagagatcaaccatgtcaagatccaagaggagtagtaggaatatttgatatgtggggacaaggaacaatggtaacagtaagtagt

SEQ ID NO: 47875 - RNA, 435 nt, synthetic construct
  misc_feature 1..435: note = derived and/or modified sequence opt6 from anti-HIV_cap256-059-107504_VR-Chain
  source 1..435: mol_type = other RNA
caagtattattagtagaaagtggaggaggagtagtacaaccaggaaaaagtttaagattaagttgtagcgcaagtagatttacatttagtaattatggaatgcattgggtaagacaagcaccaggaaaaggattagaatgggtagcagcagtaagttttgcaggaataaaaaaaacaaatgcagatagtgtaaaaggaagatttacaataagtagagataatagtaaaaatacattatatttacaaatgaatagtttaagagcagaagatacagcattatattattgtgcaagagatttaagagattttgaatgtgaagaatgggcaagtgattattatgatttttggggagatccacaaccatgtcaagatccaagaggagtggtaggaacatttgatttatggggacaaggaacaatggtaacagtaagtagt

SEQ ID NO: 47876 - RNA, 432 nt, synthetic construct
  misc_feature 1..432: note = derived and/or modified sequence opt6 from anti-HIV_cap256-059-099614_VR-Chain
  source 1..432: mol_type = other RNA
gaagtattattactagaaagtggaggcggactagtacaaccaggaagaagtttaagattaagctgtgcagcaagccaattcacattctcaagctatggaatgcactgggtaagacaagcaccaggaaaaggattagaatgggtagcaggaatatcattcgtaggaataaaaaaatactatgcagatagcgtaaaaggaagatttacaataagcagagacaatagcaaaaacacactatatctacaaatgaatagcttaagagcagaagatacagcactatattactgtgcaagagacttaagagaatacgaatgcgaagaatgggcatcagactattacgatttcggaagagatcaaccatgccaagacccaagaggagtagtaggaacattcgatatatggggacaaggaacaatggtaacagtaagttca

SEQ ID NO: 47877 - RNA, 432 nt, synthetic construct
  misc_feature 1..432: note = derived and/or modified sequence opt6 from anti-HIV_cap256-059-098972_VR-Chain
  source 1..432: mol_type = other RNA
caagtacaactagtagaaagcggaggaggagtagtacaaccaggaagaagcctaagattaagctgtgcagcaagccaattcacattttcaagctatggaatgcactgggtaagacaagcaccaggaaaaggactagaatgggtagcatcaatatcattcgcaggaataaaaaaaaactatagagatagcgtaaaaggaagatttacaataagcagagacaatagcaaaaacacactatatttacaaatgacaagcttaagaccagaagatacagcactatattactgtgcaaaagacttaagaggattcgaatgcgaagaatgggcatcagactattacgatttcggaagagaactaccatgccaagacccaagaggagtagtaggaacattcgatatgtggggacaaggaacaatggtaacagtaagttca

SEQ ID NO: 47878 - RNA, 432 nt, synthetic construct
  misc_feature 1..432: note = derived and/or modified sequence opt6 from anti-HIV_cap256-059-097236_VR-Chain
  source 1..432: mol_type = other RNA
caagtacaactagtagaaagtggaggaggagtagtacaaccagggagaagcttaagattaagctgtgcagcaagtggatttagctttagtaattttggatttcattgggtaagacaagcaccaggaaaaggattagaatgggtagcagcaataagttttgtaggaaataaaaaatattatgcagaaagtgtaaaaggaagatttacaataagtagagaaaatagtaaaaatatgttatttttacaaatgaatagtttaagaggagaagatacagcagtatattattgtgcaaaagatttaagagaatttgaatgtgaagaatgggcaagtgattattatgattttggaagagaacaaccatgtcaagatccaagaggagtagtaggaagtatagatgtatggggacatggaagtctagtaacagtaagtagc

SEQ ID NO: 47879 - RNA, 432 nt, synthetic construct
  misc_feature 1..432: note = derived and/or modified sequence opt6 from anti-HIV_cap256-059-091487_VR-Chain
  source 1..432: mol_type = other RNA
caagtacaattagtagaaagcggaggaggagtagtacaaccaggaagatcattaagattaagctgtgcagcaagccaattcacattcaatagatatggaatgcactgggtaagacaagcaccaggaaaaggattagaatgggtggcagtaataagctacgatggaacaaacaaatactatggagaaagtgtaaaaggaagatttacaataagtagagacaatagcaaaaacacactatatctacaaatgaatagcttaagagcagaagatacagcactatattactgtgcaaaagacttaagagaagacgaatgcgaagaatggtggtcagactattacgatttcggaagagaattaccatgcagaaaaagtagaggagtagcaggaatattcgatatatggggacaaggaacaatggtaacagtaagctca

SEQ ID NO: 47880 - RNA, 432 nt, synthetic construct
  misc_feature 1..432: note = derived and/or modified sequence opt6 from anti-HIV_cap256-059-089812_VR-Chain
  source 1..432: mol_type = other RNA
caagtacaattagtagaaagtggaggaggagtagtacaaccaggaagaagcttaagattaagctgtgcagcaagccaactaacattctcaagctatggaatgcactgggtaagacaagcaccaggaaaaggactagaatgggtagcaggaatatcattcgcaggaacaaaaaaacactatagcgatagcgtaaaaggaagatttacaataagcagagacaatagcaaaaacgcactatatctacaaatgaatagcttaagagcagaagatacagcactatattactgtgcaaaagacttaagagaatacgaatgtgaagaatgggcatcagactattacgatttcggaagagaacaaccgtgccaagacccaagaggagtagtaggaatattcgatatgtggggacaaggaacaatggtaacagtaagctca

SEQ ID NO: 47881 - RNA, 432 nt, synthetic construct
  misc_feature 1..432: note = derived and/or modified sequence opt6 from anti-HIV_cap256-059-088468_VR-Chain
  source 1..432: mol_type = other RNA
caagtacaattagtagaaagcggaggaggagtagtacaaccaggaagaagtttaagattaagctgtgcagcaagtcaatttacatttagtagttatggaatgcattgggtaagacaagcaccaggaaaaggattagaatgggtagcagcaataagttttgtaggaataaaaaaatattatgcaaatagtgtaaaaggaagatttacaataagtagagataatagtaaaaatacattatatttacaaatgaatagtttaagagcagaagatacagcattatattattgtgcaagagatttaagagaatatgaatgtgaagaatgggcaagtgattattatgattttggaagaggaggaccatgtcaagatccaagaggagtagtaggaagttttgatatatggggacaaggaacaatggtaacagtaagcagt

SEQ ID NO: 47882 - RNA, 432 nt, synthetic construct
  misc_feature 1..432: note = derived and/or modified sequence opt6 from anti-HIV_cap256-059-088341_VR-Chain
  source 1..432: mol_type = other RNA
caagtacaattagtagaaagcggaggaggagtagtacaaccaggaagaagcttaagattaagttgtgcagcaagccaattcacattctcaagttatggaatgcactgggtaagacaagcaccaggaaaaggattagaatgggtagcagcaatatcattcgcaggaataaaaaaacactatgcagatagcgtaaaaggaagatttacaataagcagagacaatagcaaaaacatggtatttttacaaatgaatagcttaagagcagaagatacagcactatattactgtgcaagagacttaagagaatacgaatgcgaagaatgggcatcagactattacgatttcggaagagatcaaccatgccaagacccaagaggagtagtgggaacaagcgatatatggggacaaggcacaatggtaacagtaagctca

SEQ ID NO: 47883 - RNA, 432 nt, synthetic construct
  misc_feature 1..432: note = derived and/or modified sequence opt6 from anti-HIV_cap256-059-086533_VR-Chain
  source 1..432: mol_type = other RNA
caagtattattagtagaaagcggaggaggagtagtacaaccaggaagaagtttaagattaagctgtgcagcaagtcaattcacattctcaaattttggaatgcactgggtaagacaagcaccaggaaaaggattagaatgggtagcaggaatatcattcgtaggaataaaaaaatactatgcaggaagcgtaaaaggaagatttacaataagcagagacaatagcaaaaacacactatatctacaaatgaatagcttaagagcagaagatacagcactatattactgtgcaaaagacttaagagaatttgaatgtgaagaatgggcatcagactattacgatttcggaagaccacaaccatgtcaagacccaagaggagtagtaggaacattcgatttatggggactaggaacactagtaacagtaagttca

SEQ ID NO: 47884 - RNA, 432 nt, synthetic construct
  misc_feature 1..432: note = derived and/or modified sequence opt6 from anti-HIV_cap256-059-086043_VR-Chain
  source 1..432: mol_type = other RNA
gaagtacatttagtagaaagtggaggaggattagtaaaaccaggaggaagtttaagattaagttgtgcagcaagtggatttacatttagtacatatagtatgaattgggtaagacaagcaccaggaaaaggattagaatgggtagcatttgtagcatttgatgaaagtgataaatattatgcagatagtgtaaaaggaagatttacaataagtagagataatagtaaaaatacattaagtttacaaatgaatagtttaagagtagaagatacagcaatatattattgtgcaaaagaagtaggagataataaagatgatgaatgggcaagtgattattatgatttaagtatagcatatccaatacaagatccaagagcagtaggaagaggatatgatatatggggacaaggaacaatggtaacagtaagtagt

SEQ ID NO: 47885 - RNA, 432 nt, synthetic construct
  misc_feature 1..432: note = derived and/or modified sequence opt6 from anti-HIV_cap256-059-084191_VR-Chain
  source 1..432: mol_type = other RNA
caagtacaattagtagaaagcggaggaggagtagtacaaccaggaagaagtttaagattaagttgtgcagcaagccaattcacattctcaagctatggaatgcactgggtaagacaagcaccaggaaaaggattagaatgggtagcagcaatatcattcgtaggaataaaaaaatactatgcagatagcgtaaaaggaagatttacagtaagtagagacaatagtaaaagcacactatatttacaaatgaatagcttaagagcagaagatacagcgctatattactgtgcaagagacttaagagaatacgaatgcgaagaatgggcatcagactattacgatttcgggagagatcaaccatgtcaagacccaagaggagtagtaggaatattcgatatatggggacaaggaacagcagtaacagtaagtagt

SEQ ID NO: 47886 - RNA, 417 nt, synthetic construct
  misc_feature 1..417: note = derived and/or modified sequence opt6 from anti-HIV_cap256-059-082135_VR-Chain
  source 1..417: mol_type = other RNA
caagtacaattagtagaatcaggaggaggagtagtacaaccaggaagatcactaagactatcatgtacagcatcaggatttacatttagatcatacgcaatacattgggtaagacaagcaccaggaaaaggattagaatgggtagcactaataagctatgacggaagtaataaatattacgcagactcagtaaaaggaagattcacaatatcaagagataacagcaaaaatacattatacttacaaatgaactcactaacatcagaagacacagcagtatactattgcgcaaaagatctaggaggatcaaaaacagacgaatggggaacagattactgttacccagtacaagacccaagagtagtagtaggagcattcgatatatggggacatggaacaatggtaacagtaagctca

SEQ ID NO: 47887 - RNA, 432 nt, synthetic construct
  misc_feature 1..432: note = derived and/or modified sequence opt6 from anti-HIV_cap256-059-079417_VR-Chain
  source 1..432: mol_type = other RNA
caagtacaattagtagaaagtggaggaggagtagtacaaccaggaagaagtttaagattaagttgtgcagcaagtggatttagttttagtaattatgcaatggattgggtaagacaagcaccaggaaaaggattagaatgggtagcatttgtaagtagtgatggaaataataaaaaatatgcagatagtgtaaaaggaagatttacattaagtagagataattataaaaatacagtatatttgcaaatgaatagtttaacagtagaagatacagcagtatattattgtgcaaaagatttaggagcaaataaagatgatgaatggggaacagattattatgatatgagtgtaagctatccaataccagatccaagagcagtagtaggagcatttgatgtatggggacaaggaacattagtaacagtaagtagt

SEQ ID NO: 47888 - RNA, 435 nt, synthetic construct
  misc_feature 1..435: note = derived and/or modified sequence opt6 from anti-HIV_cap256-059-076027_VR-Chain
  source 1..435: mol_type = other RNA
caagtacaattagtagaaagtggaggaggagtagtacaaccaggaagaagtttaagattaagctgtgcagcatcaggatttagctttagtaaatatggaatgcattgggtaagacaagcaccaggaaaaggactagaatgggtagcatttgtagcatttgatgaaagcgaaaaatattatgcagcaagtgtaaaaggaagatttacaataagtagagataatagtaaaaatacattaagtttacaaatgaatagtttaagaacagaagatacagcaatatattattgtgcaaaagaagtaggagataataaagacgatgaatggacaagtccatattattatgatataagtatagcatatccagtacatgatccaagagcagtagtaggagtaagtgatgtatggggacaaggaacaatggtaacagtaagcagt

SEQ ID NO: 47889 - RNA, 432 nt, synthetic construct
  misc_feature 1..432: note = derived and/or modified sequence opt6 from anti-HIV_cap256-059-075082_VR-Chain
  source 1..432: mol_type = other RNA
caagtacaattagtagaaagcggaggaggagtagtacaaccaggaagaagcttaagattaagctgtgcagcaagccaattcacattctcaagctatggaatgcactgggtaagacaagcaccaggaaaaggactagaatgggtagcagcaatatcattcgtaggaataaaaaaatactatgcagatagcgtaaaaggaagatttacaataagcagagacaatagcaaaaacacattatatctacaaatgaatagcttaagagcagaagatacagcactatattactgtgcaaaagacttaagagaaatggaatgcgaagaatgggcatcagactattacgatttcggaagagatctaccatgccaagacccaagaggagtagtaggaacactagatatatggggacaaggaacaatggtaacagtaagctca

SEQ ID NO: 47890 - RNA, 432 nt, synthetic construct
  misc_feature 1..432: note = derived and/or modified sequence opt6 from anti-HIV_cap256-059-072575_VR-Chain
  source 1..432: mol_type = other RNA
caaggacaattagtagaaagcggaggaggagtagtacaaccaggaagaagtttaagattgagctgtgcagcaagtcaatttacatttagtaattttggaatgcattgggtaagacaagcaccaggaaaaggattagaatgggtagcagtaataagttatgatggaacgaaaaaatattatgcagatagtgtaaaaggaagatttacaataagtagagataatagcaaaaatacattatatctacaaatgaatagtttaagagcagaagatacagcattatattattgtgcaaaagatatgagagaagatgaatgtgaagaatggggagcagactattatgatttcggaaaagattatccatgtcaagcaagtagaggagtagtaggaatatttgatatatggggacaaggaacaatggtaacagtaagtgca

SEQ ID NO: 47891 - RNA, 432 nt, synthetic construct
  misc_feature 1..432: note = derived and/or modified sequence opt6 from anti-HIV_cap256-059-071926_VR-Chain
  source 1..432: mol_type = other RNA
caagtacaattagtagaaagtggaggaggagtagtacaaccaggaagaagcttaagattaagttgtgcagcaagccaactatcattctcaaactatggaatgcactgggtaagacaagcaccaggaaaaggactagaatgggtagcaggaatatcattcgtaggcataaaaaaatactatagagatagcgtaaaaggaagatttacaataagcagagacaatagcaaaaacacactatatctacaaatgaatagcttaagaacagaagatacagcactatattactgtgtaaaagacttaagagaattcgaatgcgaagaatgggcatcggactattacgatttcggaagagatcaaccatgcttagacccaagaggagtagtaggaacattcgatatatggggacaaggaacaatggtaacagtaagctca

SEQ ID NO: 47892 - RNA, 432 nt, synthetic construct
  misc_feature 1..432: note = derived and/or modified sequence opt6 from anti-HIV_cap256-059-069638_VR-Chain
  source 1..432: mol_type = other RNA
caagtacaattagtagaaagcggaggaggagtagtacaaccaggaagaagtttaagattaagttgtgcagcaagtggatttacatttagtaaaaatgcaatgcattgggtaaggcaagcaccaggaagaggattagaatgggtagcaagtgtagcatttgatggaagtgataaatattatgcagatagtgtaaaaggaagatttacaataagcagagataatagtaaaaatacattaagtttacaaatgaatagtttaagggcagaagatacagcagtatattattgtgcaaaagaagtagatttatataaagatgatgaatggggaagtgattattatgatttaagtatagcatatccaatacaagatccaagagcagtagtaggaggatttggaatatggggacaaggaacaatggtaacagtaagtagc

SEQ ID NO: 47893 - RNA, 432 nt, synthetic construct
  misc_feature 1..432: note = derived and/or modified sequence opt6 from anti-HIV_cap256-059-069165_VR-Chain
  source 1..432: mol_type = other RNA
ttagtacaattagtagaaagtggaggaggagtagtacaaccaggaagaagtttaagattaagttgtgcagcaagtagatttacatttagtaattatggaatgcattgggtaagacaagcaccaggaaaaggactagaatgggtagcaggaataagttttgcaggaacaacaaaatattatgcagatagtgtaagaggaagatttacaataagtagagataatagtaaaaatacattatatttacaaatgaatagtttaagagcagaagatacagcattatattattgtgcaaaagatatgagagaaatggaatgtgaagaatgggcaagtgattattatgattttggaagaccacaaccatgtcaagatccaagaggagtagtaggaatatttgatatatggggacaaggaacaatggtaacagtaagtagt

SEQ ID NO: 47894 - RNA, 432 nt, synthetic construct
  misc_feature 1..432: note = derived and/or modified sequence opt6 from anti-HIV_cap256-059-068956_VR-Chain
  source 1..432: mol_type = other RNA
caagtacaattagtagaaagcggaggaggagtagtacaaccaggaagaagcctaaggttaagttgtgcagcaagtggatttacatttagtacatatgcaatgcattgggtaagacaagcaccaggaagaggattagaatgggtagcattaataagttatgatggaagtaataaatattatgtagatagcgtaaaaggaagatttacaataagtagagataatagtaaaaatacactatatttacaaatgaatagtttaacagcagaagatacagcagtatattattgtgcaaaagatttaggaggaagtaaagatgatgaatgggcaacagattattatgatttaagcatagcatatccaatacaagatccaagagcagtagcaggaatatttgatgtatggggaagaggaacagtagtaacagtaagtagt

SEQ ID NO: 47895 - RNA, 432 nt, synthetic construct
  misc_feature 1..432: note = derived and/or modified sequence opt6 from anti-HIV_cap256-059-068876_VR-Chain
  source 1..432: mol_type = other RNA
caagtacaattagtagaaagcggaggaggagtagtacaaccaggaagaagcttaagattaagctgtgcagcaagtcaattcacattctcaagctatggaatgcactgggtaagacaagcaccaggaaaaggactagaatgggtagcagcaatatcattcgcaggaacaaaaaaatactatgcaaatagtgtaaaaggaagatttacaataagcagagacaatagcaaaaacacactatcactacaaatgaatagcttaagaggggaagatacagcaagatattactgtgcaagagacccaagagaatacgaatgcgaagaatgggcatcagactattacgatttcggaagagatcaaccatgccaagacccaagaggagtaataggaatattcgatatatggggacaaggaacaatggtaacagtaagctca

SEQ ID NO: 47896 - RNA, 432 nt, synthetic construct
  misc_feature 1..432: note = derived and/or modified sequence opt6 from anti-HIV_cap256-059-067733_VR-Chain
  source 1..432: mol_type = other RNA
caagtacaattagtagaaagcggaggaggagtagtacaaccaggaagaagcttaagattaagctgtacagcaagccaattctcattctcaagttatggaatgcactgggtaagacaagcgccaggaaaaggactagaatgggtagcagcaatatcattcgcaggaacaaaaaaaaactatgtagatagcgtaaaaggaagatttacaataagcagagacaatagcaaaaacacactatatctacaaatgaatagcttgagagcagacgatacagcactatattactgtgcaaaagacatgagagaatacgaatgcgaagaatgggcatcagactattacgatttcggaagagaatacccatgcacagacccaagaggagtagtaggaacattcgatgtatggggacaaggaacaatggtaacagtaagttca

SEQ ID NO: 47897 - RNA, 432 nt, synthetic construct
  misc_feature 1..432: note = derived and/or modified sequence opt6 from anti-HIV_cap256-059-067450_VR-Chain
  source 1..432: mol_type = other RNA
caagtacaattagtagaaagcggaggaggagtagtacaaccaggaagaagcttaagattaagctgtgcagcaagtcaattcacattctcaaactatggaatgcactgggtaagacaagcaccaggaaaaggactagaatgggtagcaggaatatcattcgcaggaataaaaaaatactatgcagatagcgtaaaaggaagatttacaataagcagagacaatgcaaaaaacacattatatctacaaatgaatagcctaagagcagaagatacagcactatattactgtgcaaaagacttaagagaatacgaatgcgaagaatgggcatcagactattacgatttcggaagagaactaccatgccaagacccaagaggagtagtaggaacattcgatatatggggacaaggaacaatggtaacagtaagctca

SEQ ID NO: 47898 - RNA, 432 nt, synthetic construct
  misc_feature 1..432: note = derived and/or modified sequence opt6 from anti-HIV_cap256-059-065694_VR-Chain
  source 1..432: mol_type = other RNA
caagtacaattagtagaaagcggaggaggagtagtacaaccaggaagaagcctaagattaagctgtgcagcaagccaattaacattcaataactatggaatgcactgggtaagacaaacaccaggaaaaggactagaatgggtagcaggaatatcattcgcaggaataaataaatactatgcagatagtgtaaaaggaagatttacaataagcagagacaatagcaaaaacgcactatatctacaaatgacatcattaagagcagaagatacagcactatattactgtgtaaaagacttaagagaaatggaatgcgaagaatgggcaagcgactattacgatttcggaagagatcaaccatgccaagacccaagaggagtagtaggaacattcgatatatggggacaaggaacaatggtaacagtaagctca

SEQ ID NO: 47899 - RNA, 432 nt, synthetic construct
  misc_feature 1..432: note = derived and/or modified sequence opt6 from anti-HIV_cap256-059-065109_VR-Chain
  source 1..432: mol_type = other RNA
caagtacaattagtagaaagtggaggaggagtagtacaaccaggaaaaagtttaagattaagttgtgcagcaagcggatttacatttacaaataatgcaatgaattgggtaagacaagcaccaggaaaaggattagaatgggtagcatttgtaagtagtgatggaaggaataaaaattatgcagatagcgtaaaaggaagatttacaataagtagagataatagtaaaaatacagtatatttacaaatgaatagtttaagagtagaagatacagcattatattattgtgcaaaagatttaggagcaaataaagatgatgaatgggcaacagattattatgatttaagtgtagcatatccaataccagatccaagagcagtagtaggagcatttgatgtgtggggacaaggaacaatggtaacagtaagtagt

SEQ ID NO: 47900 - RNA, 432 nt, synthetic construct
  misc_feature 1..432: note = derived and/or modified sequence opt6 from anti-HIV_cap256-059-065060_VR-Chain
  source 1..432: mol_type = other RNA
caagtacaattagtagaaagtggaggaggagtagtacaaccaggaacaagtttaagattaagctgtgcagcaagtggatttacattcagtaattatgcaatgggatgggtaagacaagcaccaggaaaaggactagaatgggtagcagtagtaagttatgatggaagtaaaaaaagttatgcagatagtgtaaaagggagatttacaataagcagagacaatagcagaaatacattatatttacaattaaatagtctaagagcagaagatacagcaatgttttactgtgcaaaagacttaggaaaaggagaaatagaagaatgggcaacagactattatgattggtcaaaagcatatccaatagaaggaccaagagatgtagtaggagcatttgatacatggggacaaggaacactagtaacagtaagttca

SEQ ID NO: 47901 - RNA, 432 nt, synthetic construct
  misc_feature 1..432: note = derived and/or modified sequence opt6 from anti-HIV_cap256-059-064001_VR-Chain
  source 1..432: mol_type = other RNA
caagtacaattagtagaaagcggaggaggagtagtacaaccaggaagaagcttaagattaagctgtgcagcaagccaattcacattctcaaattatggaatgcactgggtaagacaagcaccaggaaaaggattagaatgggtagcaggaatatcattcgcaggaacaaaaaattactatgcaaaaagcgtaaaaggaagatttacaataagtagagacaatagcaaaaacgcactatatctacaaatgaatagcttaagagcagaagatacagcactatattactgtgcaaaagacatgagagaatacgaatgcgaagaatgggcatcagactattacgatttcggaagagatcaaccatgccaagacccaagaggagtagtaggaacattcgatatatggggacaaggaacaatggtagcagtaagctca

SEQ ID NO: 47902 - RNA, 432 nt, synthetic construct
  misc_feature 1..432: note = derived and/or modified sequence opt6 from anti-HIV_cap256-059-063270_VR-Chain
  source 1..432: mol_type = other RNA
caagtacaattggtagaaagcggaggaggagtagtacaaccaggaagaagcttaagattaagctgtgcagcaagccaattcacattctcaaactatggaatgcactgggtaagacaagcaccaggaaaaggactagaatgggtagcagcaatatcattcgcaggaacaaaaaaacactatgcagatagcgtaaaaggaagatttacaataagcagagacaatagcaaaaacgcactatatttacaaatgaatagcctaagagcagaagatacagcactatattactgtgcaaaagacttaagagaatacgaatgcgaagaatgggcatcagactattacgatttcggaagagatcaaccatgcttagacccaagaggagtagtaggaatattcgatatatggggacaaggaacactagtgacagtaagctca

SEQ ID NO: 47903 - RNA, 432 nt, synthetic construct
  misc_feature 1..432: note = derived and/or modified sequence opt6 from anti-HIV_cap256-059-061357_VR-Chain
  source 1..432: mol_type = other RNA
caagtacaattagtagaaagtggaggaggagtagtacaaccaggaagaagtttgagattaagctgtgcagcaagcggatttacatttagtaattttggatttcattgggtaagacaagcaccaggaaaaggattagaatgggtagcaggaataagttttgcaggaacaaaaatatattatgcagatagtgtaaaaggaagatttacaataagcagagaaaatagtaaaaatatgttatatttacaaatgaatagtttaagaggagaagatacagcagtatatttttgtgcaaaagatttaagagaatttgaatgtgaagaatgggcaagtgattattatgattttggaagagaatttccatgtcaagatccaagaggagtagtaggaacatttgatgtatggggacatggagcagtagtaacagtaagcagt

SEQ ID NO: 47904 - RNA, 435 nt, synthetic construct
  misc_feature 1..435: note = derived and/or modified sequence opt6 from anti-HIV_cap256-059-059834_VR-Chain
  source 1..435: mol_type = other RNA
caagtacaattagtagaaagtggaggaggagtagtacaaccaggaagaagtttaagattaagttgtgcagcaagcggatttacatttagtaattttggaatgcattgggtaagacaagcaccaggaaaaggattagaatgggtagcatttgtagcatttgatgaaagtgataaatattatgcagcatcagtaaaaggaagatttacagtaagtagagataatagtaaaaatacagtaagcctacaaatgaatagtttaagaacagaagatacagcagtatattattgtgcaaaagaagtaggagataataaagatgatgaatggacaagtccatattattatgattttagtatagcatatccagtacatgatccaagagcagtagtaggaggatatgatgtatggggacaaggaacgatggtaacagtaagtagt

SEQ ID NO: 47905 - RNA, 432 nt, synthetic construct
  misc_feature 1..432: note = derived and/or modified sequence opt6 from anti-HIV_cap256-059-059313_VR-Chain
  source 1..432: mol_type = other RNA
caagtacacttagtagaaagcggaggaggagtagtacaaccaggaaaaagcttaagattaagctgtgcagcaagccaattcacattctcaaactttggaatgcactgggtaagacaagcaccaggaaaaggactagaatgggtagcaggaatatcattcgcaggaacaaaaaaatactatgcagatagtgtaaaaggaagatttacaataagcagagacaatagcaaaaacacactatatctacaaatgaatagcgtaagagcagaagatacagcactatattactgtgcaaaagacatgagagaatacgaatgcgaagaatgggcatcagactattacgatttcggaaaaccacaaccatgccaagacccaagaggagtagtaggaacattcgatatgtggggattaggaacactagtaacagtaagctca

SEQ ID NO: 47906 - RNA, 432 nt, synthetic construct
  misc_feature 1..432: note = derived and/or modified sequence opt6 from anti-HIV_cap256-059-057130_VR-Chain
  source 1..432: mol_type = other RNA
caagtacaattagtagaaagcggaggaggagtagtacaaccaggaagaagcttaagattaagctgtgcagcaagtcaattctcattttcaagctatggaatgcactgggtaagacaagcaccaggaaaaggactagaatgggtagcagcaatatcattcgcaggaataaaaaaacactatgcagatagcgtaaaaggaagatttacaataagcagagacaatagcaaaaacacattatatctacaaatgaatagcttaagagtagaagatacagcactatattactgtgcaaaagacttaagagaatacgaatgcgaagaatgggcatcagactattacgatttcggaagaccacaaccatgtcaagacccaagaggagtagtaggaacaagcgatatatggggacaaggaacaatggtaacagtaagttca

SEQ ID NO: 47907 - RNA, 411 nt, synthetic construct
  misc_feature 1..411: note = derived and/or modified sequence opt6 from anti-HIV_cap256-059-050520_VR-Chain
  source 1..411: mol_type = other RNA
caagtgcaattagtagaaagtggaggaggagtagtacaaccaggaagaagtctaagattaagttgtgcagcaagtcaatttacatttaataggtatggaatgcattgggtaagacaagcaccaggaaaaggattagaatgggtagcagtaataagttatgcagatagtgtaaaaggaagatttacaataagtagagataatagcaaaaatacattatatttacaaatgaatagtttaagagcagaagatacagcattatattattgtgcaaaagatttaagagaagatgaatgtgaagaatggtggagtgattattatgattttggaagagaattaccatgtagaaaaagtagaggagtagcaggaatatttgatatatggggacaaggaacaatggtaacagtaagtagt

SEQ ID NO: 47908 - RNA, 432 nt, synthetic construct
  misc_feature 1..432: note = derived and/or modified sequence opt6 from anti-HIV_cap256-059-049839_VR-Chain
  source 1..432: mol_type = other RNA
caagtacaattagtagaaagtggaggaggagtagtacaaccaggaagaagtttaagattaagttgtgcagcaagtggatttagttttagtaattatgcaatggattgggtaagacaagcaccaggaaaaggattagaatgggtagcggtagtaagtagcgatggaaaaacaaaaaattatgcagatagtgtaaaaggaagatttacaataagtagagataatagtaaaaatacagtatatttacaaatgaatagtttaagaccagaagatacagcagtatattattgtgcaaaagacttaggagcaaataaagatgatgaatggacaacagattattatgattggagtgtagcatatccagtaccagatccaagagcagtagtaggagcatttgatgtatggggacaaggaacaatggtaacagtaagcagt

SEQ ID NO: 47909 - RNA, 432 nt, synthetic construct
  misc_feature 1..432: note = derived and/or modified sequence opt6 from anti-HIV_cap256-059-048503_VR-Chain
  source 1..432: mol_type = other RNA
caagtacaattagtagaaagcggaggcggagtagtacaaccaggaagaagcttaagactaagttgtgcagcgagccaactatcattctcaaactatggaatgcactgggtaagacaagcacccggaaaaggactagaatgggtagcaggaacatcattcgcaggaacaaaaaaatactatgcagatagcgtaaaaggaagatttacaataagcagagacaatagtaaaaacgcactatatctacaaatgaatagtttaagagcagaagatacagcattatattactgtgcaaaagacttaagagaatacgaatgcgaagaatgggcatcagactattacgatttcggaagagatcaaccatgccaagacccaagaggagtagtaggaacattcgatatatggggacaaggaacaatggtaacagtaagcgca

SEQ ID NO: 47910 - RNA, 432 nt, synthetic construct
  misc_feature 1..432: note = derived and/or modified sequence opt6 from anti-HIV_cap256-059-045516_VR-Chain
  source 1..432: mol_type = other RNA
caagtacaattagtagaaagtggaggaggagtagtacaaccaggaagaagtttaagattaagttgtgcagcaagtcaatttacattttcaggatatggaatgcattgggtaagacaagcaccaggaaaaggattagaatgggtagcagcaataagttttgcaggaaataaaagatattttgcagatagtgtaaaaggaagatttacaataagtagagataatagtaaaaatacattatttttacaaatgaatagtttaagagcagaagatacagcattatattattgtgcaagagatatgagagaatatgaatgtgaagaatgggcaagtgattattatgattttggaagaccacaaccatgtcaagatccaagaggagtagtaggagtatttgatatatggggacaaggaacaatggtaacagtaagtagt

SEQ ID NO: 47911 - RNA, 432 nt, synthetic construct
  misc_feature 1..432: note = derived and/or modified sequence opt6 from anti-HIV_cap256-059-044188_VR-Chain
  source 1..432: mol_type = other RNA
caagtacatttagtagaaagtggaggaggagtagtacaaccaggaagaagtttaagattaagctgtgcagcaagtcaattcacattttcaagttatggaatgcactgggtaagacaagcaccaggaaaaggactagaatgggtagcaggaatatcattcgcaggaacaaataaatattatgcagatagtgtaaaaggaagatttacagtaagcagagacaatagtaaaaatacattatatgtacaaatgaatagtttaagagcagaagatacagcactatattattgtgcaagagatttaagagaatacgaatgtgaagaatgggcatcagactattatgatttcggaagagaacaaccatgtcaagacccaagaggagtagtaggaatatttgatatatggggaccaggaacaatggtaacagtaagttca

SEQ ID NO: 47912 - RNA, 435 nt, synthetic construct
  misc_feature 1..435: note = derived and/or modified sequence opt6 from anti-HIV_cap256-059-044105_VR-Chain
  source 1..435: mol_type = other RNA
caaggacaattagtagaaagtggaggaggagtagtacaaccaggaagaagtttaagtttaagttgtgcagcaagtggatttagttttaataattatgcaatggattgggtaagacaagcaccaggaaaaggattagaatgggtagcagtagtaagtagtgatggaaataataaaaattatgcagatagtgtaaaaggaagatttacaataagtagagataatagtaaaaatacagtatatctacaaatgaatagtttaagagcagaagatacagcaatatattattgtgcaaaagatgtaggagcaaataaagatgatgaatgggcaacaaattattattatgattggtcagtagcatatccagtaccagatccaagagcagtaataggagcatttgatgtatggggacaaggaacaatggtaacagtaagtagt

SEQ ID NO: 47913 - RNA, 432 nt, synthetic construct
  misc_feature 1..432: note = derived and/or modified sequence opt6 from anti-HIV_cap256-059-042100_VR-Chain
  source 1..432: mol_type = other RNA
caagtacaattagtagaaagcggaggaggagtagtacaaccaggaagaagccaaagattaagctgtgcagcaagccaattcacattctcgagctatggaatgcactgggtaagacaagcaccaggaaaaggactagaatgggtagcagcaatatcattcgcaggaacaaacaaatactatggagatagcgtaaaaggaagatttacaataagtagagacaatagcaaaaacacactatatctacaaatgaatagtttaagagcagaagatacagcactatatcactgtgcaagagacatgagagaatacgaatgtgaagaatgggcatcagactattacgatttcggaagagatcaaccatgccaagacccaagaggagtagtaggaatattcgatttatggggacaaggaacaatggtaacagtaagctca

SEQ ID NO: 47914 - RNA, 432 nt, synthetic construct
  misc_feature 1..432: note = derived and/or modified sequence opt6 from anti-HIV_cap256-059-040742_VR-Chain
  source 1..432: mol_type = other RNA
caagtacaattagtagaaacaggaggaggagtcggacaaccaggaaaaagtttaagattaagctgtgcagcaagcggattcacattctcaaactttgcaatggactgggtaagacaagcaccaggaaaaggactagaatgggtagcatttatatcaagcgatggaataaacaaaaaatatggagatttcgtaaaaggaagatttacaataagtagagacaatagcaaaaacacactatttctacaaatgaatagcttgagagcagaagacacagcattatattactgtgcaaaagacgtaggagattacaaaagcgatgaatggggaacagactattacgatctatcgatagaatacccaatacaagacccaagagcagtagtaggagcattcgataactggggacaaggaacaatggtaatagtaagctca

SEQ ID NO: 47915 - RNA, 432 nt, synthetic construct
  misc_feature 1..432: note = derived and/or modified sequence opt6 from anti-HIV_cap256-059-040554_VR-Chain
  source 1..432: mol_type = other RNA
caagtacaattagtagaaagcggaggaggagtagtacaaccaggaagaagtttaagattaagctgtgcagcaagtcaattcacattctcaagttatggaatgcactgggtaagacaagcaccaggaaaaggattagaatgggtagcaggaatatcattcgcagcaacaaataaatactatggaggaagcgtaaaaggaagatttacaataagcagagacaatagtaaaaacacactatatctacaaatgaatagtttaagagcagaagatacagcattatattactgtacaagagacatgagagaatatgaatgtgaagaatgggcaagtgactattatgatttcggaaaagatcaaccatgtcaagacccaagaggagtagtaggaacactagatatatggggacaaggaacaatggtaacagtaagttca

SEQ ID NO: 47916 - RNA, 432 nt, synthetic construct
  misc_feature 1..432: note = derived and/or modified sequence opt6 from anti-HIV_cap256-059-039660_VR-Chain
  source 1..432: mol_type = other RNA
caagtacaattagtagaaagcggaggaggagtagtacaaccaggaagaagcttaagattaagctgtgcagcaagccaattctcattctcaaactatggaatgcactgggtaagacaagcaccaggaaaaggactagaatgggtagcatcaatatcattcgcaggaacaaaaaaaaaatatgcagatagcgtaaaaggaagatttacaataagcagagacaatagcaaaaatacactatttctacaaatgaatagcttaagaacagaagatgcagcactatattactgtgcaaaagacatgagagaattcgaatgcgaagaatgggcatcggactattacgatttcggaagagaacaaccgtgccaagacacaagagatgtagtaggaatattcgatatatggggacaaggaacaatggtaacagtaagttca

SEQ ID NO: 47917 - RNA, 435 nt, synthetic construct
  misc_feature 1..435: note = derived and/or modified sequence opt6 from anti-HIV_cap256-059-039298_VR-Chain
  source 1..435: mol_type = other RNA
caagtacaattagtagaaagcggaggaggagtagtacaaccaggaagaagtttaagattaagttgtgcagcaagtggatttacatttagtaaatatggaatgcattgggtaagacaagcaccaggaaaaggattagaatgggtagcatttgtagcatttgacgaaagtgataaatattatgcagcaagtgcaaaaggaagatttataataagtagagataatagtaaaaatacattaagtttacaaatgaatagtttaagaacagaagatacagcagtatattattgtgcaaaagaagtaggagataataaagatgatgaatggacaagtccatattattatgatataagtatagcatatccggtacaagatccaagagcagtagtaggaggatatgatgtatggggacaaggaacaatggtaacagtaagtagt

SEQ ID NO: 47918 - RNA, 432 nt, synthetic construct
  misc_feature 1..432: note = derived and/or modified sequence opt6 from anti-HIV_cap256-059-037873_VR-Chain
  source 1..432: mol_type = other RNA
caagtacaactagtagaaagtggaggaggagtagtacaaccaggaagaagcttaagattaagttgtgcagcaagtcaattcacattctcaaactatggaatgcattgggtaagacaagcaccaggaaaaggactagaatgggtagcagcaatatcattcgcaggaataaacaaatactatgcagatagcgtaaaaggaagatttacattaagcagagacaatacaaaaaacacactatatttacaaatgaatagcttaagagcagaagatacagcactatattactgtgcaagagacttaagagaatatgaatgcgaagaatgggcatcagactattacgatttcggaagaccacaaccatgccaagacccaagaggagtagtaggaacaagcgatatatggggacaaggaacaatggtaacagtaagctca

SEQ ID NO: 47919 - RNA, 432 nt, synthetic construct
  misc_feature 1..432: note = derived and/or modified sequence opt6 from anti-HIV_cap256-059-037633_VR-Chain
  source 1..432: mol_type = other RNA
caagtacaattagtagaaagcggaggaggagtagtacaaccaggaagatcattaagattaagctgtgcagcaagccaatttacattcagcaactttggaatgcactgggtaagacaagcaccaggaaaaggactagaatgggtagcagcaatatcattcgcaggaataaacaaaaactatgcagatagcgtaaaaggaagatttacaataagcagagacaatagcaaaaatacactacatctacaactaaatagtttaagagcagaagatacagcattatattactgtgcaaaagacttaagagaatacgaatgcgaagaatgggcatcagactattacgatttcggaagagatcaaccatgccaagacccaagaggagtagtaggaacatttgatatatggggacaaggaacaatggtaacagtaagctcg

SEQ ID NO: 47920 - RNA, 432 nt, synthetic construct
  misc_feature 1..432: note = derived and/or modified sequence opt6 from anti-HIV_cap256-059-036817_VR-Chain
  source 1..432: mol_type = other RNA
caagtacaattactagaaagcggaggaggagtagtacaaccaggaagaagcttaagattaagctgtgaagcaagccaattcacattctcaaactttggaatgcactgggtaagacaagcaccaggaaaaggactagaatgggtagcagcaatatcattcgcaggaataaaaaaaaactatgcagatagtgtaaaagggagatttacaataagcagagacaatagtaaaaacacactatatctacaaatgaatagcttaagagtagaagatacagcactatattactgtgcaaaagacttaagagaatacgaatgcgaagaatgggcatcagactattacgatttcggaagagaacaaccatgccaagacccaagaggagtaataggaacattcgatatatggggacaaggaacaatggtaacagtaagctca

SEQ ID NO: 47921 - RNA, 432 nt, synthetic construct
  misc_feature 1..432: note = derived and/or modified sequence opt6 from anti-HIV_cap256-059-032787_VR-Chain
  source 1..432: mol_type = other RNA
caagtacaattagtagaaagtggaggaggagtagtacaaccaggaagaagtttaagattaagttgtgcagcaagcggatttacattcagtaaatatgcaatgcattgggtaagacaagcaccaggaaaaggactagaatgggtagcatttgtagcatttgatgaaagtgataaatattatgtagatagtgtaaaaggaagatttacaataagtagagataatagtaaaaatacattaagtttacaaatgaatagtttaagagcagaagatacagcagtatattattgtgcaaaagaagtacatgtaaataaagatgatgaatgggcaagtgattattatgatttaagtatagcatatccaatacaagatccaagagcagtagtaggaggattagatatatggggacaaggaacaatggtaacagtaagtagt

SEQ ID NO: 47922 - RNA, 432 nt, synthetic construct
  misc_feature 1..432: note = derived and/or modified sequence opt6 from anti-HIV_cap256-059-032427_VR-Chain
  source 1..432: mol_type = other RNA
caagtacaattagtagaatcaggaggaggagtagtacaaccaggaagaagtttaagattaagctgtgcagcaagccaattcacattttcaaattttggaatgcactgggtaagacaagcaccaggaaaaggactagaatgggtagcaggaatatcatttccaggaacaaaaaaatactatgcagatagtgtaaaaggaagatttacaataagcagagacaatagcaaaaatgcattatatctacaaatgaatagcttaagagcagaagatacagcactatattattgtgcaagagatctaagagaatatgaatgtgaagaatgggcatcagactattatgatttcggaaaaccacaaccatgtttagacccaagaggagtagtaggaacatttgatatatggggacaaggaacaatggtaacagtaagttca

SEQ ID NO: 47923 - RNA, 435 nt, synthetic construct
  misc_feature 1..435: note = derived and/or modified sequence opt6 from anti-HIV_cap256-059-029390_VR-Chain
  source 1..435: mol_type = other RNA
caagtacaattagtagaatcaggaggaggagtagtacaaccaggaagatcactaagactatcatgcgcagcatcaggatttacatttaaccaacacggaatgcattgggtaagacaagcaccagacaaaggactagaatgggtagcattcgtaggatttgacgaaagtgaaaaatattacgcagactcagtaaaaggaagattcacaataagcagagataacagtaaaaatacattatcactacaaatgaactcactaagaccagaagacacagcagtatattattgcgcaaaagaagtaggagacaataaagaagatgaatgggcaagtgattactattacgatctatcaaatgcatacccaatacatgacccaagagcagtagtaggaggatacgatatatggggacaaggaacaatggtaacagtatgctca

SEQ ID NO: 47924 - RNA, 435 nt, synthetic construct
  misc_feature 1..435: note = derived and/or modified sequence opt6 from anti-HIV_cap256-059-027877_VR-Chain
  source 1..435: mol_type = other RNA
caagtacaattagtagaatcaggaggaggagtagtacaaccaggaagatcactaagattaagttgttcagcatcagcatttagttttagttattttgcaatggattgggtaagacaagcaccaggaaaaggattagaatgggtagcatttgtaagttcagatggaaataataaaaattatgcagattcagtaaaaggaagattcacaatatcaagagataatagtaaaaatacagtatttttacaaatggattcattaagaccagaagatacagcagtatattattgtgcaaaagatttaggaggaaataaagatgatgaatggtcaacaaattattattatgatatatcaatagcagatccagtaccagatccaagagcagtagcaggagcattcgatgtatggggacaaggaacaatggtaacagtatcatca

SEQ ID NO: 47925 - RNA, 435 nt, synthetic construct
  misc_feature 1..435: note = derived and/or modified sequence opt6 from anti-HIV_cap256-059-026640_VR-Chain
  source 1..435: mol_type = other RNA
caagtacaattagtagaaagtggaggaggagtagtacaaccaggaagaagtttaagattaagttgtgcagcaagtggatttagttttagcaaatatggaatgcattgggtaagacaagcaccaggaaaaggattagaatgggtagcatttgtagcatttgatgaaagcgatagatattatgcagcaagtgtaaaaggaagatttacaataagtagagataatagtaaaaatacattaagtttacaaatgaatagtttaagaacagaagatacagcaatatattattgtgcaaaagaagtaggagataataaagatgatgaatggacatcaccatattattatgatatgagtatagcatatccagtacaagatccaagagcagtagtaggaggatatgatatatggggacaaggaacaatggtaacagtaagtagt

SEQ ID NO: 47926 - RNA, 432 nt, synthetic construct
  misc_feature 1..432: note = derived and/or modified sequence opt6 from anti-HIV_cap256-059-026017_VR-Chain
  source 1..432: mol_type = other RNA
caagtacaattagtagaaagtggaggaggagtagtacaaccaggaagaagtttaagattatcatgtgcagcaagtggatttacatttagtacatatgcaatgcattgggtaagacaagcaccaggaaaaggattagaatgggtagcattaataagttatgatggaacaaataaatattatgtagatagcgcaaaaggaagatttacaatatcaagagataatagtaaaaatacattatatttacaaatgaatagtttaacaccagaagatacagcagtattttattgtgcaaaagatttaggaggatataaagatgatgaatggggaacagaatattatgatataagtgtaagttatccagtacaagatccaagagcagtagcaggagtatttgatgtatggggacatggaacaatggtaacagtaagtagt

SEQ ID NO: 47927 - RNA, 432 nt, synthetic construct
  misc_feature 1..432: note = derived and/or modified sequence opt6 from anti-HIV_cap256-059-024100_VR-Chain
  source 1..432: mol_type = other RNA
tgtcaagtattagtagaaagcggaggaggagtagtacaaccaggaagaagtctaagattaagctgtgcagcaagtcaattcacattttcaagttatggaatgcactgggtaagacaagcaccaggaaaaggactagaatgggtagcagcaatatcatttgcaggaacaaaaaaatattatgcagatagtgtaaaaggaagatttgcaataagcagagacacaagtaaaaatgcactatatttacaaatgaatacattaagagcagaagatacagcattatattactgtgcaagagatttaagagaatttgaatgtgaagaatgggcatcagactattatgatttcggaagaccacaaccatgtcaagacccaagaggagtagtaggatcatttgatatatggggacaaggaacaatggtaacagtaagttta

SEQ ID NO: 47928 - RNA, 432 nt, synthetic construct
  misc_feature 1..432: note = derived and/or modified sequence opt6 from anti-HIV_cap256-059-023966_VR-Chain
  source 1..432: mol_type = other RNA
caagtacaattagtagaaagcggaggaggagtagtacaaccaggaagaagtctaagattaagttgtgcagcaagtcaattctcattctcaagctatggaatgcactgggtaagacaagcaccaggaaaaggattagaatgggtagcagcaatatcattcgcaggaataaaaaaacactatacagatagcgtaaaaggaagatttacaataagcagagacaatagcaaaaacacattatatctacaaatgaatagcttaagagcagaagatacagcactatattactgtgcaaaagacttgagaggattcgaatgcgaagaatgggcatcagactattacgatttcggaagagatcaaccatgccaagacccaagaggagtagtaggaacattcgatatatggggacaaggaacattagtaacagtaagcagt

SEQ ID NO: 47929 - RNA, 432 nt, synthetic construct
  misc_feature 1..432: note = derived and/or modified sequence opt6 from anti-HIV_cap256-059-020534_VR-Chain
  source 1..432: mol_type = other RNA
caagtacaattagttgaaagtggaggaggagtagtacaaccaggaagaagtttaagattaagctgtgcagcaagtcaatttacattttcaaactatggaatgcattgggtaagacaagcaccaggaaaaggattagaatgggtagcaggaatgtcatttgcaggaacaaatacatattatgcagatagtgtaaaaggaagatttacaataagtagagataatagtaaaaatacgttatatttacaaatgaatagtttaagagcagtagatacagcattatattattgtgcaagagatatgagagaatatgaatgtgaagaatgggcatcagattattatgattttggaagagaatatccatgtcaagacccaagaggagtagtaggaatatttgatttatggggacaaggaacaatggtaacagtaagctca

SEQ ID NO: 47930 - RNA, 435 nt, synthetic construct
  misc_feature 1..435: note = derived and/or modified sequence opt6 from anti-HIV_cap256-059-019513_VR-Chain
  source 1..435: mol_type = other RNA
caagtacaattagtagaatcaggaggaggagtagtacaaccaggaagatcactaagactatcatgcgcagcatcgggatttacatttagcaatttcgcaatgggatgggtaagacaagcaccaggaaaaggactagaatgggtagcagtaataagctcagacggaacaaataaaaattacggagactcagtaaaaggaagattcacaatatcaagagataacagcaaaaatacattattcttacaaatgaactcactaagagcagaagacacatcattatactattgcgcaaaagatctaggaggatataaaacagacgaatgggcaacaaattactattacgatatatcaatagcaagcccaatacaagacccaagagcagtagtaggagcattcgatatatggggacaaggaacaatggtaacagtaacatca

SEQ ID NO: 47931 - RNA, 432 nt, synthetic construct
  misc_feature 1..432: note = derived and/or modified sequence opt6 from anti-HIV_cap256-059-012963_VR-Chain
  source 1..432: mol_type = other RNA
caagtacaattagtagaaagtggaggaggagtagtacaaccaggaagaagtttaagattaagttgtgtagcaagtggatttagtttttcaagttatggaatggcatgggtaagacaagcaccagggaaaggattagaatgggtaacagtaataagttttgcaggagtaaaaacatattatgcagatagtgtaaaaggaagatttacaataagtagagacaatagtaaaggaacattatatttacaaatggatggattaagaccagaagatacagcattatattattgtgcaaaagatttagcagaaagagaatgtgaagaatgggcaagtgattattatgattttggaagagaattaccatgtcaagatccaagaggagtagtaggaacatttgatgtatggggacaaggaacaatggtaacagtaagtagt

SEQ ID NO: 47932 - RNA, 435 nt, synthetic construct
  misc_feature 1..435: note = derived and/or modified sequence opt6 from anti-HIV_cap256-059-010396_VR-Chain
  source 1..435: mol_type = other RNA
caagtacaattagtagaatcaggaggaggagtagtacaaccaggaagatcactaagattatcatgtgcagcatcaggattttcatttaataattatgcaatgaattgggtaagacaagcaccaggaaaaggattagaatgggtagcatttgtaagttcagacggaagtaataaaaattatgcagattcagtaacaggaagatttacattatcaagagataatagtaaaaatacagtatttttacaaatgaatagtttaagagtagaagacacagcagtatattattgtgcaaaagatgtaggagcaaataaagatgatgaatggacaacaaattattattatgatatatcaatagcagatccagtaccagatccaagagcagtaataggagcatttgatgtatggggacaaggaacaatggtaacagtatcatca

SEQ ID NO: 47933 - RNA, 432 nt, synthetic construct
  misc_feature 1..432: note = derived and/or modified sequence opt6 from anti-HIV_cap256-059-008136_VR-Chain
  source 1..432: mol_type = other RNA
caagtacaattagtagaaagtggaggaggagtagtacaaccaggaagaagtctaagactaagctgtgcagcaagcggattcacattcaatacatatgcaatgcactgggtaagacaagcaccaggaaaaggactagaatgggtagcattaatatcatatgatggaacagaaaaatactatgcagattcagtaaaaggaagatttacaataagcagagacaatagcagaaacacactatatctacaaatgaatagcttaagattagaagatgcagcattatatcaatgtgcaaaagacttaggaggaagtaaaagcgacgaatggggaacagactattacgatatgtcaatatcatacccaatacaagacccaagagcagtagcaggagtattcgatatatggggacaaggaacattagtaacagtaagttca

SEQ ID NO: 47934 - RNA, 432 nt, synthetic construct
  misc_feature 1..432: note = derived and/or modified sequence opt6 from anti-HIV_cap256-059-006147_VR-Chain
  source 1..432: mol_type = other RNA
caagtacaagtagtagaaagcggaggaggagtagtacaaccaggaagaagtttaagattaagctgtacagcaagcggattcacattctcaaactttgcaatgggatgggtaagacaagcaccaggaaaaggactagaatgggtagcatttatatcaagcgatggatcaaacaaaaactatggagatagtgtaaaaggaagatttacaataagtagagacaatagtaaaaacacagtatttctacaaatgaatagtttaagagtagaagatacagcactatattactgtgcaaaagacgtaggagattacaaaagcgatgaatggggaacagaatattacgatatatcaatatcgtacccaatacaagacccaagagcaatggtaggagcattcgatctatggggacaaggaacaatggtaacagtaagccca

SEQ ID NO: 47935 - RNA, 432 nt, synthetic construct
  misc_feature 1..432: note = derived and/or modified sequence opt6 from anti-HIV_cap256-059-005081_VR-Chain
  source 1..432: mol_type = other RNA
caagtacaattagtagaaagcggaggaggagtagtacaaccaggaagaagcttaagattaagttgtgcagcaagtcaattcacattctcaagctatggaatgcactgggtaagacaagcaccaggaaaaggactagaatgggtagcaggaatatcattcgcagcaacaaaaaaatactatagcgaaagcgtaaaaggaagatttacaataagcagagacaatagcaaaaacgcactacatctacatatgaatagtttacgagcagaagatacagcattatattactgtgcaaaagacttaagagaattcgaatgcgaagaatgggcatcagactattacgatttcggaagagatcaaccatgccaagacccaagaggagtagtaggaatattcgatatgtggggacaaggaacaatggtaacagtaagttca

SEQ ID NO: 47936 - RNA, 432 nt, synthetic construct
  misc_feature 1..432: note = derived and/or modified sequence opt6 from anti-HIV_cap256-059-005006_VR-Chain
  source 1..432: mol_type = other RNA
caagcacaattagtagaaagtggaggaggagtagtacaaccagcaaaaagtttaagattaagttgtgcagcaagtggatttacatttaataaatatgcaatgcattgggtaaggcaagcaccaggaaaaggattagaatgggtagcatttgtagcatttgatgaaagtgataaatattatgcagatagtgtaaaaggaagatttacaataagtagagataatagtaaaaatacattaagtttacaaatgaataatttaagagcagaagatacagcagtatattattgtgcaaaagaagtaggagataataaagatgatgaatgggcaagtgattattatgatttaagtatagcatatccaatacaagatccaagagcagtaggaagaggatatgatatatggggacaaggaacaatggtaacagtaagtagt

SEQ ID NO: 47937 - RNA, 432 nt, synthetic construct
  misc_feature 1..432: note = derived and/or modified sequence opt6 from anti-HIV_cap256-059-004451_VR-Chain
  source 1..432: mol_type = other RNA
caagtacatttagtagaaagtggaggaggagtagtacaaccaggaaaaagtttgagattaagttgtacagcaagtggatttacatttacaaattttgcaatggactgggtaagacaagcaccaggaaaaggattagaatgggtagcatttatatcaagtgatggatcaaataaatattatagtgaaagtgtaaaaggaagatttacaataagcagagacaatagtaaaaatacattatatgtacaaatgaatagtttaagaacagaagatacagcagtatattactgtgcaaaagatttaggaggatataaagatgatgaatggagtacagactattatgattggtcaacagcatatccagtacaagacccaagagcagtagcaggagcatttgatttatggggacaaggaacaatggtaagcgtaagttca

SEQ ID NO: 47938 - RNA, 432 nt, synthetic construct
  misc_feature 1..432: note = derived and/or modified sequence opt6 from anti-HIV_cap256-059-003571_VR-Chain
  source 1..432: mol_type = other RNA
caagaacaattagtagaaagtggaggaggagtagtacaaccaggaagaagtttaagattaagttgtgcagcaagccaatttacatttggagcatatggaatgcattgggtaagacaagcaccaggaaaaggattagaatgggtagcaggagtaagttttgtaggaaataataaatattatgcagatagtgtaaaaggaagatttacaataagtagagataatagtaaaaatacattatatttacaaatgaatagtttaagaggagaagatacagcattatattattgtgcaagagatatgagagaaatggaatgtgaagaatgggcaagtgattattatgattttggaagaccacaaccatgtcaagatccaagaggagtagtaggaatatttgatatgtggggacaaggaacaatggtaacagtaagtagc

SEQ ID NO: 47939 - RNA, 432 nt, synthetic construct
  misc_feature 1..432: note = derived and/or modified sequence opt6 from anti-HIV_cap256-059-003449_VR-Chain
  source 1..432: mol_type = other RNA
caagtacaattagtagaaagcggaggaggagtagtacaaccaggaaaaagcttaagattaagctgtgcagcaagccaagtaacattctcaagctatggaatgcactgggtaagacaagcaccaggaaaaggactagaatgggtagcaggaatatcattcgcaggaacaaaaaaatactatgcagatagcgtaaaaggaagatttacaataagtagagacaatagcaaaaacgcactatatctacaaatgaatagattaagagcaggagatacagcactatattactgtgcaaaagacttaagagaatacgaatgcgaagaatgggcatcagactattacgattttggaagagaacaaccatgccaagacccaagaggggtagtaggaatattcgatatatggggattaggaacaatggtaacagtaagttca

SEQ ID NO: 47940 - RNA, 432 nt, synthetic construct
  misc_feature 1..432: note = derived and/or modified sequence opt6 from anti-HIV_cap256-059-002712_VR-Chain
  source 1..432: mol_type = other RNA
caagtacaattagcagaaagtggaggaggagtagtacaaccaggaagaagcttaagattaagctgtgcagcaagccaattcacattcagtagctatggaatgcactgggtaagacaagcaccaggaaaaggactagaatgggtagcagcaatatcattcgcaggaacaaaaaaacactatgcagatagcgtgaaaggaagatttacaataagcagagacaatagcaaaaacacactaaatttacaaatgaatagtttaagagcagaagatacagcactatattactgtgcaagagacatgcgagaatatgaatgcgaagtatgggcatcagactattacgatttcggaagagaacaaccatgccaagacccaagaggagtagtaggaacatttgatatatggggacaaggaacaatggtaacagtaagccca

SEQ ID NO: 47941 - RNA, 432 nt, synthetic construct
  misc_feature 1..432: note = derived and/or modified sequence opt6 from anti-HIV_cap256-059-001573_VR-Chain
  source 1..432: mol_type = other RNA
caagtacaattagtagaaagtggaggcggagtagtacaaccaggaagaagtttgagattaagttgtgcagcaagccaattcacattctcaagttatggaatgcactgggtaagacaagcaccaggaaaaggactagaatgggtagcaggaatatcatatgatggaacaagtaaatactatgcagatagcgtaaaaggaagatttacaataagtagggacaatagcaaaaacacattatatttacaaatgaatagcttaagagcagaagatacagcactatattactgtgcaaaagacttaagagaagacgaatgcgaagaatggtggtcagactattacgatttcggaagagaactaccatgcagaaaatcaagaggggtagcaggaacattcgatatatggggacatggaacaatggtaaccgtaagttca

SEQ ID NO: 47942 - RNA, 432 nt, synthetic construct
  misc_feature 1..432: note = derived and/or modified sequence opt6 from anti-HIV_cap256-059-001379_VR-Chain
  source 1..432: mol_type = other RNA
caagtaagattagtagaaagcggaggaggagtagtacaaccaggaaggagcttaagactaagctgtgcagcaagtggatttacatttaatagttatccaatgcactgggtaagacaagcacccggaaaaggactagattgggtagcattaatatcatatgatggaacaaataaattttatgtagatagtgtaaaaggaagatttacaataagcagagacaatagtaaaaatacactatatttacaaatgaatagtttaacagcagaagatacagcaatgtattactgtgcaaaagatttaggaggaaataaagatgatgaatggggaacagactattatgatatatcagtagcttatccaatacatgacccaagagcagtagcaggaatatttgatgtatggggacatggaacaatggtaacagtaagttca

SEQ ID NO: 47943 - RNA, 432 nt, synthetic construct
  misc_feature 1..432: note = derived and/or modified sequence opt6 from anti-HIV_cap256-059-001029_VR-Chain
  source 1..432: mol_type = other RNA
caagaacaattagtacaaagtggaggaggagtagtacaaccaggaagaagcttaagattaagctgtgcaccaagtcaattcacattctcagcacatggaatgcattgggtaagacaagcaccaggaaaaggactagaatgggtagcaggaataagtttcgcaggaacaaaaaattactatgcagatagcgtaaaaggaagatttacaataagtagagacaatagcaaaaacacactatatctacaaatgaatagcttaagagtagaagatacagcactatattactgtgcaaaagacatgagagaaatggaatgcgaagaatgggcatcagactattacgatttcggaagacatcaaccatgccaagacccaagaggagtagtaggaatattcgatatatggggacaaggaacaatggtaacagtaagctca

SEQ ID NO: 47944 - RNA, 432 nt, synthetic construct
  misc_feature 1..432: note = derived and/or modified sequence opt6 from anti-HIV_cap256-048-165087_VR-Chain
  source 1..432: mol_type = other RNA
gaagtaaaattattagaaagtggaggaggattagtacaaccaggaggatatagaagattaagttgtgcagcaagtggatttacatttagtagatatgcaatgcattgggcaagacaagcaccaggaaaaggattagaatgggtagcagtagtaagtgatgatggagtaaaaaaatattatccagattcagtaagaggaagatttacaataagcagagataatagtagaaatacagtatcattacaaatgaatagcttaagaccagaagatacagcagtatattattgtgcaaaagatgtaggagcaaataaagatgatgaatgggcaacagattattatgatttaagtatagcatatccagtaccagatccaagagcagtagtaggagcatttgatatatggggacaaggaacaatggtaacagtaagtagt

SEQ ID NO: 47945 - RNA, 432 nt, synthetic construct
  misc_feature 1..432: note = derived and/or modified sequence opt6 from anti-HIV_cap256-048-158861_VR-Chain
  source 1..432: mol_type = other RNA
gaagtacaattagtagaaagtggaggaggattagtacaaccaggaggaagtttaagattaagttgtgtagattttggatttagattttcagaatattggatgagttgggtaagacaagcaccaggaaaaggattagaatgggtagcagtaataagttatgatggaacaaataaatattatgcagatagcgtgaaaggaagatttacaataagtagagataatagcaaaaatacattatatttacaaatgaatagtttaagagcagaagatacagcattatattattgtgcaaaagatatgagagaaagtgaatgtgaagaatgggcgtcagattattatgattttggaaaagattatccatgtcaagatccaaggggagtagtaggaacatttgatatatggggacaaggaacaatggtaacagtaagtagt

SEQ ID NO: 47946 - RNA, 435 nt, synthetic construct
  misc_feature 1..435: note = derived and/or modified sequence opt6 from anti-HIV_cap256-048-158280_VR-Chain
  source 1..435: mol_type = other RNA
caagtacatctagtagaatcaggaggaggagtagtacaaccaggaagatcactaagaatatattgcgcagtatcagaatttacattcagaaattacgcaatgcattgggtaagattagcaccaggaaaaggattacaatgggtagcagtaataagccatgacggaataaatgactattacgcagactcagtaaaaggaagattcacaatatcaagagataacagcaaaaatacagtgtcattacaaatgaactcactaagaccagaagacacagcagtatactattgcgcaaaagatctaggagcaaataaagatgacgaatgggcaacagattactatgacttaagcatagcatatccagtaccagatccaacaggaccatggtttggagcattcgatatatggggacaaggaacaatggtgacagtaagctca

SEQ ID NO: 47947 - RNA, 432 nt, synthetic construct
  misc_feature 1..432: note = derived and/or modified sequence opt6 from anti-HIV_cap256-048-157928_VR-Chain
  source 1..432: mol_type = other RNA
caagtacaattaatggaaagcggaggaggagtagtacaaccaggaagaagtttaagattaagctgtgcaataagtggattcacattttcaaattattggatgagctgggtaagacaagcaccaggaaaaggactagaatgggtagcagtaatatcaagtgatggatcaagtaaaaattatgcagatagtgtaaaaggaagatttacaataagcagagataatagcaaaaatacagtatcattacaaatgaatagtttaagaccagaagatacagcagtatattattgtgcaaaagatgtaggagcaaataaagatgatgaatgggcaacagactattatgatttatcaatagcatatccagtaccagacccaagagcagtagtaggagcatttgatatatggggacaaggaacaatggtaacagtaagttca

SEQ ID NO: 47948 - RNA, 432 nt, synthetic construct
  misc_feature 1..432: note = derived and/or modified sequence opt6 from anti-HIV_cap256-048-157056_VR-Chain
  source 1..432: mol_type = other RNA
caagtacaattagtagaaagtggaggaggggtagtacaaccaggaagaagtttaagattaagctgtgcagcaagcggatttacactaagtagttatgcaatgcattgggtaagacaagcaccaggaaaaggattagaatgggtagcatttataagtaatgatggaagtaataaatattttgcagatagtgtaaaaggaagatttacaataagtagagataatagtaaaaatacattatatttacaaatgaatagtttaagagcagaagatacagcagtatattactgtgcaaaagatttaggaggaaataaagatgatgaatgggcaacagattattatgatttaagtatagcatatccagtacaagatccaagagtagtagtaggaatatttgatatatggggacaaggaacaatggtaacagtaagtagt

SEQ ID NO: 47949 - RNA, 432 nt, synthetic construct
  misc_feature 1..432: note = derived and/or modified sequence opt6 from anti-HIV_cap256-048-156422_VR-Chain
  source 1..432: mol_type = other RNA
caagtacaattagtagaaagtggaggaacagtagtacaaccaggaagaagtttaagattaagctgtgtaggaagtggattttcattaagttactatgcaatacattgggtaagacaagcaccaggaaaaggactagaatgggtagcagtaataagttatgatggaagtaattattattatgcagatagtgtaaaaggaagatttacaataagtagagataatagcaaaaatacagtatatttacaaatgaatagtttaagaggagtagatacagcagtatattattgtgcaaaagatttaggaggaggagaagtagaagaatgggcaacagattattatgattggagtatagcatatccagtagaacatccaagagcagtagtaggagtatttgatatatggggacaaggaacaaaagtaacagtaagtagt

SEQ ID NO: 47950 - RNA, 432 nt, synthetic construct
  misc_feature 1..432: note = derived and/or modified sequence opt6 from anti-HIV_cap256-048-152863_VR-Chain
  source 1..432: mol_type = other RNA
gaagtacaattattagaaagtggaggaggattagtacaaccaggaggaagtttaagattaagttgtgcaggaagtggatttacatttagtaaacatggaatgcattgggtaagacaagcaccaggaaaaggattagaatgggtagcatttgtagcatttgatgaaagtgataaatattatgcagatagtgtaaaaggaagattcacaataagtagagataatagtaaaaatacactaagtttacaaatgaatagcttaagagcagaagatacagcaatgtattattgtgcaaaagaagtaggagataataaagatgatgaatgggcaagtgattattatgatttaagtatagcatatccagtacatgatccaagagcagtagtaggaggatatgatatatggggacaaggaacaatggtaacagtaagtagt

SEQ ID NO: 47951 - RNA, 432 nt, synthetic construct
  misc_feature 1..432: note = derived and/or modified sequence opt6 from anti-HIV_cap256-048-152770_VR-Chain
  source 1..432: mol_type = other RNA
caagtacaattagtagaaagtggaggaggagtagtacaaccaggaagaagtttaagattaagttgtgcagcaagtggatttacatttagaagtaatgcaatgcattgggtaagacaagcaccaggaaaaggactagaatgggtagcagtaataagttatgatggaagtaaaacatattatgcagatagtgtaaaaggaagatttacaataagtagagataatagtaaaaatacactatatctacaaatgaatagtttaagagcagaagatacagcagtatattattgtgcgaaagatttaggagaatataaaagtgatgaatgggcaacagattattatgatttaagtatagcatatccagtacaagatccaagaggagtagcaggagcatttgatatatggggacaaggaacaatggtaacagtaagtagt

SEQ ID NO: 47952 - RNA, 432 nt, synthetic construct
  misc_feature 1..432: note = derived and/or modified sequence opt6 from anti-HIV_cap256-048-150027_VR-Chain
  source 1..432: mol_type = other RNA
gaagtacaattagtagagagcggaggaggattagtacaaccaggaggatcattaagattaagctgtgcagtaagcggattcacattcagcagttatataatgcactgggtaagacaagcaccaggaaaaggactagaatgggtagcagtaatatcatatgatggatcaaacaaagactatgcagatagcgtaaaaggaagatttacaataagtagagacaatagtaaaaacacactatatctacaaatgaatagtttaagagcagaagatacagcactatattactgtgcaaaagacttaagagaatacgaatgcgaagaatgggcatcagactattacgatttcggaagagattacccatgccaagacccaagaggagtagtaggaacattcgatatatggggacaaggaacaatggtaacagtaagctca

SEQ ID NO: 47953 - RNA, 432 nt, synthetic construct
  misc_feature 1..432: note = derived and/or modified sequence opt6 from anti-HIV_cap256-048-148246_VR-Chain
  source 1..432: mol_type = other RNA
caagtacaattagtagaaagtggaggaggagtagtacaaccaggaagaagtttaagattaagttgtgcaacaagtggatttacatttagtacatatagtatgcattgggtaagacaagcaccaggaaaaggattagaatgggtagcagtaataagttatgatggaagtaatgaatattatgtagatagtgtaaaaggaagatttacaataagtagagataatagtaaaaatacattatatttacaaatgaatagtttaagagtagaagatacagcattatattattgtgcaaaagatctaggaggaaataaagatgatgaatggggaacagattattatgattttagtgtagcatatccagtacaagatccaagggcagtaagtggaatatttgatgtatggggacatggaacaatggtaacagtaagtagt

SEQ ID NO: 47954 - RNA, 432 nt, synthetic construct
  misc_feature 1..432: note = derived and/or modified sequence opt6 from anti-HIV_cap256-048-147428_VR-Chain
  source 1..432: mol_type = other RNA
caagtacaattagtagaaagcggaggaggagtagtacaaccgggaagaagtttaagattaagttgtagcgcaagcggattcacattctcaaattatggaatgcactgggtaagacaagcgccaggaaaaggactagaatgggtagcagtaatatcattcgatggatcaaataaagtatatgcagatagcgtaaaaggaagatttacaataagtagagacaatagcaaaaacacactatatctagaaatgaatagcttaagagcagaagatacagcagaatattactgtgcaaaagacttaggagaaagtgataaagaagaatggccatcagactattacgatttcggaagagatttcacaggacaagtcccaagagcagtagtaggaatattcgatatgtggggacaaggaacaatggtaacagtaagttca

SEQ ID NO: 47955 - RNA, 432 nt, synthetic construct
  misc_feature 1..432: note = derived and/or modified sequence opt6 from anti-HIV_cap256-048-146603_VR-Chain
  source 1..432: mol_type = other RNA
gaagtacaattagtagaaagtggaggaggattagtacaaccaggaagaagtttaagattaagctgtgcagcaagtggatttacatttgatgattatgcaatacattgggtaagacaagcaccaggaaaaggattagaatgggtagcattaatatcatatgatggaacagataaatattatgcagatagtgtaaaaggaagatttacaataagtagagataatagcaaaaatacattatatttacaaatgaatagtttaagagtagaagatacagcagtatatcattgtgcaaaagatttaggaggaacaaaaagtgatgaatgggcaacagattattatgatttaagtatagcatatccaatacaagatccaggagcagtagtaggagtatttgatatatggggacaaggaacaatggtaacagtaagtagt

SEQ ID NO: 47956 - RNA, 432 nt, synthetic construct
  misc_feature 1..432: note = derived and/or modified sequence opt6 from anti-HIV_cap256-048-145735_VR-Chain
  source 1..432: mol_type = other RNA
caagtacaattagtacaaagtggaggaggagtagtacaaccaggaagaagtctaagattaagttgtggagcaagtggatttacatttagtaattatgcaatgcattgggtaagacaagcaccaggaaaaggattagattgggtagcagtaataagttatgatggaacaaatgaaaatcatgcagatagtgtaaaaggaagatttacaataagcagagataatagcaaaaatacagtatatttacaaatgaatagtttaagagcagaagatacagcagtatattattgtgcaaaagatgtaggaggaagtaaagatgatgaatgggcaacagattattatgatttaagtatagcatatccagtaccagatccaagagcagtagtaggagcatttgatatatggggacaaggaacaatggtaacagtaagtagt

SEQ ID NO: 47957 - RNA, 432 nt, synthetic construct
  misc_feature 1..432: note = derived and/or modified sequence opt6 from anti-HIV_cap256-048-145116_VR-Chain
  source 1..432: mol_type = other RNA
caagtacacctagtagaaagcggaggaggagtagtacaaccaggaggaagtttaagattaagctgtgcagcaagcggattcacattctcaaattatggaatgcactgggtaagacaagcaccaggaaaaggactagaatgggtagcagcaatatcattcgcaggaacaaataaatactatgcagatagtgtaaaaggaagatttacaataagcagagacaatagtaaaaacgcactatatttacaaatgaatagtttaagagcagaagatacagcactatattactgtgcaaaagacttaagagaaagtgaatgtgaagaatgggcatcagactattacgatttcggaagagattatccatgtcaagacccaagaggagtagtgggaacactagatatatggggtcaaggaacaatggtaacagtaagttca

SEQ ID NO: 47958 - RNA, 432 nt, synthetic construct
  misc_feature 1..432: note = derived and/or modified sequence opt6 from anti-HIV_cap256-048-144077_VR-Chain
  source 1..432: mol_type = other RNA
caagtaaaattagtagaaagcggaggaggagtagtacaaccaggaagaagtttaagattaagctgtgcagcaagtggatttacattatcaagttatgcaatgcattgggtaagacaagcaccaggaaaaggactagaatgggtagcagtgatatcatatgatggatcaaatagatatacagcagatagcgtaaaaggaagatttacaataagtagagacaatagtaaaaatacattaaatttacaaatgaatagtttaagaccagaagatacagcagtatattattgtgcaaaagatgtaggagcaaataaagatgatgaatgggcaacagattattatgatttaagtatagcatatccagtaccagacccaagagcagtagtaggagcatttgatatatggggacaaggaacaacagtaacagtatcatca

SEQ ID NO: 47959 - RNA, 432 nt, synthetic construct
  misc_feature 1..432: note = derived and/or modified sequence opt6 from anti-HIV_cap256-048-142876_VR-Chain
  source 1..432: mol_type = other RNA
caagtacaattagtagaaagtggaggaggagtagtacaaccgggaggaagtttaagattaagttgtgtagcaagtggatttacatttagtacatatggaatgcattgggtaagacaagcaccaggaaaaggattagaatgggtagcatttatgagatttgatggaagtaatagatattatggagatagtgtaaaaggaagatttacaataagtagagataatagtaaaaatacattatatttacaaatgataagtctaagagcagaagatacagcagtatatcattgtgcaaaagatttaggaggaaataaaccagatgaatgggcaacagattattatgatttaagtatagcatatccagtacaagatccaagagcagtagtaggagtatttgatatatggggacaaggaacaataataacagtaagtagt

SEQ ID NO: 47960 - RNA, 432 nt, synthetic construct
  misc_feature 1..432: note = derived and/or modified sequence opt6 from anti-HIV_cap256-048-140582_VR-Chain
  source 1..432: mol_type = other RNA
caagtacaattagtagaaagtggaggaggagtagtacaaccaggaagaagtttaagattaagttgtgcagcaagtgggtttagctttagtaattatgcaatggattgggtaagacaagcaccaggaaaaggattagaatgggtagcatttgtaagcagtgatggaagtaataaaaattatgcagatagtgtaaaaggaagatttacaataagtagagataatagtaaaaatacagtgtatttacaaatgaatagtttaagagtagaagatacagcagtatattattgtgcaaaagatttaggagcaaataaagatgatgaatgggcaacagattattatgatttaagtgtagcatatccagtaccagatccaagagcagtagtaggagcattcgatgtatggggacaaggaacaatggtaacagtaagtagt

SEQ ID NO: 47961 - RNA, 432 nt, synthetic construct
  misc_feature 1..432: note = derived and/or modified sequence opt6 from anti-HIV_cap256-048-139355_VR-Chain
  source 1..432: mol_type = other RNA
caagtacaattagtagaaagcggaggaggagtagtacaaccaggaagaagtttaagattaagctgtgcagcaagtggatttacatttagtagttatgcaatgcattgggtaagacaagcaccaggaaaaggattagaatgggtagcaataattagttatgatggaagtaataaatattatgcagatagtgtaaaaggaagatttacaataagcagagataatagtaaaggaacattatatttacaaatggatggaccaagaccagaagatacagcattatattattgtgcaaaagatttaggagaaagagaatgtgaagaatgggcaagtgattattatgattttggaagagattttccatgtcaagatccaagaggagtagtaggaacatttgatatatggggacaaggaacaatggtaacagtaagtagt

SEQ ID NO: 47962 - RNA, 432 nt, synthetic construct
  misc_feature 1..432: note = derived and/or modified sequence opt6 from anti-HIV_cap256-048-139151_VR-Chain
  source 1..432: mol_type = other RNA
caagtacaattagtagaaagcggaggaggagtagtacaaccaggaaaaagtttaagattaagctgtgcagcaagcggattcacattcaatacatatggaatgcactgggtaagacaagcaccaggaaaaggactagaatgggtagcagtaatatcatacgatggatcaatacaaaaatatgcagatagcgtaaaaggaagatttacaataagcagagacaatagtaaaaacacactatatctacaaatgaatagcttaagcgtagaagatacagcagtatattactgtgcaaaagacttagggaaaaacaaagacgatgaatgggcaacagactattacgatatatcaatagcatacccagtaccagacccaagagcagtagtaggagtattcgatatatggggacaaggaacagtagtaacagtaagctca

SEQ ID NO: 47963 - RNA, 432 nt, synthetic construct
  misc_feature 1..432: note = derived and/or modified sequence opt6 from anti-HIV_cap256-048-137672_VR-Chain
  source 1..432: mol_type = other RNA
gaagtacaattagtagaaagcggaggaggagtagcaagaccaggaggaagtttaagattaagttgtgcagcaagtggatttatatttacacattatgcaatggattgggtaagacaagcaccaggaaaaggattagaatgggtagcagtaataagtagcgatggaagtagtaaaaattatgcagatagtgtaaaaggaagatttacaataagtagagataatagtaaaaatacagtatcattacaaatgaatagtttaagaccagaagatacagcagtatattattgtgcaaaagatgtaggagcaaataaagatgatgaatgggcaacagattattatgatttaagtatagcatatccggtaccagatccaagagcagtagtaggagcatttgatatatggggacaaggaacaatggtaacagtaagtagt

SEQ ID NO: 47964 - RNA, 432 nt, synthetic construct
  misc_feature 1..432: note = derived and/or modified sequence opt6 from anti-HIV_cap256-048-137506_VR-Chain
  source 1..432: mol_type = other RNA
caagtaagattagtagatagcggaggaggagtagtacaaccaggaggaagtttaagattaagctgtgcagcaagcggattcacattctcaacatatggaatgcactgggtaagacaagcaccaggaaaaggactagaatgggtagcatttataagaagcgatggatcaaacaaatactatgcagatagcgtacaaggaagatttagcataagcagagacaatagcaaaaacacactatatttacaaatgaatagcttaagagcagaagatacagcagtatattactgtgcaaaagacttaggagaaagcgataaagaagaatggccatcagactattacgatttcggaagagatttcacaggacaagacccaagagcagtagtaggagtattcgatatatggggacaaggaacaacagtaatagtaagttcg

SEQ ID NO: 47965 - RNA, 432 nt, synthetic construct
  misc_feature 1..432: note = derived and/or modified sequence opt6 from anti-HIV_cap256-048-137270_VR-Chain
  source 1..432: mol_type = other RNA
caagtacaattagtagaaagtggaggaggagtagtacaaccaggaagaagtctaagattaagttgtgcagcaagtggatttacatttagtagttatgcaatgcattgggtaagacaagcaccaggaaaaggattagaatgggtagcagtaatgagcccagatggaagtaatagatattatacagatagtgtaaaaggaagatttacgataagtagagataatagtaaaaatacattaagtttacaaatgaatagcttaagaccagaagatacagcagtatattattgtgcaaaagatgtaggagcaaataaagatgatgaatgggcaacagattattatgatttaagtatagcatatccagtaccagatccaagagcagtagtaggagcatttgatatatggggacaaggaacaatggtaacagtaagtagt

SEQ ID NO: 47966 - RNA, 432 nt, synthetic construct
  misc_feature 1..432: note = derived and/or modified sequence opt6 from anti-HIV_cap256-048-135447_VR-Chain
  source 1..432: mol_type = other RNA
gaagtacaattagtagaaagcggaggagcagtagtacaaccaggaagaagcttaagattaagctgtacagcaagcggattcagtttcacaagctatacaatacactgggtaagacaagcaccaggaaaaggactagaatgggtagcatttatatcatacgatggaacagaaaaaaaatatacagatagcgtaaaaggaagatttacaataagcagagacaatagcaaaaacacactatcactacaaatgaatagcttaagaccagaagatacagcagtctattactgtgcaaaagacttaggagcaagcaaagacgatgaatgggcaacagattattacgatttctcaatagcatacccagtacaagacccaagagcagtagtaggagcattcgatatatggggacaaggaacaatggtaacagtaagctca

SEQ ID NO: 47967 - RNA, 432 nt, synthetic construct
  misc_feature 1..432: note = derived and/or modified sequence opt6 from anti-HIV_cap256-048-131966_VR-Chain
  source 1..432: mol_type = other RNA
caagaacaattagtagaaagtggaggaggagtagtacaaccaggaagaagtttaagattaagttgtgcagcaagtggattcacatttagtaattatgcaatgcattgggtaagacaagcaccaggaaaaggattagaatgggtagcagcaatgagtcatgatggaagtgataaatattatgcagatagtgtaaaaggaagatttacaataagtagagataatagtaaaaatacattatatatgcaaatgaatagtttaagagcagaagatacagcagtatattattgtgcaaaagatcaaggagaaagtgaaaaagaagaatgggcaagtgattattatgattttggaagagattatccaggacaagatccaagaagagtagttgcaacatttgcaatatggggacaaggaacaatggtaacagtaagtagt

SEQ ID NO: 47968 - RNA, 432 nt, synthetic construct
  misc_feature 1..432: note = derived and/or modified sequence opt6 from anti-HIV_cap256-048-131008_VR-Chain
  source 1..432: mol_type = other RNA
gaagtaagattagtagaaagcggaggaggattggtaaaaccaggaggaagcctaagattaagctgtgcagcaagcggattcacagtatcaagcaattacatgagctgggtaagacaagcaccaggaaaaggactagaatgggtagcagcaatatcattcgcaggaacaaacaaatactatgcagatagcgtaaaaggaagatttacaataagcagagacaatagcaaaaacgcactatatctacaaatgaatagcttaagagcagaagatacagcactatattactgtgcaaaagacttaagagaaagcgaatgcgaagaatgggcatcagactattacgatttcggaagagattacccgtgccaagacccaagaggagtagtaggaacactagatatatggggacaaggaacaatggtaacagtaagctcg

SEQ ID NO: 47969 - RNA, 432 nt, synthetic construct
  misc_feature 1..432: note = derived and/or modified sequence opt6 from anti-HIV_cap256-048-129369_VR-Chain
  source 1..432: mol_type = other RNA
caagtacaattagtagaaagtggaggaggagtagtacaaccaggaagaagtttaagattaagttgtgcagcaagtggatttacatttagcaattatgtaatgcattgggtaagacaagcaccaggaaaaggattagaatgggtagcattagtaagttttgatggaagcaataaatattatgcagatagtgtaaaaggaagatttacaataagtagagataatagtaaaaatacagtatatttacaaatgaatagtttaagaggagtagatacagcagtatattattgtgcaaaagatttaggaggaggagaagtagaagaatgggcaacagattattatgattggagtatagcatatccagtagaacatccaagagcagtagtaggagtatttgatatatggggacaaggaacaaaagtaacagtaagtagt

SEQ ID NO: 47970 - RNA, 432 nt, synthetic construct
  misc_feature 1..432: note = derived and/or modified sequence opt6 from anti-HIV_cap256-048-128476_VR-Chain
  source 1..432: mol_type = other RNA
gaagtacaagtattagaaagtggaggaggattagtacaaccaggaggaagtctaagactagcatgtgcagcgagcggatttagttttagtagttatggaatgcattgggtaagacaagcaccaggaaaaggattagaatgggtaagttttataagatatgatggagcaaataaatatcatgcagatagtgtaaaaggaagatttataataagtagagatgatagtaaaaatacagtaagtttacaaatgaatagtctaagaccagaagatacagcagtatattattgtgcaaaagatttaggagcaaataaagatgatgaatgggcaacagattattatgatttaagtatagcatatccagtaccagatccaagagcagtagtaggagcatttgatatatggggacaaggaacaatggtaacagtaagtagt

SEQ ID NO: 47971 - RNA, 432 nt, synthetic construct
  misc_feature 1..432: note = derived and/or modified sequence opt6 from anti-HIV_cap256-048-128270_VR-Chain
  source 1..432: mol_type = other RNA
caagtacaattagtagaaagtggaggaggagtagtacaaccaggaagaagtttaagattaagttgtacagcaagtggatttacatttagaagttatgcaatgcattgggtaagacaagcaccaggtaaaggactagaatgggtagcattaataagttatgatggaagtaataaatattatgcagatagtgtaaaaggaagatttacaataagtagagataatagtaaaaatacattatatttacaaatgaatagtctaacaagtgaagatacagcagtatattattgtgcaaaagatttaggaggaagtaaaacagatgaatggggaacagattattatgaattttggaatgcatatccagtacaagatccaagagtagtagtaggagcatttgatatatggggacatggaacaatggtaacagtaagtagt

SEQ ID NO: 47972 - RNA, 432 nt, synthetic construct
  misc_feature 1..432: note = derived and/or modified sequence opt6 from anti-HIV_cap256-048-126220_VR-Chain
  source 1..432: mol_type = other RNA
caagtacaattagtagaaagtggaggaggagtagtacaaccaggaagaagtttaagattaagttgtgcagcaagtggatttatatttagtccatatggaatacattgggtaagacaagcaccaggaaaaggattagaatgggtagcattaataagtcatgatggatcaaaaaaatattatgcagatagtgtaaaaggaagatttacaataagtagagataattttaaagatacattatatttacaaatgaatagtttaagaggagtagatacagcagtatattattgtgcaaaagatctaggaggaggagaagtagaagaatgggcaacagattattatgattggagtacagcatatccagtagaacatccaagagcagtagtaggagtatttgatatatggggacaaggaacaaaagtaacagtaagtagt

SEQ ID NO: 47973 - RNA, 432 nt, synthetic construct
  misc_feature 1..432: note = derived and/or modified sequence opt6 from anti-HIV_cap256-048-125713_VR-Chain
  source 1..432: mol_type = other RNA
gaagtacaattagtagaaagcggaggaggattagtacaaccaggaggaagtctaagactaagctgtgaagcgagcggattctcattctcaacatatgaactaaactgggtaagacaagcaccaggaaaaggactagaatgggtagcagtaatatcatatgatggatcaaattattactatgcagatagcgtaaaaggaagatttacaataagcagagacaatagcaaaaacacactatatttacaaatgaatagcttaagagcagaagatacagcagtatattactgtgcaaaagacgtaggagcaaataaagacgatgaatgggcaacagactattacgatttatcaatagcatacccagtaccagacccaagagcagtagtaggagcatttgatatatggggacaaggaacaatggtaacagtaagttca

SEQ ID NO: 47974 - RNA, 432 nt, synthetic construct
  misc_feature 1..432: note = derived and/or modified sequence opt6 from anti-HIV_cap256-048-123934_VR-Chain
  source 1..432: mol_type = other RNA
caagtacaattagtagaaagtggaggaggagtagtgcaaccaggaagaagtttaagattaagttgtgcagcaagtggatttacatttagtagttatggaatggcatgggtaagacaagcaccaggaaaaggattagaatgggtaacagcaatatcatttgcaggaacaaataaatattatgcagatagcgtaaaaggaaggtttacaataagtagagataatagtaaagatacattatatttacaaatggatggattaagaccagaagatacagcattatattattgtgcaaaagatttaggagaaagagaatgtgaagaatgggcaagtgattattatgattttggaagagattttccaggacaagatcaaagagcagtagcaggagtatttgatatgtggggacaaggaacaatggtaacagtaagcagt

SEQ ID NO: 47975 - RNA, 432 nt, synthetic construct
  misc_feature 1..432: note = derived and/or modified sequence opt6 from anti-HIV_cap256-048-122673_VR-Chain
  source 1..432: mol_type = other RNA
gaagtacaagtagtagaaagtggaggaggattagtaaaaccaggaggaagtttaagattaagctgtgcagcaagtggatttacatttagcagtcatgtaatgaattgggtaagacaagcaccaggaaaaggactagaatgggtaagttcaatatcaggaggaagcagtagtaaagattatgcagatagtgtaaaaggaagatttacaataagtagagataatagtaaaaatacattatcattacaaatgaatagtttaagaccagaagatacagcagtatattattgtgcaaaagatgtaggagcaaataaagatgatgaatgggcaacagattattatgatttatcaatagcatatccagtaccagatccaagagcagtagtaggagcatttgatatatggggacaaggaacaatggtaacagtaagtagt

SEQ ID NO: 47976 - RNA, 432 nt, synthetic construct
  misc_feature 1..432: note = derived and/or modified sequence opt6 from anti-HIV_cap256-048-122208_VR-Chain
  source 1..432: mol_type = other RNA
agagtacaagtagtagaaagcggaggaggagtagtaaaaccaggaggaagtttaagattaagctgtggagcaagcgggtttacattttcaaatgcatggttaagttgggtaagacaagcaccaggaaaaggactagaatgggtagcagtaatatcaagcgatggatcaagtaaaaattatgcagatagtgtaaaagggagatttacaataagcagggacaatagtaaaaatacagtatcattacaaatgaatagtttaagaccagaagatacagcagtatattattgtgcaaaagatgtaggagcaaataaagatgatgaatgggcaacagactattatgatttatcaatagcatatccagttccagacccaagagcagtagtaggagcatttgatatatggggacaaggaacaatggtaacagtaagctca

SEQ ID NO: 47977 - RNA, 432 nt, synthetic construct
  misc_feature 1..432: note = derived and/or modified sequence opt6 from anti-HIV_cap256-048-121552_VR-Chain
  source 1..432: mol_type = other RNA
caagtacaattagtagaaagtggaggaggagtagtacaaccaggaggaagtttaagattaagttgtgcagcaagcggatttacatttagtagttatgcaatgcattgggtaagacaagcaccaggaaaaggattaaaatgggtagcagatataagttatgatgcaagtagtaaatattatgcagatagtgtaaaaggaagatttacaataagtagagataatagcaaaaacacattatatttagaaatgaatagtttaagaccagaagatacagcagtatattattgtgcaaaagatttaggagaaagagaatgtgaagaatgggcaagtgattattatgattttggaagagattttccatgtcaagatccaagaggagtagtaggaacatttgatatatggggacaaggaacaatggtaacagtaagcagt

SEQ ID NO: 47978 - RNA, 432 nt, synthetic construct
  misc_feature 1..432: note = derived and/or modified sequence opt6 from anti-HIV_cap256-048-120643_VR-Chain
  source 1..432: mol_type = other RNA
caagtacaattagtagaaagcggaggaggagtagtacaaccaggaagaagcctaaggttaagctgtgcagcaagcggattcacactatcagcatatacaatgcactgggtaagacaagcaccaggaaaaggactagaatgggtaagcgtaatatcattcgcaggaaataataaatactatgcagacagcgtaaaaggaagatttacaataagcagagaaaatagtaaaaatatgttatatctacaaatgaatagtttaagaggagaagatacagcagtatattactgtgcaaaagacttaagagaatttgaatgtgaagaatgggcatcagactattacgatttcggaagagattacccatgtcaagacccaagaggagtagtaggaacattcgatgtatggggacatggatcattagtaacagtaagttca

SEQ ID NO: 47979 - RNA, 432 nt, synthetic construct
  misc_feature 1..432: note = derived and/or modified sequence opt6 from anti-HIV_cap256-048-118458_VR-Chain
  source 1..432: mol_type = other RNA
caagtacaattagtagaaagtggaggaggagtagtacaaccaggaagaagtttaagattaagttgtgcagcaagtggatttacatttagtacaagtggaatgcattgggtaagacaagcaccaggaaaaggattagaatgggtagcatttataagtagtgatagaagtaataaattttatgcagacagtgtaaaaggaagatttagtataagtagagataatagtaaatatacactatatttacaaatgaatagtttaagagcagatgatacagcagtatatttttgtgcaaaagatttaggagtaaataaaaatgatgaatgggcaacagattattatgatttaagtgtagcatatccagtacaagatccaagaggagtagcaggaatatttgatatatggggacaaggaacaatggtaacagtaagtagt

SEQ ID NO: 47980 - RNA, 432 nt, synthetic construct
  misc_feature 1..432: note = derived and/or modified sequence opt6 from anti-HIV_cap256-048-118112_VR-Chain
  source 1..432: mol_type = other RNA
caagaacaattagtagaaagcggaggaggagtagtacaaccaggaagaagcctaagattaagctgtgcagcaagccaatttacattttcaaactatggaatgcactgggtaagacaagcaccaggaaaaggattagtatgggtagcaggaatatcattcgcaggaacaaataaatactatgcagcaagcgtaaaaggaagatttacaataagcagagacaatagtaaaaacacactatatctacaaatgaatagcttaagagcagaagatacagcactatattactgtgcaaaagacatgagagaatatgaatgtgaagaatgggcatcagactattacgatttcggaagagattacccatgtcaagacccaagaggagtagtaggaacattcgatatatggggacaaggaacaatggtgacagtaagctcg

SEQ ID NO: 47981 - RNA, 432 nt, synthetic construct
  misc_feature 1..432: note = derived and/or modified sequence opt6 from anti-HIV_cap256-048-116469_VR-Chain
  source 1..432: mol_type = other RNA
caagtacaattagtagaaagtggaggaggagtagtacaaccaggaagaagtttaagattaagttgtgcagcgagtggatttacatttagtagttatgcaatgcattgggtaagacaagcaccaggaaaaggattagaatgggtagcaataataagttatgatggaagtaataaatattatgcagatagtgtaaaaggaagatttacaataagtagagataatccgaaaaatacattatatttacaaatgaatagtttaagagcagaagatacaggattatattattgtgcaaaagatatgggagaaagtgaaaaagaagaatgggcaagtgattattatgattttggaagagattatccaggacaagaaccaagagcaatggtaggaacatttgatatatggggacaaggaacaatggtaacagtaagtagt

SEQ ID NO: 47982 - RNA, 432 nt, synthetic construct
  misc_feature 1..432: note = derived and/or modified sequence opt6 from anti-HIV_cap256-048-113917_VR-Chain
  source 1..432: mol_type = other RNA
gaagtacaattagtagaaagcggaggaggattagtacaaccaggaggaagtctaagactaagttgtgcagcaagtggattaacagtaagcgatacatatatgaattggttaagacaagcaccaggaaaaggattagaatgggtagcagtagtaagtagtgatggaagtaataaaaattatgcagatagtgtaaaaggaagatttacaataagtagagataatagtaaaaatacagtatatttacaaatgaatagtttaagagcagaagatacagcagtatattattgtgcaaaagatttaggagcaaataaagatgatgaatgggcaacagattattatgatttaagtgtagcatatccagtaccagatccaagagcagtagtaggagcatttgatgtatggggacaaggaacaatggtaacagtaagtagt

SEQ ID NO: 47983 - RNA, 432 nt, synthetic construct
  misc_feature 1..432: note = derived and/or modified sequence opt6 from anti-HIV_cap256-048-112368_VR-Chain
  source 1..432: mol_type = other RNA
caagtacaattagtagaaagtggaggaggagtagtacaaccaggaagaagtttaagactaagttgtgcagcaagtggatttacatttagtagaaatgcaatgcattgggtaagacaagcaccaggaaaaggattagaatgggtagcagtaataagttatgatggaagtaataaatattatgcagatagtgtaaaaggaagatttacaataagtagagataatagtaaaaatacattatatttacaaatgaatagcctaagagcagaagatacagcagtatattattgtgcaaaagatttaggaggaggagaagtagaagaatgggcaacagattattatgattggtcaacagcatatccagtagaacatccaagggcagtagtaggagtatttgatatatggggacaaggaacaaaagtaacagtaagtagt

SEQ ID NO: 47984 - RNA, 432 nt, synthetic construct
  misc_feature 1..432: note = derived and/or modified sequence opt6 from anti-HIV_cap256-048-112047_VR-Chain
  source 1..432: mol_type = other RNA
gaagtacaattagtagaaagtggaggaggattagtacaaccaggaggaagtttaagactaagctgtgcagcaagtggactaacagtatcaggatattatatgagttgggtaagacaagcaccaggaaaaggactagaatggttagcatttatacattttgatggatcaaaaatacattatgcaggaagtgtaaaaggaagaataacagtaagcagagacaatagtaaaaatacattagatttacaaatgaatagcttaagagcagaagatacagcagtatattactgtgcaaaagatgtaggagatagtaaaagtgatgaatgggcaacagactattatgatctatcagtagcatatccagtaccggacccaagagcagtagtaggagcatttgatatatggggacaaggaacaatggtaacagtaagttca

SEQ ID NO: 47985 - RNA, 432 nt, synthetic construct
  misc_feature 1..432: note = derived and/or modified sequence opt6 from anti-HIV_cap256-048-112029_VR-Chain
  source 1..432: mol_type = other RNA
caagtgcaattagtagaaagcggaggaggagtagtacaaccaggaagaagtctaagattaagctgtgcagcaagtcaatttacattttcaagttatggaatgcactgggtaagacaagcaccaggaaaaggactagaatgggtagcaggaatatcatttgcaggcataaaaaaatactatgcagatagtgtaaaaggaagatttacaataagcagagacaatagcaaaaacacattatatctacaaatgaatagcttaagaggagaagatacagcactatattactgtgcaaaagacttaagagaatatgaatgtgaagaatgggcatcagactattacgatttcggaagagattacccatgtcaagacccaagaggagtagtaggaatattcgatatatggggacaaggaacaatggtaacagtaagtagt

SEQ ID NO: 47986 - RNA, 432 nt, synthetic construct
  misc_feature 1..432: note = derived and/or modified sequence opt6 from anti-HIV_cap256-048-110957_VR-Chain
  source 1..432: mol_type = other RNA
caagtaagattagtagaaagtggaggaggagtagtaagaagtggaagaagtttaagattaagttgtgcagcaagtggatttacatttagtaattttgcattacattgggtaagacaagcaccaggaaaaggattagaatgggtagcagtaataagttatgatggaaatagtaaattttatgcagatagtgtaaaaggaagatttacaataagtacagataatagtaaaaatacattatatttacaaatgaatagtctaacagcagaagatacagcagtatattattgtgcaaaagatttaggaggaaataaagatgatgaatggggaacagattattatgattttagtgtagcatatccagtacaagatccaagagcagtaagtggaatatttgatgtatggggacatggaacaatggtaacagtaagtagc

SEQ ID NO: 47987 - RNA, 432 nt, synthetic construct
  misc_feature 1..432: note = derived and/or modified sequence opt6 from anti-HIV_cap256-048-110526_VR-Chain
  source 1..432: mol_type = other RNA
caagtacaattagtagaaagcggaggaggagtagtacaaccaggaagaagcctaagattgagttgtgcagcaagcggattcacattctcaaacttcggctttcactgggtaagacaagcaccaggaaaaggactagaatgggtagcagcaatatcattcgcaggaaataataaatactatgcagatagtgtaaaaggaagatttacaataagcagagaaaatagcaaaaacatactatatttacaaatgaatagtttaagaggagaagatacagcagtatattactgtgcaaaagacctaagagaatttgaatgcgaagaatgggcatcagactattacgattggtcaacagcatatccagtagaacacccaagagcagtagtaggagtattcgatatatggggacaaggaacaaaagtaacagtaagttca

SEQ ID NO: 47988 - RNA, 432 nt, synthetic construct
  misc_feature 1..432: note = derived and/or modified sequence opt6 from anti-HIV_cap256-048-109336_VR-Chain
  source 1..432: mol_type = other RNA
gaagtacaattagtagaaagtggaggaggattagtacaaccaggaggaagtcaaagattaagttgtgcagcaagtggattaacagtaaatagtaattatatgacatgggtaagacaagcaccaggaaaaggattagaatgggtagcaataataagtagtgatggaagtggacaatattatgcagatagtgtaaaaggaagatttacaataagtagagataatagtaaaaatacattaagtttacaaatgaatagtttaagaccagaagatacagcagtatattattgtgcaaaagatttaggagcaagtaaagatgatgaatgggcaacagattattatgattttagtatagcatatccagtacaagatccaagagcagtagtaggagcatttgatatatggggacaaggaacaatggtaacagtaagtagt

SEQ ID NO: 47989 - RNA, 432 nt, synthetic construct
  misc_feature 1..432: note = derived and/or modified sequence opt6 from anti-HIV_cap256-048-108152_VR-Chain
  source 1..432: mol_type = other RNA
caagcacaattagtagaaagtggaggaggagtagtacaaccgggaagaagtttagtattaagttcagtagcaagtggattttcatttagtacatatgcaatgcattgggtaagacaagcaccaggaaaaggattagaatgggtagcagtaataagttatgatggaggaaataaatattatgcagatagtgtaaaaggaagatttagtataagtagagataatagtaaaaatacagtatatctacaaataaatagtttaagagcagaagatacagcagtatattattgtgcaaaagatctaggagcaaataaagatgatgaatgggcaacagattattatgatttatcagtagcatatccagtaccagatccaagagcagtagtaggagcatttgatgtatggggacaaggaacaatggtaacagtaagtagt

SEQ ID NO: 47990 - RNA, 432 nt, synthetic construct
  misc_feature 1..432: note = derived and/or modified sequence opt6 from anti-HIV_cap256-048-107799_VR-Chain
  source 1..432: mol_type = other RNA
gaagtacaagtagtagaaagtggaggaggagtagtacaaccaggaaggagtttaagattaagttgtgcagcaagtggatttacatttagtaattatgcaatggattgggtaagacaagcaccaggaaaaggattagaatgggtagcatttgtaagtagtgatggaagtaataaaaattatgcagatagtgtaaaaggaagatttacaataagtagagataatagtaaaaatacattaagtttacaaatgaatagtttaagagcagaagatacagcagtatattattgtgcaaaagaagtaggagaaaataaagatgatgaatgggcaagtgattattatgatttaagtatagcatatccaatacatgatccaagagcagtagtaggaggatttgatatatggggacaaggaacaatggtaacagtaagtagt

SEQ ID NO: 47991 - RNA, 432 nt, synthetic construct
  misc_feature 1..432: note = derived and/or modified sequence opt6 from anti-HIV_cap256-048-107384_VR-Chain
  source 1..432: mol_type = other RNA
gaagtaagattagtagaaagcggaggagcattagtaaaaccaggaacaagcttaagattaagttgtgcagcaagcggattcacattcacacactatgcaatggactgggtaagacaagcaccaggaaaaggactagaatgggtagccataatatcaagtgatggatcaacaaaaaactatgcagatagcgtaaaaggaagatttacaataagcagagacaatagtaaaaacacattatcactacaaatgaatagcttaagaccagaagatacagcagtatattactgtgcaaaagacgtaggagcaaataaagacgatgaatgggcaacagactattacgatctatcaatagcatacccagtaccagacccaagagcagtagtaggagcattcgatatatggggacaaggcacaatggtaacagtaagctca

SEQ ID NO: 47992 - RNA, 432 nt, synthetic construct
  misc_feature 1..432: note = derived and/or modified sequence opt6 from anti-HIV_cap256-048-106530_VR-Chain
  source 1..432: mol_type = other RNA
gaagtacaattactagaaagcggaggaggattagtacaaccaggaggatcactaagattaagttgtgcagcaagcggattcacattctcaagttatgcaatggactgggtaagacaagcgccaggaaaaggactagaatgggtagcagtaatatcaagtgatggatcaaacaaaaactatgcagatagcgtaaaaggaagatttacaataagcagagacaatagtaaaaacacactatatctacaaatgagcagcttaagaccagaagatacagcagtatattactgtgcaaaagacgtaggagatagcaaaagcgatgaatgggcaacagactattacgatttctcaatagcatacccaatacaagacccaagagcagtagtaggagcattcgatatatggggacaaggaacaatggtaacagtaagctca

SEQ ID NO: 47993 - RNA, 432 nt, synthetic construct
  misc_feature 1..432: note = derived and/or modified sequence opt6 from anti-HIV_cap256-048-106464_VR-Chain
  source 1..432: mol_type = other RNA
gaagtacaaatggtacaaagtggaggaggattagtacaaccaggaggaagtttaagattaagttgtgcagcatttggatttacatttacaaatcatgcaatggattgggtaagacaagtaccaggaaaaggattagaatgggtagcatttatatcaagtgatggaagtaataaaaattatgcagatagtgtaaaaggaagatttacaataagtagagataatagtaaaaatacagtatatttacaaatgagtagtctaagaccagaagatacagcagtatattattgtgcaaaagatgtaggagatagtaaaagtgatgaatgggcaacagattattatgatttaagtgtagcatatccagtaccagatccaagagcagtagtaggagcatttgatatatggggacaaggaacaatggtaacagtaagttca

SEQ ID NO: 47994 - RNA, 432 nt, synthetic construct
  misc_feature 1..432: note = derived and/or modified sequence opt6 from anti-HIV_cap256-048-106411_VR-Chain
  source 1..432: mol_type = other RNA
caagtacaattagtagaaagtggaggaggagtagtacaaccaggaagaagtttaagattaagctgtgcagcaagtggatttacatttagttatagtggaatgcattgggtaagacaagcaccaggaaaaggaatggaatgggtagcagtaataagttatgatggaagtaataaatattatgcagatagtgtgaaaggaagatttacaataagtagagataatagtaaaaatacattatatctacaaatgaatagtttaagagtagaagatacagcagtatatcattgtgcaaaagatttaggaggaacaaaaagtgatgaatgggcaacagattattatgatttaagtatagcatatccaatacaagatccaggagcagtagtaggagtatttgatatatggggacaaggaacaatggtaacagtaagtagt

SEQ ID NO: 47995 - RNA, 432 nt, synthetic construct
  misc_feature 1..432: note = derived and/or modified sequence opt6 from anti-HIV_cap256-048-106306_VR-Chain
  source 1..432: mol_type = other RNA
gaagtacaattagtagaaagtggaggaggattagtacaaccaggaggaagtttaagattaagttgtgaagcaagtggatttacatttaataattatggaatggtatgggtaagacaagcaccaggaaaaggattagaatgggtagcaataataagttatgatggaacagaaaaatattatgtagatagcgtaaaaggaaggtttacaataagcagagataatagtaaaaatacattaagtttacaaatgaatagtttaagagcagaagatacagcagtatattattgtgcaaaagaagtaggagaaaataaagatgatgaatgggcaagtgattattatgatttaagtatagcatatccaatacatgacccaagagcagtagtaggaggatttgatatatggggacaaggaacaatggtaacagtaagtagc

SEQ ID NO: 47996 - RNA, 432 nt, synthetic construct
  misc_feature 1..432: note = derived and/or modified sequence opt6 from anti-HIV_cap256-048-104496_VR-Chain
  source 1..432: mol_type = other RNA
caagtacaattagtagaaagtggaggaggattagtaaaaccaggaggaagtttaagattaagctgtgcagcaagtggatttacatttagtagttatggaatgcattgggtaagacaagcaccaggaaaaggattagaatgggtagcatttgtaagtagtgatggaaataataaaaattatgcagatagtgtaaaaggaagatttacaataagtagagataatagtaaaaatacagtatatttacaaatgaatagtttaagagtagaagatacagcagtatattattgtgcaaaagatttaggagcaaataaagatgatgaatgggcaacagattattatgatttaagtgtagcatatccagtaccagatccaagagcagtagtaggagcatttgatgtatggggacaaggaacaatggtaacagtaagtagt

SEQ ID NO: 47997 - RNA, 432 nt, synthetic construct
  misc_feature 1..432: note = derived and/or modified sequence opt6 from anti-HIV_cap256-048-103074_VR-Chain
  source 1..432: mol_type = other RNA
caagtacatttagtagaaagtggagcaggagtagtgcaaccaggaggaagtttaagattaagttgtgcagtaagtggatttacatttaatagttatggaatgcattgggtaagacaagcaccaggaaaaggattagaatgggtagcagtaataagttatgatggaagtgataaatattatgcagatagcgtaaaaggaagatttacaataagtagagattcaagtaaaaatacattatatttacaaatgaatagtttaagagtagaagatacagcagtatattattgtgcaaaagatctaggagcaaataaagatgatgaatgggcaacagattattatgatttaagtgtagcgtatccagtaccagatccaagagcagtagtaggagcatttgatgtatggggacaaggaacaatggtaacagtaagtagt

SEQ ID NO: 47998 - RNA, 432 nt, synthetic construct
  misc_feature 1..432: note = derived and/or modified sequence opt6 from anti-HIV_cap256-048-100832_VR-Chain
  source 1..432: mol_type = other RNA
caagtacaattagtagaaagtggaggaggagtagtacaaccaggaagaagtttaagattaagttgtgcagcaagtggatttacatttagtagctatggaatgcattgggtaagacaagcaccaggaaaaggattagaatgggtagcagtagtaagtagtgatggaacaaataaaaattatggggatagtgtaaaaggaagatttacaataagtagagataatagtagaaatacagtatatttacaaatgagtagtttaagaccagaagatacagcagtatattattgtgcaaaagatgtaggagatacgaaaagtgatgaatgggcaacagattattatgattttagtatagcatatccagtacaagatccaagagcagtagtgggagcatttgatatatggggacaaggaacaatggtaacagtaagtagt

SEQ ID NO: 47999 - RNA, 432 nt, synthetic construct
  misc_feature 1..432: note = derived and/or modified sequence opt6 from anti-HIV_cap256-048-100188_VR-Chain
  source 1..432: mol_type = other RNA
caagtacatttagtagaaagtggaggaggagtagtacaaccaggaagaagtttaagaatatactgtgcagtaagtgaatttacattcagaaattatgcaatgcactgggtaagactagcaccaggaaaaggactacaatgggtagcagtaatatcatataatggagggaaaaaatactatgcagatagcgtaaaaggaagatttacaataagcagagacaatagtaaaaacgcactatatctacaaatgaatagcttaagagcagaagatacagggctatattactgtgcaaaagacttaagagaatttgaatgtgaagaatgggcatcagactattacgatttcggaagagaatatccatgtcaagacccaagaggagtagtaggaacattcgatatatggggacaaggaacaatggtaacagtaagttca

SEQ ID NO: 48000 - RNA, 432 nt, synthetic construct
  misc_feature 1..432: note = derived and/or modified sequence opt6 from anti-HIV_cap256-048-099645_VR-Chain
  source 1..432: mol_type = other RNA
caagtacaattagtagaaagtggaggaggagtagtacaaccaggaagatcattaagactaagttgtgcagcaagtggatttacatttagtagatatgcattacattgggtaagacaagcaccaggaaaaggattagaatgggtagcagtaataagttatgatggaagtagcaaatattatgcagatagtgtaaaaggaagattttcaataagtagagataatagtaaatatacattatatttacaaatgaatagtttaagagcagatgatacagcagtatatttttgtgcaaaagatttaggagtaaataaaaatgatgaatgggcaacagattattatgatttaagtgtagcatatccagtacaagatccaagaggagtagcaggaatatttgatatatggggacaaggaacaatggtaacagtaagtagt

SEQ ID NO: 48001 - RNA, 432 nt, synthetic construct
  misc_feature 1..432: note = derived and/or modified sequence opt6 from anti-HIV_cap256-048-098137_VR-Chain
  source 1..432: mol_type = other RNA
caagtacaattagtagaaagtggaggaggagtagtacaaccaggaagaagtttaagactaagctgtgcagcaagcggatttacattaagaaattatgcaatgcactgggtaagacaagcaccaggaaaaggactagaatgggtagcagtaataagtagtgatggaaataataaatactatgcagacagcgtaaaaggaagatttacagtaagtagagacaatagtaaagacacactatatctacaaatgaatagtttaagaccagaagatacagcattatattactgtgcaaaagacttaggagaaagagaatgtgaagaatgggcaagtaactattacgatttcggaagagattatccatgtcaagacccaagaggagtagtaggaacattcgatatatggggacaaggaacaatggtaacagtaagttca

SEQ ID NO: 48002 - RNA, 432 nt, synthetic construct
  misc_feature 1..432: note = derived and/or modified sequence opt6 from anti-HIV_cap256-048-097878_VR-Chain
  source 1..432: mol_type = other RNA
caagtacaattattagaaagtggaggaggagtagtacaaccaggaaaaagtttaagattaagctgtgcagcaagtggattcacattcaatacatatggaatgcactgggtaagacaagcaccaggaaaaggactacaatgggtagcagtaatatcatacgatggaacaatacaaaaatatgcagatagcgtaaaaggaagattcacaataagcagagaaaatagcaaaaacatgttatatctacaaatgaatagcttaagaggagaagatacagcagtatattactgtgcaaaagacttaagagaatttgaatgcgaagaatgggcaagtgactattacgatttcggaagagattatccatgccaagacccaagaggagtagtaggaacattcgatgtatggggacatggaagtctagtaacagtaagttca

SEQ ID NO: 48003 - RNA, 432 nt, synthetic construct
  misc_feature 1..432: note = derived and/or modified sequence opt6 from anti-HIV_cap256-048-097510_VR-Chain
  source 1..432: mol_type = other RNA
caagtacaattagtagaaagtggaggaggagtagtacaaccaggaagaagtttatggttaagttgtgcagcaagtgaatttacattaagaagttatggaatgcactgggtaagacaagcaccaggaaaaggattagaatgggtagcatttgtagcatttgatgaaagtgataaatattatgcagatagtgtaaaaggaagatttacaataagtagagacaatagtaaaaatacattaagtctacaaatgaatagtttaagagcagaagatacagcagtatattattgtgcaaaagaagtaggagataataaagatgatgaatgggcaagcgattattatgatttaagtatagcatatccagtacatgatccaagagcagtagtaggaggatttgatatatggggacaaggaacaatggtaacagtaagtagt

SEQ ID NO: 48004 - RNA, 432 nt, synthetic construct
  misc_feature 1..432: note = derived and/or modified sequence opt6 from anti-HIV_cap256-048-097313_VR-Chain
  source 1..432: mol_type = other RNA
caagtacaattagtagaaagtggaggaggattagtacaaccaggaggagcattaagattaagttgtttagtgagtggatttacatttgatgattatgcattacattgggtaagacaagcaccaggaaaaggaccagaatgggtagcagtattaagtagtgatggaagttataaatattatacagaaagtgtacaaggaagatttacaataagtagagataatagtaaaaatacagtatatttacaaatgaatagtttaagaggagtagatacagcagtatattattgtgcaaaagatttaggaggaggagaagtagaagaatgggcaacagattattatgattggagtatagcatatccagtagaacatccaagagcagtagtaggagtatttgatatatggggacaaggaacaaaagtaacagtaagtagt

SEQ ID NO: 48005 - RNA, 432 nt, synthetic construct
  misc_feature 1..432: note = derived and/or modified sequence opt6 from anti-HIV_cap256-048-096626_VR-Chain
  source 1..432: mol_type = other RNA
gaagtacaattagtagaaagtggaggaggattagtacaaccaggagaaagtttaagattaagttgtgcaggaagtggatttacatttagtagctattggatgagttgggtaagacaagcaccaggaaaaggattagaatggatggcattaataagttatgatggaagtaataaatattatgtagatagtgtaaaaggaagatttacaataagcagagataatagtaaaaatacactatatttacaaatgaatagtttaagagcagaagatacagcagtatattattgtgcaaaagatttaggaggaaataaagatgatgaatgggcaacagattattatgatctaagtatagcatatccagtacaagatccaagagtagtagtaggaatatttgatatatggggacaaggaacaatggtaacagtaagttca

SEQ ID NO: 48006 - RNA, 432 nt, synthetic construct
  misc_feature 1..432: note = derived and/or modified sequence opt6 from anti-HIV_cap256-048-096483_VR-Chain
  source 1..432: mol_type = other RNA
gaagtacaattagtagaaagtggaggaggattagtacaaccaggaagaagtttaagattaagctgtgcagcaagtggattttcatttgaagattatgcaatgcactgggtaagacaagcaccaggaaaaggattagaatgggtagcaggaataagttttgcaggaacaaaaaaatattatgcagatagtgtaaaaggaagatttacaataagcagagacaatagtaaaaatgcattatatttacaaatgaatagtctaagagcagaagatacagcattatattattgtgcaaaagatttaagagaatatgaatgtgaagaatgggcatcagactattatgattttggaagagattatccatgtcaagacccaagaggagtagtaggaacatttgatatatggggacaaggaacaatggtaacagtaagttca

SEQ ID NO: 48007 - RNA, 432 nt, synthetic construct
  misc_feature 1..432: note = derived and/or modified sequence opt6 from anti-HIV_cap256-048-095691_VR-Chain
  source 1..432: mol_type = other RNA
caagtacaattagtagaaagtggaggaggggtagtacaaccaggaagaagtttaagattaagttgtgcagcaagtggatttacatttagtagttatggaatggcatgggtaagacaagcaccaggaaaaggattagaatgggtaacagcaataagttttgcaggaacaaataaatattatgcagatagtgtaaaaggaagatttacaataagtagagataatagcaaagacacactatatttacaaatggatggattgagaccagaagatacagcattatattattgtgcaaaagatttaggagaaagagaatgtgaagaatgggcaagtaattattatgattttggaagagattatccatgtcaagatccaagaggagtagtaggaacatttgatatatggggacaaggaacaatggtaacagtaagtagt

SEQ ID NO: 48008 - RNA, 432 nt, synthetic construct
  misc_feature 1..432: note = derived and/or modified sequence opt6 from anti-HIV_cap256-048-095525_VR-Chain
  source 1..432: mol_type = other RNA
caagtacaattagtacaaagtggaggaagtgtagtacaaccaggaaaaagtctaagattaagttgtgcagcaagtggatttacatttagtagttttggaatgcattgggtaagacaaacaccgggaaaaggattagaatgggtagcagtaataagttatgatggaagtgaaaaaagctatgcagatagtgttaaaggaagatttacaataagtagagataatagtaaaaatacattatatttacaaatgaatagcttaagagcagaagatacagcagtatattattgtgcaaaagatttaggaggaacaaaagatgatgaatgggcaacagattattatgatatatcaatagcatatccagtacaagatccaagagcagtagcaggagcatttgatatatggggacaaggaacaatggtgacagtaagttca

SEQ ID NO: 48009 - RNA, 432 nt, synthetic construct
  misc_feature 1..432: note = derived and/or modified sequence opt6 from anti-HIV_cap256-048-094783_VR-Chain
  source 1..432: mol_type = other RNA
gaagtacaattagtagaaagtggaggaggattagtaaaaccaggaggaagtttaagattaagttgtgcagcaagtggaataacatttagtacatatgaaatgaattgggtaagacaagcaccaggaaaaggaatggaatgggtagcagtaataagttatgatggaagtaataaatattatgcagatagtgtaaaaggaagatttacaataagtagagataatagtaaaaatacagtatatttacaaatgaatagtttaagaggagtagatacagcagtatattattgtgcaaaagatttaggaggaggagaagtagaagaatgggcaacagattattatgattggagtatagcatatccagtagaacatccaagagcagtagtaggagtatttgatatatggggacaaggaacaaaagtaacagtaagtagt

SEQ ID NO: 48010 - RNA, 432 nt, synthetic construct
  misc_feature 1..432: note = derived and/or modified sequence opt6 from anti-HIV_cap256-048-094356_VR-Chain
  source 1..432: mol_type = other RNA
caagtacaattagtagaaagtggaggaggagtagtacaaccaggaagaagtttaagattaagttgtgcagcaagtggatttatatttacacattatgcgatggattgggtaagacaagcaccaggaaaaggattagaatgggtagcagtaataagtagtgatggaagtagtaaaaactatgcagatagtgtaaaaggaagatttacaataagtagagataatagtaaaaatacagtaagtttacaaatgaatagtttaagaccagaagatacagcagtatattattgtgcaaaagatgtaggagataataaaagtgatgaatgggcaacagattattatgattttagtatagcatatccagtaccagatccaagagcagtagtaggagcatttgatttatggggacaaggaacaatggtaacagtaagtagt

SEQ ID NO: 48011 - RNA, 432 nt, synthetic construct
  misc_feature 1..432: note = derived and/or modified sequence opt6 from anti-HIV_cap256-048-090756_VR-Chain
  source 1..432: mol_type = other RNA
caagtacaattagtagaaagtggaggaggagtagtaagaccaggaagaagtttaagattaagttgtgcagtaagtggatttacatttagtaattatgcaatacattgggtaagacaagcaccaggaaaaggattagaatgggtagcagtaatatcatatgatggaagtgataaatattatgcagatagtgtaaaaggaagatttacaataagtagagaaaatagtaaaaatatgttatatttacaaatgaatagtttaagaggagaagatacagcagtatattattgtgcaaaagatttaagagaatttgaatgtgaagaatgggcaagtgattattatgattttggaagagattatccatgtcaagatccaagaggagtagtaggaacatttgatgtatggggacatggatcattagtaacagtaagtagt

SEQ ID NO: 48012 - RNA, 432 nt, synthetic construct
  misc_feature 1..432: note = derived and/or modified sequence opt6 from anti-HIV_cap256-048-089065_VR-Chain
  source 1..432: mol_type = other RNA
caagtacaattagtagaaagtggaggaggagtagtacaaccaggaagaagtttaagattaagttgtgcagcaagcggatttacatttagtacatatgcaatgcattgggtaagacaagcaccaggaaaaggactagaatgggtagcattaataagttatgatggaacaaacaaatattatgtagatagtgtaaaaggaagatttacaataagtagagataatagtaaaaatacactatatttacaaatgaatagtttaacagcagaagatacagcagtatattattgtgcaaaagatttaggaggaaataaagatgatgaatggggaacagattattatgattttagtgtagcatacccagtacaagatccaagagcagtaagtggaatatttgatgtatggggacatggaacaatggtaacagtaagtagt

SEQ ID NO: 48013 - RNA, 432 nt, synthetic construct
  misc_feature 1..432: note = derived and/or modified sequence opt6 from anti-HIV_cap256-048-084986_VR-Chain
  source 1..432: mol_type = other RNA
caagtacaattagtagaaagtggaggaggagtagtacaaccaggaagaagtttaagattaagttgtgcagcaagtggatttacatttagtgattacgcaatgcattgggtaagacaagcaccaggaaaaggattagaatgggtagcattaataagttatgatggaagtaataaatattatgcagatagtgtaaaaggaagatttacaataagtagagataatagtaaaaatacattatatttacaaatgagtagtttaacagcagaagatacagcagtatattattgtgcaaaagatttaggaggaaataaaaatgatgaatgggcaacagattattatgatttaagcatagcatatccaatacatgatccaagagcagtattaggagcatttgatgtatggggacaaggaacaatgttaacagtaagtagc

SEQ ID NO: 48014 - RNA, 432 nt, synthetic construct
  misc_feature 1..432: note = derived and/or modified sequence opt6 from anti-HIV_cap256-048-083355_VR-Chain
  source 1..432: mol_type = other RNA
caagtacaattagtagaaagtggaggaggagtagtacaaccaggaagaagtttaagattaagctgcgcagtaagtggatttatatttagtagttatgcaatgagatgggtaagacaagcaccaggaaaaggattagaatgggtagcagtaataagttatgatggaagtaaaacaaattatgcagatagtgtaaaaggaagatttacaataagcagagataatagcaaaaatacattatatttacaaatgaatagtttaacaagtgaagatacagcagtatattattgtgcaaaagatttaggaggaagtaaaacagatgaatggggaacagattattatgaattttggaatgcatatccagtacaagatccaagagtagtagtaggagcatttgacatatggggacatggaacaatggtaacagtaagtagt

SEQ ID NO: 48015 - RNA, 432 nt, synthetic construct
  misc_feature 1..432: note = derived and/or modified sequence opt6 from anti-HIV_cap256-048-082462_VR-Chain
  source 1..432: mol_type = other RNA
caagtacatttagtagaaagtggaggaggagtagtacaaccaggaaaaagtttaagattaagttgtacagcaagtagatttatatttagaaattatgcaatggattgggtaagacaagcaccaggaaaaggactagaatgggtagcagtaataagttatgatggagtaaaagagcattatgcagaaagtgtaaaaggaagatttacaataagtagagataatagtaaaaatacagtatatttacaaatgaatagtttaagagtagaagatacagcagtatattattgtgcaaaagatttaggagcaaataaagatgatgaatgggcaacagattattatgatttaagtgtagcatatccagtaccagatccaagagcagtagtaggagcatttgatgtatggggacaaggaacaatggtaacagtaagcagc

SEQ ID NO: 48016 - RNA, 432 nt, synthetic construct
  misc_feature 1..432: note = derived and/or modified sequence opt6 from anti-HIV_cap256-048-082246_VR-Chain
  source 1..432: mol_type = other RNA
caagtacatttagtagaaagtggaggaggagtagtacaaccaggaagaagtttaagaataagttgtgcagcaagcggatttacatttagtaaaaatgcaatgcattgggtaagacaagcaccaggaaaaggattagaatgggtagcatttgtagcatttgatgaaagtgataaatattatgcagatagtgtaaaaggaagatttacaataagtagagataatagtaaaaatatattaagtttacaaatgaatagcttaagagcagaagatacagcagtatattattgtgcaaaagaagtagatgaatataaagatgatgaatgggcaagcgattattatgatttaagtatagcatatccagtaagagatccaagagcagtagtaggaggatttgatatatggggacaaggaacaatggtaacagtgagcgca

SEQ ID NO: 48017 - RNA, 432 nt, synthetic construct
  misc_feature 1..432: note = derived and/or modified sequence opt6 from anti-HIV_cap256-048-080752_VR-Chain
  source 1..432: mol_type = other RNA
caagtacaattagtagaaagcggaggaggagtagtacaaccaggaggaagtttaagattgagttgtgcagcaagcggatttacattctcaaattatggaatgcactgggtaagacaagcaccaggaaaaggactagaatgggtagcatttataagatatgatggagatataacatattatgtagatagtgtaaaaggaagatttacaataagcagagacaatagtaaaaatgcactatatttacaaatgaatagtttaagagcagaagatacagcactatattactgtgcaaaagacttaagagaatatgaatgtgaagaatgggcaagtgactattatgatttcggaagagaatatccatgtcaagacccaagaggagtagtaggaacattcgatatatggggacaaggaacaatggtaacagtaagttca

SEQ ID NO: 48018 - RNA, 435 nt, synthetic construct
  misc_feature 1..435: note = derived and/or modified sequence opt6 from anti-HIV_cap256-048-078409_VR-Chain
  source 1..435: mol_type = other RNA
caagtacaattagtagaatcaggaggaggagtagtacaaccaggaagatcattaagactatcatgtgcagcatcaggatttacatttaataattatgcaatggattgggtaagacaagcaccaggaaaaggattagaatgggtagcactaatatcatatgacggaagtaataaatattatgcagaatcagtaaaaggaagatttacaatatcaagagataatagtaaaaatacattatatttacaaatgaatagtttaagagcagaagacacagcagtatattattgtgcaaaagatgtaggagaaaaacaatcaatgatgagatgggcaacagactattatgatttatcaatagcatatccagtaccagacccaagagcagtagtaggagcatttgatttatggggaagaggaacaatggtaacagtatcatca

SEQ ID NO: 48019 - RNA, 432 nt, synthetic construct
  misc_feature 1..432: note = derived and/or modified sequence opt6 from anti-HIV_cap256-048-078273_VR-Chain
  source 1..432: mol_type = other RNA
gaagtacaattagtagaaagcggaggaggattagtacaaccaggaggaagtttaagattaagctgtgcagcaagcggatttacagtatcaagtaattacatgagctgggtaagacaagcaccaggaaaaggactagaatgggtagcagtaatatcaagtgatggatcaaataaaaattatgcagatagtgtaaaaggaagatttacaataagcagagacaatagtaaaaatacactatttctacaaatgaatagcttaagaccagaagatacagcagtatatttctgtgcaaaagacttaggagcaaataaagatgatgaatgggcaacagactattacgatttaagtatagcatatccagtacatgacccaagagcagtagtaggaatatttgatttatggggacaaggaacaatggtaacagtaagttca

SEQ ID NO: 48020 - RNA, 432 nt, synthetic construct
  misc_feature 1..432: note = derived and/or modified sequence opt6 from anti-HIV_cap256-048-078062_VR-Chain
  source 1..432: mol_type = other RNA
gatgtatatttagtagaaagtggaggaggattagtacaaccaggaggaagtttaagattaagttgtacagcaagtggaataacatttagtacatatgaaatgaattgggtaagacaagcaccaggaaaaggattagaatgggtagcatttgtagcatttgatggaagtgataaatattatgcagatagtgtaaaaggaagatttgtaataagtagagataatagtaaaaatacattaagtttacaaatgaatagtttaagagcagaagatacagcagtatattattgtgcaaaagaagtaggagaagataaagacgatgaatgggcaagtgattattatgatttaagcatagcatatccagtacatgatccaagagcagtagtaggaggatttgatatatggggacaaggaacaatggtaacagtaagtagt

SEQ ID NO: 48021 - RNA, 432 nt, synthetic construct
  misc_feature 1..432: note = derived and/or modified sequence opt6 from anti-HIV_cap256-048-077798_VR-Chain
  source 1..432: mol_type = other RNA
caagtacaattagtagaaagcggaggaggagtagtacaaccaggaagaagtttaagattaagctgtgcagcaagcggatttacattcagtaattatggaatgcactgggtaagacaaacaccaggaaaaggattagaatgggtagcagtaatatcatatgatggatcaaataaattttatgcagatagtgtgaaaggaagatttacaataagcagagacaatagtaaaaatacattatatttacaaatgaatagtttaagagtagaagatacagcagtatatcattgtgcaaaagatttaggaggaagtaaaagtgatgaatgggcaacagactattatgattggtcaatagcatatccagtacatgacccaagagcagtagtaggagtatttgatatatggggacaaggaacattagtaacagtaagttca

SEQ ID NO: 48022 - RNA, 432 nt, synthetic construct
  misc_feature 1..432: note = derived and/or modified sequence opt6 from anti-HIV_cap256-048-073853_VR-Chain
  source 1..432: mol_type = other RNA
gaagtacaattggtagaaagtgggggaggattagtaaaaccaggaggaagtttaagattgagttgtgcagcaagtggatttacatttagtgatgcatggatgaattgggtaagacaagcaccaggaaaaggattagaatgggtagcaggaataagttttgcaggaacaaataaatattatgcagatagtgtaaaaggaagatttacaataagtagagataatagtaaaaatacattatatttacaaatgaatagtttaagagcagaagatacagcattatattattgtgcaaaagatatgagagaatatgaatgtgaagaatgggcaagtgattattatgattttggaagagattatccatgtcaggatccaagaggagtagtaggaacatttgatatatggggacaaggaacaatggtaacagtaagtagt

SEQ ID NO: 48023 - RNA, 435 nt, synthetic construct
  misc_feature 1..435: note = derived and/or modified sequence opt6 from anti-HIV_cap256-048-071661_VR-Chain
  source 1..435: mol_type = other RNA
caagtacaattagtagaaagtggaggaggggtagtacaaccaggaagaagtttaggattaagttgtgaagtaagtggatttacatttagtgattattttatgagttggataagacaagcaccaggaaaaggattagaatgggtagcagtaataagtcatgacggaaataataaatattatccagatagtgtacaaggaagatttacaataagtagagaaaatagtaaaaatacattatatttacaaatgaatagtttaaaaccagaagatacagcagtatatttttgtgcaaaagatttaggaggagaaagcgaagtagaagaatgggcaagtgattattatgattttggaagagatataccaggaccagatccaagaggagtagtaggaacactagatatatggggacatggaacaatggtaacagtaagtagc

SEQ ID NO: 48024 - RNA, 432 nt, synthetic construct
  misc_feature 1..432: note = derived and/or modified sequence opt6 from anti-HIV_cap256-048-071360_VR-Chain
  source 1..432: mol_type = other RNA
caagtacaattagtagaaagtggaggaggagtagtacaaccaggaagaagtttaagattaagttgtgcagcaagtggatttacactaacaaattatgcaatggattgggtaagacaagcaccaggaaaaggattagaatgggtagcagtaatatcaagtgatggcagtaataaaaattatgaagatagtgtaaaaggacgatttacaataagtagagataatagtaaaaatacactatatttacaaatgtcaagtttaagaccagaagatacagcagtatattattgtgcaaaagatgtaggagataataaaagtgatgaatgggcaacagattattatgattttagtatagcatatccagtaccagatccaagagcagtagtaggagcatttgatttatggggacaaggaactatggtaacagtaagtagt

SEQ ID NO: 48025 - RNA, 432 nt, synthetic construct
  misc_feature 1..432: note = derived and/or modified sequence opt6 from anti-HIV_cap256-048-070955_VR-Chain
  source 1..432: mol_type = other RNA
gaagtacaattagtagaaagcggaggaggattagtacaaccaggaggaagtgtaagattaagttgtgcagtaagtggatttacatttagtagttattggatgagttgggtaagacaagcaccaggaaaaggattagaatgggtagcagtgataagtgatagtggatcaaataaatattatgcagatagtgtaaaaggaagatttacaataagtagagataatagtaaaaatacattatatttacaaatgaatagcttaagagcagaagatacagcagtatatttttgtgcaaaagatttaggagggagagaaacagaagaatgggcatcagattattatgattttggaagagattttccaggacaagatcaaagagcagtagcaggagtatttgatatgtggggacaaggaacaatggtaacagtaagttca

SEQ ID NO: 48026 - RNA, 432 nt, synthetic construct
  misc_feature 1..432: note = derived and/or modified sequence opt6 from anti-HIV_cap256-048-070061_VR-Chain
  source 1..432: mol_type = other RNA
gaagtacaattattagaaagtggaggaggattagtacaaccaggaggaagtctaagattaagttgtgcagcaagcggatttacatttagttcatatgcaatgcattgggtaagacaagcaccaggaaaaggattagaatgggtagcagtaacaagttatgatggaagtaataaatattatgcagatagtgtaaaaggaagatttacaataagtagagataatagcaaaaatacattatatatgcaaatgaatagtttaagagcagaagatacagcagtatattattgtgcaaaagatcaaggagaaagtgaaaaagaagaatgggcaagtgattattatgattttggaagagattatccaggaagagatccaagaagggtagtagcaacatttgcaatatggggacaaggaacaatggtaacagtaagtagt

SEQ ID NO: 48027 - RNA, 432 nt, synthetic construct
  misc_feature 1..432: note = derived and/or modified sequence opt6 from anti-HIV_cap256-048-069669_VR-Chain
  source 1..432: mol_type = other RNA
caagtacaattagtagaaagcggaggaggagtagtgcaaccaggaagaagtttaagattaagttgtgcagtaagcggattcacattctcaaaatttccaatgcactgggtaagacaagcaccaggaaaaggactagaatgggtagcagtaatatcatatgatggaaacaaaaaatactatgtagatagtgcaaaaggaagatttacaataagcagagacaatagtagaaaaacactatatctacagatgacaggattaagaccagaagatacagcagtatattactgtgcaaaagacttaggaggaggagaatgtgaaacatgggcatcagactattacgatttcggaaaagattacccgtgcttagacccaagagatgtagtaggaacattcgatatatggggacaaggaacactagtaacagtaagttca

SEQ ID NO: 48028 - RNA, 432 nt, synthetic construct
  misc_feature 1..432: note = derived and/or modified sequence opt6 from anti-HIV_cap256-048-069205_VR-Chain
  source 1..432: mol_type = other RNA
caagtacaattagtagaaagcggaggaggagtagtacaaccaggaagaagtttaagattaagttgtgcagcaagtggattcacattctcaagctatgcaatgcactgggtaagacaagcaccaggaaaaggactagaatgggtagtagtaatatcaaacgatggaaataacaaatactacgcagatagcgtaaaaggaagatttacaataagcagagacaatagtaaaaacacagtatatctacaaatgaatagcttaagagcagaagatacagcagtatattactgtgcaaaagacgtaggagatacaaaaaaagatgaatgggcaacggactattacgatctatcaatagcatacccagtacaagacccacaagcagtagtaggagcattcgatatatggggacaaggaacaatggtaacagtaagtagt

SEQ ID NO: 48029 - RNA, 432 nt, synthetic construct
  misc_feature 1..432: note = derived and/or modified sequence opt6 from anti-HIV_cap256-048-068882_VR-Chain
  source 1..432: mol_type = other RNA
caagtacaattagtagaaagtggaggaggagtagtacaaccaggaagaagtttaagattaagctgtgcagcaagtggatttacatttagtacatatgcaatgcattgggtaagacaagcaccaggaaaaggattagaatgggtagcattaataagttatgatggaacagataaatattatgcagatagtgtaaaaggaagatttacaataagtagagataatagtaaaaatacagtatatttacaaatgaatagcttaagaggagtggatacagcagtatattattgtgcaaaagatttaggaggaggagaagtagaagaatgggcaacagattattatgattggagtacagcatatccagtagaacatccaagagcagtagtaggagtatttgatatatggggacaaggaacaaaagtaacagtaagtagt

SEQ ID NO: 48030 - RNA, 432 nt, synthetic construct
  misc_feature 1..432: note = derived and/or modified sequence opt6 from anti-HIV_cap256-048-067764_VR-Chain
  source 1..432: mol_type = other RNA
gaagtacaattagtacaaagtggaggaggattagtaaaaccaggaggaagtttaagattaagttgtgcagcaagtggatttacatttagtacatatagtatgaattgggtaagacaagcaccaggaaaaggattagaatgggtagcagtaatatcaagtgatggaagtagtaaaaattatgcagatagcgtaaaaggaagatttacaataagtagagataatagtaaaaatacagtaagtttacaaatgaatagtttaagaccagaagatacagcagtatattattgtgcaaaagatgtaggagcaaataaagatgatgaatgggcaacagattattatgatttaagtatagcatatccagtaccagatccaagggcagtagtaggagcatttgatatatggggacaaggaacaatggtaacagtaagtagt

SEQ ID NO: 48031 - RNA, 432 nt, synthetic construct
  misc_feature 1..432: note = derived and/or modified sequence opt6 from anti-HIV_cap256-048-066845_VR-Chain
  source 1..432: mol_type = other RNA
caagtattattagtagaaagtggaggaggagtagtacaaccaggaggaagtttaacattaagttgtgcagcaagtggatttacatttagtaattatggaatgcattgggtaagacaagcaccaggaaaaggattggaatgggtagcatttataagatatgatggaaataataaatattatgcagatagtgtaaaaggaagatttacaataagtagagataatagtaaagatacactatatttacaaatggatggattaagaccagaagatacagcattatattattgtgcaaaagatttaggagaaagagaatgtgaagaatgggcaagtaattattatgattttggaagagattatccatgtcaagatccaagaggagtagtaggaacatttgatatatggggacaaggaacaatggtaacagtaagttca

SEQ ID NO: 48032 - RNA, 432 nt, synthetic construct
  misc_feature 1..432: note = derived and/or modified sequence opt6 from anti-HIV_cap256-048-065226_VR-Chain
  source 1..432: mol_type = other RNA
gaagtacaattagtagaaagcggaggaggattagtgaaaccaggaggaagtttgagattaagctgtgtagcaagcggatttacattttcaaattatggaatgcactgggtaagacaagcaccaggaaaaggattagtatgggtagcaggaatatcatttgcaggaacaaataaatattatgcagcaagtgtaaaaggacgatttacaataagcagagataatagtaaaaatacactatatctacaaatgaatagtttaagagcagaagatacagcactatattactgtgcaaaagacatgagagaatatgaatgtgaagaatgggcatcagactattatgatttcggaagagattatccatgtcaagacccaagaggagtagtaggaacatttgatatatggggacaaggaacaatggtaacagtaagctca

SEQ ID NO: 48033 - RNA, 432 nt, synthetic construct
  misc_feature 1..432: note = derived and/or modified sequence opt6 from anti-HIV_cap256-048-063717_VR-Chain
  source 1..432: mol_type = other RNA
caagtacaattagtagaaagtggaggaggagtagtacaaccaggaagaagtttaagattaagttgtgcagcaagtggatttagttttagtaatcatgcaatggattgggtaagacaagcaccaggaaaaggattagaatgggtagcagtaataagtagtgatggaagtgataaaatatatgcagaaagtgtaaaaggaagatttacaataagtagagataatagtaaaaatacattatatttacaaatgaatagcctaagagtagaagatacagcagtatatttttgtgcaaaagatttaggagcaaataaagatgatgaatgggcaacagattattatgatttaagtatagcatatccagtaccagacccaagagcagtagtaggagcatttgatatatggggacaaggaacaatggtaagtgtaagtagt

SEQ ID NO: 48034 - RNA, 432 nt, synthetic construct
  misc_feature 1..432: note = derived and/or modified sequence opt6 from anti-HIV_cap256-048-063150_VR-Chain
  source 1..432: mol_type = other RNA
gaagtacaattagtagaaagtggaggaggagtagtacaaccaggaagaagtttaagattaagttgtgcagcaagtggatttacatttagtagttatgcaatgcattgggtaagacaagcaccaggaaaaggattagaatgggtagcacatataagatatgatggaagtaataaatattatatagatagtgtacaaggaagatttacaataagtagagataatccaaaaaatacattatatttacaaatgaatagcttaagaacagaagatacagcagtatattattgtgcaaaagatttaggaggaggagaagtagaagaatgggcaacagattattatgattggagtatagcatatccagttgaacatccaagagcagtagtaggagtatttgatatatggggacaaggaacaaaagtaacagtaagtagt

SEQ ID NO: 48035 - RNA, 432 nt, synthetic construct
  misc_feature 1..432: note = derived and/or modified sequence opt6 from anti-HIV_cap256-048-062431_VR-Chain
  source 1..432: mol_type = other RNA
caagtacaattagtagaaagtggaggaggagtagtacaaccaggaagaagcttaagattaagttgtgcagcaagtggatttacatttagtaattttgcaatggattgggtaagacaagcaccaggaaaaggattagaatgggtagcagtaataagtagcgatggaagtaaaaaaaattatggagatagcgtaaaaggaagatttacaataagtagagataatagtaaaaatacattatttttacaaatgaatagtttaagaccagaagatacagcattatattattgtgcaaaagatttaggaggatataaaagtgatgaatgggcaacagattattatgatttaagtatagcatatccagtacaagatccaagaccgtggttagaattattatatatatggggacaaggagcaatggtaacagtaagtagt

SEQ ID NO: 48036 - RNA, 432 nt, synthetic construct
  misc_feature 1..432: note = derived and/or modified sequence opt6 from anti-HIV_cap256-048-060745_VR-Chain
  source 1..432: mol_type = other RNA
caagtacaattagtagaaagcggaggaagtgtagtacaaccaggaagaagtttaagattaacatgtacagcaagtggatttacatttagtcattatgcaatggattgggtaagacaagcaccaggaaaaggactagaatgggtagcagtaataagtagtgatgcaacaaataaaaattatgcagatagtgtaaaaggaagatttacaataagtagagataatagtaaaaatacagtatatttacaaatggatagtttaagagcagaagatacagcagtatattattgtgcaaaagatgtaggagattataaagatgatgaatgggcaacagattattatgatttttcaatagcatatccagtaccagatccaagagcagtagtaggagcatttgatttttggggacaaggaacaatggtaacagtaagtagt

SEQ ID NO: 48037 - RNA, 432 nt, synthetic construct
  misc_feature 1..432: note = derived and/or modified sequence opt6 from anti-HIV_cap256-048-060420_VR-Chain
  source 1..432: mol_type = other RNA
caagtacaactagtagaaagcggaggaggagtagtacaaccaggaagaagcttaagattaagctgtgcagcaagcggattcacattttcaagctatggaatggcatgggtaagacaagcaccaggaaaaggactagaatgggttacagtaatatcattcgcaggagtaaaaaaatactatgcagatagcgtaaaaggaagatttacaataagcagagacaatagtaaaggaacactatatttacaaatgaatagcttaagagcagaagatacagcagtatattactgtgcaaaagacgtaggagatacaaaaaaagatgaatgggcaacagactattacgatttatcaatagcatacccagtacaagacccacaagcagtagtaggagcattcgatatatggggacaaggaacaatggtaacagtaagttca

SEQ ID NO: 48038 - RNA, 435 nt, synthetic construct
  misc_feature 1..435: note = derived and/or modified sequence opt6 from anti-HIV_cap256-048-060014_VR-Chain
  source 1..435: mol_type = other RNA
caagtacaattagtagaaagtggaggaggagtagtacaaccaggaagaagtttaagattaagttgtgcagcaagtggatttacatttagtaattacggaatgcattgggtaagacaagcaccaggaaaaggattagaatgggtagcattaataagtcatgatggaagtaataaaaattttgcagatagtgtaaaaggaaggtttacaataagtagagataatagtaaaaatacattatatttacaaatgaatagtttaagaacagaagatacagcaatatattattgtgcaaaagatttaggaggagaaagtgaaatagaagaatggccaagtgattattatgattttggaagagattatccagtaccagatccaagaggagtagtaggaacatttgatttttggggacaaggaacaatggtaacagtaagtagt

SEQ ID NO: 48039 - RNA, 432 nt, synthetic construct
  misc_feature 1..432: note = derived and/or modified sequence opt6 from anti-HIV_cap256-048-059747_VR-Chain
  source 1..432: mol_type = other RNA
caagtacaattagtagaaagtggaggaggagtagtacaaccaggaagaagtttaagattaagttgtgcagcaagcggatttacatttacacattatgcaatggattgggtaagacaagcaccaggaaaaggattagaatgggtagcagtaataagtagtgatggaagtagtaaagattatgcagatagtgtaaaaggaagatttacaataagtagagataatagcaaaaatacattaagtttacaaatgaatagtttaagaccagaagatacagcagtatattattgtgcaaaagatttaggagcaagtaaagatgatgaatgggcaacagattattatgatttaagtatagcatatccagtacatgatccaagagcagtagtaggaggatttgatatatggggacaaggaacaatggtaacagtaagtagt

SEQ ID NO: 48040 - RNA, 432 nt, synthetic construct
  misc_feature 1..432: note = derived and/or modified sequence opt6 from anti-HIV_cap256-048-058393_VR-Chain
  source 1..432: mol_type = other RNA
caagtacaattagtagaaagcggaggaggagtagtacaaccaggaggaagtttaagattaagctgtgcagcaagcggattcacattcaatacatatggaatgcactgggtaagacaagcaccaggaaaaggactagaatgggtaacatttataagatatgatggatcaaatgaatactatgcagatagcgtaaaaggaagatttacaataagtagggacaatagtaaaaacacactatatctacaaatgaatagcttaagcgtagaagatacagcagtatactactgtgcaaaagacttaggaaaaaataaagacgatgaatgggcaacagactattacgatatatcaatagcatacccagtaccagacccaagagcagtagtaggagtattcgatatatggggacaaggaacagtagtaacagtaagcagt

SEQ ID NO: 48041 - RNA, 432 nt, synthetic construct
  misc_feature 1..432: note = derived and/or modified sequence opt6 from anti-HIV_cap256-048-058159_VR-Chain
  source 1..432: mol_type = other RNA
caagtacaattagtagaaagcggaggaggagtagtacaaccaggaagaagtttaagattaagttgtgcagcaagcggatttacatttagtagttatccaatgcattgggtaagacaagcaccaggaaaaggattagaatgggtagcagtaataagttttgcaggaacaaataaatattatgcacatagtgtaaaagggagatttacaataagcagagataatagtaaaaatacattatatttacaaatgaatagtttaagagcagaagatacagcattatattattgtgcaagagatttaagagaaagcgaatgtgaagaatgggcatcagattattatgattttggaagagaatatccatgtcaagatccaagaggagtagtaggaacatttgatatatggggaagaggaacaatggtaacagtaagttca

SEQ ID NO: 48042 - RNA, 432 nt, synthetic construct
  misc_feature 1..432: note = derived and/or modified sequence opt6 from anti-HIV_cap256-048-057127_VR-Chain
  source 1..432: mol_type = other RNA
gatgtatatttagtagaaagtggaggaggattagtacaaccaggaggaagtttaagattaagttgtgtagcaagtggaataacatttagcagttatggaatgcattgggtaagacaagcaccaggaaaaggattagaatgggcagcatttataagatatgatggaagaaataaatattatgcagatagtgtaaaaggaagatttacaataagtagagataatagtaaaaatacattaagtttacaaatgaataatttaagagcagaagatacagcagtatattattgtgcaaaagaagtaggagataataaagatgatgaatgggcaagtgattattatgatttaagtatagcatatccagtacaagatccaagagcagtagtaggaggatatgatatatggggacaaggaacaatggtaacagtaagtagt

SEQ ID NO: 48043 - RNA, 432 nt, synthetic construct
  misc_feature 1..432: note = derived and/or modified sequence opt6 from anti-HIV_cap256-048-056251_VR-Chain
  source 1..432: mol_type = other RNA
gaagtacaattagtagaaagtgggggaggattagtacaaccaggaagaagtttaagattaagctgtgcaggaagtggattcacatttagtaattttggatttcattgggtaagacaagcaccaggaaaaggattagaatgggtagcagcaataagttttgcaggatataataaatattatgcagatagtgtaaaaggaagatttacaataagtagagaaaatagtaataatatgttatatttacaaatgagtagtttaagagcagaagatacagcagtatattattgtgcaaaagatttaagagaaagcgaatgtgaagaatgggcatcagattattatgattttggaaaagattatccatgtcaagatccaagaggagtagtaggaacatttgatgtatggggacatggaagtttagtaacagtaagcagt

SEQ ID NO: 48044 - RNA, 432 nt, synthetic construct
  misc_feature 1..432: note = derived and/or modified sequence opt6 from anti-HIV_cap256-048-055421_VR-Chain
  source 1..432: mol_type = other RNA
caagtacaattagtagaaagtggaggaggagtagtacaaccagcaagaagtttaagattaagttgtgcagcaagtggatttatattttcaacatatggaatgcattgggtaagacaagcaccaggaaaaggattagaatgggtagcagtaataagtagtgatggaagtagtaaagattatgcagatagtgtaaaaggaagatttacaataagtagagacaatagtaaaaatacattaagtttacaaatgaatagtttaagaccagaagatacagcagtatattattgtgcaaaagatttaggagcaagtaaagatgatgaatgggcaacagattattatgattttagtatagcatatccagtacaagatccgagagcagtagtaggagcatttgatatatggggacaaggaacaatggtaacagtaagtagt

SEQ ID NO: 48045 - RNA, 432 nt, synthetic construct
  misc_feature 1..432: note = derived and/or modified sequence opt6 from anti-HIV_cap256-048-054989_VR-Chain
  source 1..432: mol_type = other RNA
caagtacaattagtagaaagtggaggaggagtagtacaaccaggaggaagtttaagattaagttgtgcagcaagtggatttacgtttagtacaaatggaatgcattgggtaagacaagcgccaggaaaaggattagaatgggtggcatttataagatatgatggaagtaataaatattatgcagatagtgtaaaaggaagatttacaataagtagagataatagtaaaaatacagtatatttacaaatgaatagtttaagaggagtagatacagcagtatattattgtgcaaaagatttaggaggaggagaagtagaagaatgggcaacagattattatgattggagtatagcatatccagtagaacatccaagagcagtagtaggagtatttgatatatggggacaaggaacaaaagtaacagtaagtagt

SEQ ID NO: 48046 - RNA, 435 nt, synthetic construct
  misc_feature 1..435: note = derived and/or modified sequence opt6 from anti-HIV_cap256-048-054759_VR-Chain
  source 1..435: mol_type = other RNA
caagtacaattagtagaaagtggaggaggagtagtacaaccaggaagaagtttaagattaagttgtgcagcaagtggatttagttttagcaaaaatggaatgcattgggtaagacaagcaccaggaaaaggattagaatgggtagcatttgtagcatttgatgaaagtgataaatattatgcagatagtgtaaaaggaagatttacaataagtagagataatagtaaaaatacactaagtttacaaatgaatagtttaagagtagaagatacagcagtatattattgtgcaaaagaagtaggagaaaataaagatgatgaatgggcagcaccagattattatgattttagtatagcatatccagtacaagatccaagagcagtagtaggaggatttgatatatggggacaaggaacaatggtaacagtaagtagt

SEQ ID NO: 48047 - RNA, 432 nt, synthetic construct
  misc_feature 1..432: note = derived and/or modified sequence opt6 from anti-HIV_cap256-048-052573_VR-Chain
  source 1..432: mol_type = other RNA
caagtaaaattagtagaaagtggaggaggagtagtacaaccaggaagaagtttaagattaagctgtgcagcaagtggatttagttttagtaattatgcaatggattgggtaagacaagcaccaggaaaaggattagaatgggtagcagtagtaagtagtgatggaagtaataaaaattatgcagatagcgtaaaaggaagatttacaataagtagagataatagtaaaaatacagtatatttacaaatgaatagtttaagagcagaagatacagcagtatattattgtgcaaaagatttaggagcaaataaagatgatgaatgggcaacagattattatgattggagtatagcatatccagtacatgatccaagagcagtagtaggagtatttgatatatggggacaaggaacattagtaacagtaagttca

SEQ ID NO: 48048 - RNA, 432 nt, synthetic construct
  misc_feature 1..432: note = derived and/or modified sequence opt6 from anti-HIV_cap256-048-051477_VR-Chain
  source 1..432: mol_type = other RNA
caagaacaattagtagaaagtggaggaggagtagtacaaccaggaagaagtttaagattaagttgtgcagcaagtggatttacatttagtaattatgcaatgcattgggtaagacaagcaccaggaaaaggattagaatgggtagcagcaatgagtcatgatggaagtgataaatattatgcagatagtgtaaaaggaagatttacaataagtagagataatagtaaaaatacattatatatgcaaatgaatagtttaagagcagaagatacagcagtatattattgtgcaaaagatcaaggagaaagcgaaaaagaagaatgggcatcagattattatgatttaagtatagcatatccaatacaagatccaagagcaatggtaggagcatttgatatatggggacaaggaacaatggtaacagtaagtagt

SEQ ID NO: 48049 - RNA, 432 nt, synthetic construct
  misc_feature 1..432: note = derived and/or modified sequence opt6 from anti-HIV_cap256-048-051299_VR-Chain
  source 1..432: mol_type = other RNA
caagtacaattagtagaaagcggaggaggagtagtacaaccaggaagaagtttaagattaagctgtgcagcaagcggatttacattttcaacatttggaatgcactgggtaagacaagcaccaggaaaaggactagaatgggtagcattaatatcacacgatggaaataataaatattatgcagatagtttaaaaggaagatttacaataagcagagaaaatagtaaaaatacattatttctacaaatgaactcattaagagcagaagatacatcagtatattactgtgcaaaagacttaggagattcagaatgtgaagaatgggcatcagactattatgatttcggaaaagattatccatgtttacacccaagaggagtagtaggaacattcgatttctggggacatggaacaatggtaacagtaagttca

SEQ ID NO: 48050 - RNA, 432 nt, synthetic construct
  misc_feature 1..432: note = derived and/or modified sequence opt6 from anti-HIV_cap256-048-050815_VR-Chain
  source 1..432: mol_type = other RNA
caagtacaattagtagaaagtggaggaggagtagtacaaccaggaggaagtttaagactaagttgtgtagtaagtggatttacatttagtagttatggaatgcattgggtaagacaagcaccaggaaaaggattagaatgggtaagttttataagatttgatggaaattatgaatattatgtagatagcgtaaaaggaagatttacaataagtagagataatagtaaaaatacagtatatttacaaatggatagtttaagagcagaagatacagcagtatattattgtgcaaaagatgtaggagattataaagatgacgaatgggcaacagactattatgatttcagtatagcatatccagtaccagatccaagagcagtagtaggagcatttgatttttggggacaaggaacaatggtaacagtaagtagt

SEQ ID NO: 48051 - RNA, 432 nt, synthetic construct
  misc_feature 1..432: note = derived and/or modified sequence opt6 from anti-HIV_cap256-048-049884_VR-Chain
  source 1..432: mol_type = other RNA
caagtacaattagtagaaagtggaggaggagtagtacaaccaggaagaagtttaagattaagttgtgcagcaagtggatttagttttaatacatatgcaatgcattgggtaagacaagcaccaggaaaaggattagaatggatggcattaataagttatgatggaagtaataaatattatgtagatagtgtaaaaggaagatttacaataagtagagataatagtaaaaatacattatatttacaaatgaatagtttaagagcagaagatacagcagtatattattgtgcaaaagatctaggagggaataaagatgatgaatgggcaacagattattatgatctaagtatagcatatccagtacaagatccaagagtagtagtaggaatatttgatatatggggacaaggaacaatggtaacagtgagtagt

SEQ ID NO: 48052 - RNA, 432 nt, synthetic construct
  misc_feature 1..432: note = derived and/or modified sequence opt6 from anti-HIV_cap256-048-049170_VR-Chain
  source 1..432: mol_type = other RNA
caagtacaattagtagaaagtgggggaggagtagtacaaccagggagaagtttaagattaagttgtgcagcaagtggatttatatttagtagttatggaatgcattgggtaagacaagcaccaggaaaaggattagaatgggtagcagtaataagtggagatggaacaaaaaaagattttgcagatagtgtaaaaggaagatttacaataagtaaagataatagtaaaaatatggtaagtttacaaatgaatagtttaagagcagaagatgcagcagtatattattgtgcaaaagatttaggagaaagtgataatgaagaatggccatcagattattatgattttggaagagattttacaggacaaaatccaagagcagtagtaggaacatttgatttatggggacaaggaacaatggtaacagtaagtagt

SEQ ID NO: 48053 - RNA, 435 nt, synthetic construct
  misc_feature 1..435: note = derived and/or modified sequence opt6 from anti-HIV_cap256-048-048531_VR-Chain
  source 1..435: mol_type = other RNA
caagtacaattagtagaaagtggaggaggagtagtacaaccaggaaggagtctaagattaagctgtgcagcaagtggatttacatttagtagttatggattacattgggtaagacaagcaccaggaaaaggattagaatgggtagcatttataagttatgatggaaataataaacattatgtagatagtgtaaaaggaagatttacaataagtagagataatagtaaaaatacactatatttacaaatgaatagtttaagagcagaagatacagcagtatattattgtgcaaaagatttaggaggagaatcagaaatagaagaatgggcaacagattattatgattttagtatagcatatccagtaaaagaaagtagaggagtagtaggaatatttgatatgtggggacaaggaacaatggtaacagtaagtagt

SEQ ID NO: 48054 - RNA, 432 nt, synthetic construct
  misc_feature 1..432: note = derived and/or modified sequence opt6 from anti-HIV_cap256-048-048259_VR-Chain
  source 1..432: mol_type = other RNA
caagtacaattagtagaaagtggaggaggagtagtacaaccaggaagaagtttaagattaagttgtgcagcaagtggatttacatttagtacatgtgcaatgcattgggtaagacaagcaccaggaaaaggattagaatgggtagcagtaataagttatgatggaagtaataaatattatgtagatagtgtaaaaggaagatttacaataagtagagataatagtaaaaatacattatatttacaaatgaatagtttaagagcagaagatacagcagtatattattgtgcaaaagaagtagatataaataaagaagatgaatgggcaagtgattattatgattttagcatagcatatccagtacaagatccaagagcagtagtaggaggatttgatatatggggacaaggaacaatggtaacagtaagtagt

SEQ ID NO: 48055 - RNA, 432 nt, synthetic construct
  misc_feature 1..432: note = derived and/or modified sequence opt6 from anti-HIV_cap256-048-047313_VR-Chain
  source 1..432: mol_type = other RNA
caagtacaattagtagaaagtggaggaggagtagtacaaccaggaagaagtttaagattaagttgtgcagcaagtggatttacatttagtacatttggaatgcattgggttagacaagcaccaggaaaaggactagaatgggtagcagtaataagtcatgatggaaataataaatattatgcagatagtgtaaaaggaagatttacaataagcagagataatagtaaaaatacagtatatttacaaatgaatagtttaagagcagaagatacagcagtatattactgtgcaaaagatttaggagcaaataaagatgatgaatgggcaacagattattatgatctaagtgtagcatatccagtaccagatccaagagcagtagtaggagcatttgatgtatggggacaaggaacaatggtaacagtaagtagt

SEQ ID NO: 48056 - RNA, 432 nt, synthetic construct
  misc_feature 1..432: note = derived and/or modified sequence opt6 from anti-HIV_cap256-048-046596_VR-Chain
  source 1..432: mol_type = other RNA
caagtacaattagtagaaagtggaggaggagtagtacaaccaggaggaagtctaagattaagctgtgcagcaagcggatttacatttagtagttatggaatgcattgggtaagacaagcaccaggaaaaggattagaatgggtagcatttatgagatttgatggaagtaatagatattatggagatagcgtaaaaggaagatttacaataagtagagataatagtaaaaatacattatatttacaaatgaatagtttaagaacagaagatgcagcattatattattgtgcaaaagatatgagagaatttgaatgtgaagaatgggcaagtgattattatgattttggaagagattatccatgtcaagatccaagaggagtagtaggaatatttgatatatggggacaaggaacaatggtaacagtaagtagt

SEQ ID NO: 48057 - RNA, 432 nt, synthetic construct
  misc_feature 1..432: note = derived and/or modified sequence opt6 from anti-HIV_cap256-048-044781_VR-Chain
  source 1..432: mol_type = other RNA
caagtacaattagtagaaagcggaggaggagtagtacaaccaggaagaagtttaagattaagttgtgcagcaagtggatttacatttacaagctatgcaatacattgggtaagacaagcaccaggaaaaggattagaatgggtagcagtaataagttatgatggaagtaaaaaaaattatgcagatagcgtaaaaggaagatttacaataagtagagataatagcaaaaatacactatatgtacaaatgaatagtttaagagcagaagatacagcagtatattattgtgcaaaagaagtaggagaagataaagatgatgaatgggcaagtgattattatgatttaagtatagcatatccagtacatgatccaagagcagtagtaggaggatttgatatatggggacaaggaacaatggtaacagtaagtagt

SEQ ID NO: 48058 - RNA, 432 nt, synthetic construct
  misc_feature 1..432: note = derived and/or modified sequence opt6 from anti-HIV_cap256-048-042599_VR-Chain
  source 1..432: mol_type = other RNA
caagtacaattagtagaaagtggaggaggagtagtacaaccgggaagaagtctaagattaagttgtgcagcaagtggatttacattcagtaattatggaatgcattgggtaagacaaacaccaggaaaaggattagaatgggtagcagtaataagttatgatggaagtaataaattttatgcagatagtgtaaaaggaagatttacaataagtagagataatagtaaaaatacattatatttacaaatgagtagtttaagagcagatgatacagcagtatattattgtgcaaaagaagtaggagaagataaagatgatgaatgggcaagtgattattatgatttaagtatagcatatccagtacatgatccaagagcagtagtaggaggatttgatatatggggacaaggaacaatggtaacagtaagttca

SEQ ID NO: 48059 - RNA, 432 nt, synthetic construct
  misc_feature 1..432: note = derived and/or modified sequence opt6 from anti-HIV_cap256-048-041276_VR-Chain
  source 1..432: mol_type = other RNA
caagtacaattagtagaaagtggaggaggagtagtacaaccaggaaggagcttaagactaagctgtgcagcaagcagattcacattctcaagctatgcaatgcactgggtaaggcaagcaccaggaaaaggactagaatgggtagcaataatatcgtacgatggatcaaacaaatactatgcagatagcgtaaaaggaagatttacaataagcagagacaatagcaaaaacacactatttttacaaatgaatagtctaagagcagaagatacagcactatattactgtgcaaaagacttaggaggatacaaaagcgatgaatgggcaacagactattacgatctatcaatagcatacccaatacaagacccaagagcagtagtaggagcattcgatatatggggacaaggaacaatggtaacagtaagctca

SEQ ID NO: 48060 - RNA, 432 nt, synthetic construct
  misc_feature 1..432: note = derived and/or modified sequence opt6 from anti-HIV_cap256-048-040200_VR-Chain
  source 1..432: mol_type = other RNA
caagtacaattagtagaaagtggaggaggagtagtacaaccaggaagaagtttaagattaagttgtgtagcaagtggatttacatttagtagctttggaatgcattgggtaaggcaagcaccaggaaaaggattagaatgggtagcagtaatatcacatgatggacataataaatattatgcagatagtttaaaaggaagatttacagtaagtagagaaaatagtaaaaatacattatttttacaaatgaatagcttaagagcagaagatacaagtgtatattattgtgcaaaagatttaggagggggagaatgtgaagaatgggcaagtgattattatgattttggaagagattatccatgtttaacaccaagaggagtagtaggaacatttgatatatggggacatggaacaacagtaacagtaagtagt

SEQ ID NO: 48061 - RNA, 432 nt, synthetic construct
  misc_feature 1..432: note = derived and/or modified sequence opt6 from anti-HIV_cap256-048-039061_VR-Chain
  source 1..432: mol_type = other RNA
gaagtacaactactaggaagcggaggaggattagtacaaccaggaggaagtctaagattaacatgtgcagtaagcggatttacattcagtagttttgcaatgagctgggtaagacaagcaccaggaaaaggattagaatgggtagcattaatatcatatgatggaacagacaaatactatgcagatagcgtaaaaggaagatttacaataagcagagacaatagcaaaaacacactatatctacaaatgaatagcttaagagtagaagatacagcaatatatcactgtgcaaaagacttaggaggaacaaaaagtgatgaatgggcaacagactattacgatttatcaatagcatatccaatacaagacccaggagcagtagtaggagtattcgatatatggggacaaggaacaatggtaacagtaagttca

SEQ ID NO: 48062 - RNA, 432 nt, synthetic construct
  misc_feature 1..432: note = derived and/or modified sequence opt6 from anti-HIV_cap256-048-038515_VR-Chain
  source 1..432: mol_type = other RNA
caagtacaattagtagaaagcggaggaggagtagtacaaccaggaagaagtttaagattaagctgtgcagcaagcggattcacattctcgacatatgcaatgcactgggtaagacaagcaccagggaaagggctagaatgggtagtagtaatatcatacgatggatcaaacaaatactatgcagatagcgtaaaaggaagatttacaataagcagagacaatagcaaaaacacactatttctacaaatgaatagcttaagagcagaagatacagcattatattactgtgcaaaagacgtaggagaatacaaaagtgatgaatgggcaacagactattacgatctatcaatagcatacccaatacaagacccacgagcaatggtaggagcattcgatatatggggacaaggaacaatggtaacagtaagctca

SEQ ID NO: 48063 - RNA, 432 nt, synthetic construct
  misc_feature 1..432: note = derived and/or modified sequence opt6 from anti-HIV_cap256-048-038255_VR-Chain
  source 1..432: mol_type = other RNA
caagtacaattagtagaaagcggaggaggagtagtacaaccgggaagaagcctacgactaagctgtgcagcaagcggattcacactatcaagctatgcaatgcactgggtaagacaagcaccaggaaaaggactagaatgggtagcagtaatatcatacgatggatcaaacaaatactatgcagatagcgtaaaaggaagatttacaataagcagagacaatagcaaaaacgcactatatctacaaatgaatagtctaagagcagaagatacagcactatattactgtgcaaaagacttaagagaatacgaatgcgaagaatgggcatcagactattacgatttcggaagagattatccatgccaagacccaagaggagtagtaggaacattcgatatatggggacaaggaacaatggtaacagtaagttca

SEQ ID NO: 48064 - RNA, 432 nt, synthetic construct
  misc_feature 1..432: note = derived and/or modified sequence opt6 from anti-HIV_cap256-048-038177_VR-Chain
  source 1..432: mol_type = other RNA
caagtacaattagtagaatcaggaggaggagtagtacaaccaggaagaagtttaagattaagctgtgcagcaagcggattcacattcaatacatatggaatacactgggtaagacaagcaccaggaaaaggactagaatgggtagcactaatatcatacgatggaacagacaaatactatgcagatagcgtaaaaggaagatttacaataagcagagacaatagcaaaaacacactatatctacaaatgaatagcttaagagtagaagatacagcaatatatcactgtgcaaaagacttaggaggaacaaaaagcgatgaatgggcaacagactattacgatttatcaatagcatacccaatacaagacccaggagcagtagtaggagtattcgatatatggggacaaggaacaatggtaacagtaagctca

SEQ ID NO: 48065 - RNA, 432 nt, synthetic construct
  misc_feature 1..432: note = derived and/or modified sequence opt6 from anti-HIV_cap256-048-035513_VR-Chain
  source 1..432: mol_type = other RNA
caagtacaattagtagaaagtggaggaggagtagtacaaccaggaagaagtttaagattaagttgtgcagcaagtggatttacatttagtagttatggaatggcatgggtaagacaagcaccaggaaaaggattagaatgggtaacagtaataagttttgcaggagtaaaaaaatattatgcagatagtgtaaaaggaagatttacaataagtagagataatagtaaaggaacattatatttacagatggatggattaagaccagaagatacagcattatattattgtgcaaaagatttaggagaaagagaatgtgaagaatgggcaagtgattattatgattttggaagagattttccatgtcaagatccaagaggagtagtaggaacatttgatatatggggacaaggaacaatggtaacagtaagtagt

SEQ ID NO: 48066 - RNA, 432 nt, synthetic construct
  misc_feature 1..432: note = derived and/or modified sequence opt6 from anti-HIV_cap256-048-034112_VR-Chain
  source 1..432: mol_type = other RNA
caaatgcaattagtagaaagtggaggaggagtagtacaaccaggaagaagtttaagattaagttgtgcagcaagtggatttacatttaatagttatgcaatgcattgggtaagacaagcaccaggaaaaggattagaatgggtggcagtaataagttatgatggatcaaataaatattatgcagatagtgtaaaaggaagatttacaataagtagagataatagtaaaaatacagtatatttacaaatgaatagtttaagaggagtagatacagcagtatattattgtgcaaaagatttaggaggaggagaagtagaagaatgggcaacagattattatgattggagtatagcatatccagtagaacatccaagagcagtagtaggagtatttgatatatggggacaaggaacaaaagtaacagtaagcagt

SEQ ID NO: 48067 - RNA, 432 nt, synthetic construct
  misc_feature 1..432: note = derived and/or modified sequence opt6 from anti-HIV_cap256-048-033983_VR-Chain
  source 1..432: mol_type = other RNA
caagtgcaattagtagaaagcggaggaggagtagtacaaccaggagaaagtttaagattaagctgtgcagcaagtggattcacactatcaagccacggaatacactgggtaagacaagcaccaggaaaaggactagaatgggtagcatttatatcaagcgatggatcaaacaaaaactatggagatagcgtaaaaggaagatttacaataagcagagacaatagcaaaaacacactatttttacaaatgaatagtttgagagcagaagatacagcactatattactgtgcaaaagacgtaggagaatacaaaagcgatgaatgggccacagactattacgatctatcaatagcatacccaatacaagacccaagagcaatggtaggagcattcgatatatggggacaaggaacaatggtaacagtaagctca

SEQ ID NO: 48068 - RNA, 432 nt, synthetic construct
  misc_feature 1..432: note = derived and/or modified sequence opt6 from anti-HIV_cap256-048-032688_VR-Chain
  source 1..432: mol_type = other RNA
caagtacaattagtagaaagcggaggaggagtagtacaaccaggaagaagtttaagattaagctgtgcagcaagcggattcatattcaatagttatggaatgcactgggtaagacaagcaccaggaaaaggactagaatgggtagcagtagtacatggagatggaggaaataaatactatgcagatagtgtaaaaggaagatttacaataagcagagacaatagtaaaaacacgctatatttagaaatgaatagcttaagagcagaagatacagcagaatattactgtgcaaaagacttaggagaaagtgataaagaagaatggccatcagactattacgatttcggaagagatttcacaggacaagtaccaagagcagtagtaggagcatttgatatatggggacaaggaacaatggtaacagtaagctca

SEQ ID NO: 48069 - RNA, 432 nt, synthetic construct
  misc_feature 1..432: note = derived and/or modified sequence opt6 from anti-HIV_cap256-048-031092_VR-Chain
  source 1..432: mol_type = other RNA
caagtacaattagtagaaagcggaggaggagtggtacaaccaggaagaagtctaagactaagttgtgcagcaagtggatttagtttttataattttgcaatggattgggtaagacaagcaccaggaaaaggactagaatgggtagcagtaataagcagtgatggaggaaataaaaattatgtagatagtgtaaaaggaagatttacaataagcagagataatagcaaaaatacattatatttacaaatgaatagtttaagagcagaagatacagcagtatattattgtgcaaaagatttaggaggaacaaaagatgatgaatgggcaacagattattatgatatatcaatagcatatccagtacaagatccaagagcagtagcaggagcatttgatatatggggacaaggaacaatggtaacagtaagttca

SEQ ID NO: 48070 - RNA, 435 nt, synthetic construct
  misc_feature 1..435: note = derived and/or modified sequence opt6 from anti-HIV_cap256-048-030464_VR-Chain
  source 1..435: mol_type = other RNA
caagtacaattagtagaaagtggaggaggattagtaaaaccaggaggaagtttaagattaagttgtgaagcaagtggatttagttttacaaattattatatgagttggataaggcaagcaccaggaaaagggttagaatgggtagcagtaataagttttaatggaagaaataaatattatgcagattttgtaaaaggaagatttacaataagtagagataatagtaaaaatacattaagtttacaaatgaatagtttaagagtagaagatacagcagtatattattgtgcaaaagaagtaggagaaaataaagatgatgaatgggcagcaccagattattatgattttagtatagcatatccagtacaagatccaagagcagtagtaggaggatttgatatatggggacaaggaacaatggtaacagtaagtagt

SEQ ID NO: 48071 - RNA, 432 nt, synthetic construct
  misc_feature 1..432: note = derived and/or modified sequence opt6 from anti-HIV_cap256-048-030289_VR-Chain
  source 1..432: mol_type = other RNA
caagtacaattagtagaaagtggaggaggagtagtacaaccaggaggaagtttaagattaagttgtgcagcaagtggatttacattttcaagttatggaatgcattgggtaagacaagcaccaggaaaaggattagaatgggtagcatttataagatatgatggatcaaataaatattatgcagatagtgtaaaaggaagatttacaataagcagagataatagtaaaaatacagtatatttacaaatgaatagtttaagagtagaagatacagcagtatattattgtgcaaaagatttaggagcaaataaagatgatgaatgggcaacagattattatgatttaagtgtagcatatccagtaccagatccaagagcagtagtaggagcatttgacgtatggggacaaggaacaatggtaacagtaagtagt

SEQ ID NO: 48072 - RNA, 432 nt, synthetic construct
  misc_feature 1..432: note = derived and/or modified sequence opt6 from anti-HIV_cap256-048-030261_VR-Chain
  source 1..432: mol_type = other RNA
caagtacaattagtagaaagcggaggaggagtagtacaaccaggaggaagtttaagattaagctgtgcagcaagtggatttacattctcaacatttggaatgcactgggtaagacaagcaccaggaaaaggactagaatgggtagcagtaatatcacatgatggatcaaataaatattatgcagatagtttaaaaggaagatttacaataagtagagaaaatagtaaaaatacactatatttacaaatgaatagtttaagattggaagatacagcagtatatcactgtgcaaaagatttaggaggaagtaaaagcgatgaatgggcaacagactattatgatttatcagtagcatatccagtacaagacccaagagcagtagtaggagtatttgatatatggggacaaggaacaatggtaacagtaagttca

SEQ ID NO: 48073 - RNA, 432 nt, synthetic construct
  misc_feature 1..432: note = derived and/or modified sequence opt6 from anti-HIV_cap256-048-029362_VR-Chain
  source 1..432: mol_type = other RNA
caagtacaattagtagaaagcggaggaggagtagtacaaccaggaagaagtttaagattaagctgtgcagcaagtcaatttacattttcaagttatggaatgcactgggtaagacaagcaccaggaaaaggattagaatgggtagcaggaatatcatttgcaggaacaaataaatattatgcagatagcgtaaaaggaagatttacaataagcagagacaatagtaaaaatacactatatttacaaatgaatagtttaagaacagaagatgcagcattatattactgtgcaaaagacatgagagaatttgaatgtgaagaatgggcatcagactattatgatttcggaagagattacccatgtcaagacccaagaggagtagtaggaatatttgatatatggggacaaggaacaatggtaacagtaagtagt

SEQ ID NO: 48074 - RNA, 432 nt, synthetic construct
  misc_feature 1..432: note = derived and/or modified sequence opt6 from anti-HIV_cap256-048-027638_VR-Chain
  source 1..432: mol_type = other RNA
caagtacaattagtagaaagtggaggaggagtagtacaaccaggaagaagtttaagattaagttgtgtagcaagtgggtttatattttcaagttatggaatacattgggtaagacaagcaccaggaaaaggattagaatgggtagcagtaataagtggagatggaacaaataaatattgtgcagatagcgtaaaaggaagatttacaataagtagagataatagtaaaaatacagtatttctacaaatgaatagtttaagagcagaagatacagcagtattttattgtgctaaagatttaggagaaagtgataaagaagaatggccaagtgattattatgattttggaagagattttacaggacaagtaccaagagcagtagtaggagcatttgatatatggggacaaggaacaatggtaacagtaagcagt

SEQ ID NO: 48075 - RNA, 432 nt, synthetic construct
  misc_feature 1..432: note = derived and/or modified sequence opt6 from anti-HIV_cap256-048-027613_VR-Chain
  source 1..432: mol_type = other RNA
gtacaacaattagtagaaagcggaggagatgtagtacaaccgggaacaagtttaagattaagttgtgaagcaagtggattaatattaagtggatatggattacattgggtaagacaagcaccaggaaaaggaatggaatgggtagcagtaataagttatgatggaagtaataaatattatgcagatagtgtaaaaggaagatttacaataagtagagacaatagtaaaaatacagtatatttacaaatgaatagtttaagaggagtagatacagcagtatattattgtgcaaaagatttaggaggaggagaagtagaagaatgggcaacagattattatgattggagtacagcatatccagtagaacatccaagagcggtagtaggagtatttgatatatggggacaaggaacaaaagtaacagtaagtagt

SEQ ID NO: 48076 - RNA, 432 nt, synthetic construct
  misc_feature 1..432: note = derived and/or modified sequence opt6 from anti-HIV_cap256-048-026627_VR-Chain
  source 1..432: mol_type = other RNA
caagtacaattactaggaagcggaggaggaagcgtacaaccaggaggatcattaagactaacatgtgcagtaagtggattcacattcagcagctttgcaatgagctgggtaagacaagcaccaggaaaaggactagaatgggtagcatttatatcaagcgatggaacaaacaaaaactatggagatagcgtaaaaggaagatttacaataagcagagacaatagtaaaaacacactatttctacaaatgaatagcttaagagcagaagatacagcactatattactgtgcaaaagacttaggaggatacaaaagcgatgaatgggcaacagactattacgatctatcaatagcatacccaatacaagacccaagagcagtagtaggagcattcgatatatggggacaaggaacaatggtaacagtaagttca

SEQ ID NO: 48077 - RNA, 432 nt, synthetic construct
  misc_feature 1..432: note = derived and/or modified sequence opt6 from anti-HIV_cap256-048-026239_VR-Chain
  source 1..432: mol_type = other RNA
caaatgcaattagtagaaagtggaggaggagtagtacaaccaggaagaagtttaagattaagctgtgcagcaagcggatttacatttaatagttatgcaatgcactgggtaagacaagcaccaggaaaaggattagaatgggtagcagtaataagttatgatggatcaaataaatattatgcagatagtgtaaaaggaagatttacaataagcagagacaatagtaaaaatacactatatctacaaatgaatagtttaagaacagaagatgcagcattatattactgtgcaaaagatatgagagaatttgaatgcgaagaatgggcatcagactattatgatttcggaagagattatccatgtcaagacccaagaggagtagtaggaatatttgatatatggggacaaggcacaatggtaacagtaagctca

SEQ ID NO: 48078 - RNA, 432 nt, synthetic construct
  misc_feature 1..432: note = derived and/or modified sequence opt6 from anti-HIV_cap256-048-025518_VR-Chain
  source 1..432: mol_type = other RNA
caagtacaattagtagaaagcggaggaggagtagtacaaccaggaagaagtttaagattaagctgtgcagtaagcggatttacattcagtcaacatgcaatgcactgggtaagacaagcaccaggaaaaggactagaatgggtaacattaatatcaaatgatggaacagaaaaattctatgcagatagcgtaaaaggaagatttacaataagcagagacaatagcaaaaatacactatatctacaaatgaatagtttaagcgtagaagatacagcagtatattactgtgcaaaagacttaggaaaaaataaagacgatgaatgggcaacagactattacgatatatcaatagcatatccagtaccagacccaagagcagtagtaggagtattcgatatatggggacaaggaacagtagtaacagtaagttca

SEQ ID NO: 48079 - RNA, 432 nt, synthetic construct
  misc_feature 1..432: note = derived and/or modified sequence opt6 from anti-HIV_cap256-048-024854_VR-Chain
  source 1..432: mol_type = other RNA
caagtacaattagtagaaagtggaggaggagtagtacaaccaggaagaagtttaacattaagctgtgcggcaagtggatttacatttaataattatgatatgcattgggtaagacaagcaccaggaaaaggattagaatgggtagcatttacaagatatgatggaagtaatcaatattatgcagatagtgtaacaggaagatttacaataagcagagataatagtaaaaatacagtatatttacaaatgaatagtttaagaggagtagatacagcagtatattattgtgcaaaagatttaggaggaggagaagtagaagaatgggcaacagattattatgattggagcatagcatatccagtagaacatccaagagcagtagtaggagtatttgatatatggggacaaggaacaaaagtaacagtaagtagt

SEQ ID NO: 48080 - RNA, 432 nt, synthetic construct
  misc_feature 1..432: note = derived and/or modified sequence opt6 from anti-HIV_cap256-048-024537_VR-Chain
  source 1..432: mol_type = other RNA
caagtacaattagtagaaagtggaggagcagtagtacaaccaggaagaagtttaagattaagttgtgtagcaagcggatttacattttcaagttatgcaatgcactgggtaagacaagcaccaggaaaaggactagattgggtagcattaatatcatatgatggatcaaataaatattttgcagatagtgtaaaaggaagatttgcaataagtagagacaatagtaaaaatacattatatttacaaatgaatagtttaagaccagaagatacagcagtatattactgtgcaaaagatttaggaggaggagaatgtgaaacatgggcaagtgactattatgatttcggaaaagattatccatgtttagacccaagagatgtagtaggaacatttgatatatgggtacaaggaacattagtaacagtaagttca

SEQ ID NO: 48081 - RNA, 432 nt, synthetic construct
  misc_feature 1..432: note = derived and/or modified sequence opt6 from anti-HIV_cap256-048-021781_VR-Chain
  source 1..432: mol_type = other RNA
caagtacatctagtagaaagtggaggaggattagtaaaaccaggaggaagtttaagattaagttgtgaagcaagtggatttagttttagtaattatgcaatggattgggtaagacaagcaccaggaaaaggattagaatgggtagcatttgtaagtagtgatggaagtaataaaaattatgcagatagtgtaaaaggaagatttacaataagcagggataatagtaaaaatacagtatatttacaaatgaatagtttaagagtagaagatacagcagtatattattgtgcaaaagatttaggagcaaataaagatgatgaatgggcaacagattattatgatttaagtgtagcatatccagtaccagatccaagagcagtagtaggagcatttgatgtatggggacaaggaacaatggtaacagtaagtagt

SEQ ID NO: 48082 - RNA, 432 nt, synthetic construct
  misc_feature 1..432: note = derived and/or modified sequence opt6 from anti-HIV_cap256-048-021758_VR-Chain
  source 1..432: mol_type = other RNA
caagtacaattagtagaaagtggaggaggagtagtacaaccaggaagaagtttaagattaagttgtgcagcaagtggatttacattttcaagatatggaatgcactgggtcagacaagcaccaggaaaaggattagagtgggtagcagtaatatcatatgatggatcaaaagaatattatgcagatagtgtaaaaggaagatttacaataagtagagataatagtaaagatacattatatttacaaatgtcaagtttaagagtagaagatacagcagtatattattgtgcaaaagatgtgggagcaaataaagatgatgaatgggcaacagattattatgatctatcaatagcatatccagtaccagatccaagagcagtagtaggagcatttgatatatggggacaaggaacaatggtaacagtaagttca

SEQ ID NO: 48083 - RNA, 432 nt, synthetic construct
  misc_feature 1..432: note = derived and/or modified sequence opt6 from anti-HIV_cap256-048-020988_VR-Chain
  source 1..432: mol_type = other RNA
caagtacaattggtagaaagcggaggaggagtagtacaaccaggaagaagtttaagattaagctgtgaagcaagcgcattcacattctcaagttatggaatgcactgggtaagacaagcaccaggaaaaggactagaatgggtaacattcatatcatactcaggaaataacaaatactatgcagatagcgtaaaaggaagatttacagtaagcagagacaatagtaaaaacacactatatctacaaatgaatagcttaacatcagaagatacagcagtatattactgtgcaaaagacttaggaggaagtaaaacagatgaatggggaacagactattacgaattttggaacgcatatccagtacaagacccaagagtagtagtaggagcattcgatatatggggacatggaacaatggtaacagtaagctca

SEQ ID NO: 48084 - RNA, 435 nt, synthetic construct
  misc_feature 1..435: note = derived and/or modified sequence opt6 from anti-HIV_cap256-048-020663_VR-Chain
  source 1..435: mol_type = other RNA
caagtacaattagtagaaagtggaggaggagtagtacaaccaggaatgagtttaagattaagttgtgcagcaagtggatttacatttagtaattttggaatgcattgggtaagacaagcaccaggaaaaggattagaatgggtagcagtaataagtcatgatggaaataataaatattatccagatagtgtacaaggaagatttacaataagcagagaaaatagtaaaaatacattatatttacaaatgaatagtttaaaaccagaagatacagcagtatatttttgtgcaaaagatttaggaggagaaagtgaagtagaagaatgggcaagtgattattatgattttggaagggatataccaggaccagatccaagaggagtagtaggaacattagatatatggggacatggaacaatggtaacagtaagtagt

SEQ ID NO: 48085 - RNA, 432 nt, synthetic construct
  misc_feature 1..432: note = derived and/or modified sequence opt6 from anti-HIV_cap256-048-020590_VR-Chain
  source 1..432: mol_type = other RNA
caagtacaattagtagaaagtggaggaggagtagtacaaccaggaggagtaccaagactagcatgtgcagcaagtggatttacattttcaagttatgcaatgcattgggtaagacaagcaccaggaaaaggattagaatgggtaacagtaataagctatgatggaagtaataaatattatgcagatagtgtaaaaggaagatttacaataagtagagataatagtaaaaatacattatatttacaaatgaatagtttaagagcagaagatacagcagtatattattgtgcaaaagatttaggaggaacaaaagatgatgaatgggcaacagattattatgatataagtatagcatatccagtacaagatccaagagcagtagcaggagcatttgatatatggggacaaggaacaatggtaacagtaagtagt

SEQ ID NO: 48086 - RNA, 432 nt, synthetic construct
  misc_feature 1..432: note = derived and/or modified sequence opt6 from anti-HIV_cap256-048-019765_VR-Chain
  source 1..432: mol_type = other RNA
caagtacaattagtagaaagcggaggaggagtagtacaaccaggaagaagtttaagactaagctgtgcagcaagtggatttatattcacaaattatgcaatggactgggtaagacaagcaccaggaaaaggactagaatgggtagcagtaatatcaagtgatggatcaaataaaaactatgcagatagcgtaaaaggaagatttacaataagcagagacaatagcaaaaacacagtatcactacaaatgaatagcttaagagcagaagatacagcagtatattactgtgcaaaagacttaggagatagtaaaaaagatgaatgggcaacagactattacgatctatcaatagcatatccagtaccagacccaagagcagtagtaggagcattcgatatatggggacaaggaacaatggtgacagtaagctca

SEQ ID NO: 48087 - RNA, 432 nt, synthetic construct
  misc_feature 1..432: note = derived and/or modified sequence opt6 from anti-HIV_cap256-048-019254_VR-Chain
  source 1..432: mol_type = other RNA
caagtacaattagtagaaagtggaggaggagtagtacaaccaggaagaagtctaagattaagctgtgcagcaagcggattcacaagctcaacatatgcaatgcactgggtaagacaagcaccaggaaaaggactagaatgggtagcattaatatcatatgatggaacagacaaatactatgcagatagcgtaaaaggaagatttacaataagcagagacaatagcaaaaacacactatatctacaaatgaatagcttaagagtagaagatacagcagtatatcactgtgcaaaagacttaggaggaaataaaccagatgaatgggcaacagactattacgatctaagtatagcatacccagtacaagatccaagagcagtagtaggagtattcgatatatggggacaaggaacaataataacagtaagctca

SEQ ID NO: 48088 - RNA, 432 nt, synthetic construct
  misc_feature 1..432: note = derived and/or modified sequence opt6 from anti-HIV_cap256-048-018073_VR-Chain
  source 1..432: mol_type = other RNA
caagtacaattagtagaaagtggaggaggagtagtacaaccaggaagaagtttaagattaagttgtgcagcaagtggatttagcttaagtagctatgcaatggattgggtaagacaagcaccaggaaaaggattagaatgggtagcagtaataagtagtgatggaacaaataaatattatgcagatagtgtaaaaggaagatttacaataacgagagataatagtaaaaatacattatatttacaaatgaatagtttaagagtagaagatacagcattatattattgtgcaaaagatatgggagaaagtgaaaaagaagaatgggcaagcgattattatgattttggaagagatataccaggacaagatccaagaggagaagtaggaagttttgatatatgggggcaaggaacaatggtaacagtaagtagt

SEQ ID NO: 48089 - RNA, 432 nt, synthetic construct
  misc_feature 1..432: note = derived and/or modified sequence opt6 from anti-HIV_cap256-048-016775_VR-Chain
  source 1..432: mol_type = other RNA
gaagtacaattagtagaatttggaggaggattagtacaaccaggaagaagtctaagattaagttgtgcagcaagtgcatttacatttagtcattatggaatacattgggtaagacaagcaccaggaaaaggattagaatgggtagcagtaataagtcatgatggaagtacaaaagattatgcagatagtgtaaaaggaagatttacaataagtagagataatagcaaaaatacaatgtatttacaaatgaatagtttaagagcagaagatacagcagtatattattgtgcaagagatttaggagaaagtgaaacagaagaatgggcaacagattattatgattttagtatagcatatccagtacaaaatccaagaggagtaataggagtattagatatatggggattaggaacaatggtaacagtaagtagt

SEQ ID NO: 48090 - RNA, 432 nt, synthetic construct
  misc_feature 1..432: note = derived and/or modified sequence opt6 from anti-HIV_cap256-048-016069_VR-Chain
  source 1..432: mol_type = other RNA
caagtacaattagtagaaagtggaggaggagtagtacaaccaggaagaagtttaagattaagttgtgcagcaagtggatttacatttagtaaatatgcaatgcattgggtaagacaagcaccaggaaaaggattagaatgggtagcatttgtagcatttgatgaaagtgcaaaattttatgcagatagcgtaaaaggaagatttacaataagtagagataatagtaaaaatacattaagtttacaaatgaatagtttaagagcagaagatacagcagtatattattgtgcaaaagaagtaggagaaaataaagatgatgaatgggcaagtgattattatgatttaagtatagcatatccagtacatgatccaagagcagtagtaggaggatttgatgtatggggacaaggaacaatggtaacagtaagtagt

SEQ ID NO: 48091 - RNA, 432 nt, synthetic construct
  misc_feature 1..432: note = derived and/or modified sequence opt6 from anti-HIV_cap256-048-015867_VR-Chain
  source 1..432: mol_type = other RNA
caagtacaattagtagaaagcggaggaggagtagtacaaccaggaagaagtttaagattaagctgtagcgcatcaggattttcattcacaaattatgcaatggattgggtaagacaagcaccaggaaaaggactagaatgggtagcagtaatatcaagtgatggatcaaataaaaattatgcagatagcgtaaaaggaagatttacaataagcagagacaatagcaaaaacacactatttttacaaatgaatagcttaagaccagaagatacagcagtatatttctgtgcaaaagacctaggagcaaataaagacgatgaatgggcaacagactattacgatttatcaatagcatatccagtacatgacccaagagcagtagtaggaatattcgatttatggggacaaggaacaatggtaacagtaagttca

SEQ ID NO: 48092 - RNA, 432 nt, synthetic construct
  misc_feature 1..432: note = derived and/or modified sequence opt6 from anti-HIV_cap256-048-015673_VR-Chain
  source 1..432: mol_type = other RNA
caagtacacttagtagaaagcggaggaggagtagtacaaccaggaagaagtttaagattaagctgtgcagcaagcggattcacattctcgaactttgcaatgggatgggtaagacaagcaccaggaaaaggactagaatgggtagcatttatatcaagcgatggaacaaacaaaaactatggagatagcgtaaaaggaagatttacaataagtagagacaatagtaaaaacacactatttttacaaatgaatagcttaagagcagaagatacagcactatattactgtgcaaaagacttaggaggatacaaaagcgatgaatgggcaacagactattacgatctatcaatagcatacccaatacaagacccaagagcagtagtaggagcattcgatatatggggacaaggaacaatggtaacagtaagttca

SEQ ID NO: 48093 - RNA, 432 nt, synthetic construct
  misc_feature 1..432: note = derived and/or modified sequence opt6 from anti-HIV_cap256-048-015156_VR-Chain
  source 1..432: mol_type = other RNA
caagtacaattagtagaatcaggaggaggagtagtacaaccaggaagaagtttaagactaagttgtgcagcaagtggatttacatttagcgtatatgcactacattgggtaagacaaacaccaggaaaaggattagaatgggtagcattaataagctatgatggaacaaataaatattatgtagatagtgtaaaaggaagatttacaataagtagagataatagtaaaaatacattatatttacaaatgaatagtttaacagcagaagatacagcagtatattattgtgcaaaagatttaggaggaagtaaaaatgatgaatgggcaacagattattatgatttatcaatagcatatccaatacaagatccaagagcagtagcaggaatatttgatgtatggggaagaggaacaatggtaacagtaagtagt

SEQ ID NO: 48094 - RNA, 432 nt, synthetic construct
  misc_feature 1..432: note = derived and/or modified sequence opt6 from anti-HIV_cap256-048-014521_VR-Chain
  source 1..432: mol_type = other RNA
gaagtacaattagtagaaagcggaggaggattagtacaaccaggaagaagtctaagattaagctgtgcagcaagcggattcatattctcaagctatggaatacactgggtaagacaaggaccaggaaaaggactagaatgggtagcattaatatcaggagatggaaataacaaatactatgcagatagcgtacaaggaagatttagtataagcagagacaatagcaaaaacacactatatttacaaatgaatagcttaagagcagaagatacagcagtatattactgtgcaaaagacttaggagaaagcgataaagaggaatggccatcagactattacgatttcggaagagatttcacaggacaagacccaagagcagtagtaggagtattcgatatatggggacaaggaacaacagtaatagtaagctca

SEQ ID NO: 48095 - RNA, 432 nt, synthetic construct
  misc_feature 1..432: note = derived and/or modified sequence opt6 from anti-HIV_cap256-048-014475_VR-Chain
  source 1..432: mol_type = other RNA
caagtacaattagtagaaagcggaggaggagtagtgcaaccaggaagaagtttaagattaagctgtgcagcaagtggattcacatttaatacatttggaatgcactgggtaagacaagcaccaggaaaaggactcgaatgggtagcagtaataagtcacgatggaaataataaatactatgcagatagcttaaaaggaagatttacaataagtagagaaaatagtaaaaacacactatttctacaaatgaatagcttaagagcagaagatacatcagtatattactgtgcaaaagacttaggacatggagaatgcgaagaatgggcatcagactattacgatttcggaaaagattacccatgcttaacaccaagaggagtcgcaggaacattcgatatatggggacatggaacaacagtaacagtaagctca

SEQ ID NO: 48096 - RNA, 432 nt, synthetic construct
  misc_feature 1..432: note = derived and/or modified sequence opt6 from anti-HIV_cap256-048-013798_VR-Chain
  source 1..432: mol_type = other RNA
caagtacaattagtagaaagtggaggaggagtagtacaaccaggaagaagtttaagattaagttgtgcagcaagtggatttacatttaataattatggaacacattgggtaagacaagcaccaggaaaaggattagaatgggtagcagtaataagtgattcaggatcaaataaatattatgcagatagcgtaaaaggaagatttacaataagtagagataatagtaaaaatacactatatttacaaatgaatagtttaagagcagaagatacagcagtatatttttgtgcaaaagatttaggaggaagagaaacagaagaatgggcatcagattattatgattttggaagagattttccaggacaagatcaaagagcagtagcaggagtatttgatatgtggggacaaggaacaatggtaacagtaagtagt

SEQ ID NO: 48097 - RNA, 432 nt, synthetic construct
  misc_feature 1..432: note = derived and/or modified sequence opt6 from anti-HIV_cap256-048-013271_VR-Chain
  source 1..432: mol_type = other RNA
gaagtacaattagtagaaagcggaggaggagtagtaagaccaggaggaagcttaagattaagttgtgcagcaagtggatttatatttagtagctatggaatacattgggtaagacaagcaccaggaaaaggattagaatgggtagcagtaataagtggagatggaacaaataaatattgtgcagacagcgtaaaaggaagatttacaataagtagagataatagtaaaaatacattatatttacaaataaatagtttaagagtagaagatacagcagtatattattgtgcaaaagatttaggaaaaaataaagatgatgaatgggcgacagattattatgatttaagtatagcatatccagtaccagatccaagagcagtagtaggagtatttgatatatggggacaaggaacagtagtaacagtaagctca

SEQ ID NO: 48098 - RNA, 432 nt, synthetic construct
  misc_feature 1..432: note = derived and/or modified sequence opt6 from anti-HIV_cap256-048-013180_VR-Chain
  source 1..432: mol_type = other RNA
caagtacaattagtagaaagtggaggaggagtagtacaaccaggaagaagtttaagattaagttgtgcagcaagtggatttacatttagtaaaaatggaatgcattgggtaagacaagcaccaggaaaaggattagaatgggtagcatttgtagcatttgatggaagtgataaatattatgcagatagtgtaaaaggaagatttgtaataagtagagataatagcaaaaatacattaagtttacaaatgaatagtttaagagcagaagatacagcagtatattattgtgcaaaagaagtaggagaagataaagatgatgaatgggcaagtgattattatgatttaagcatagcatatccagtacatgatccaagagcagtagtaggaggatttgatatatggggacaaggaacaatggtaacagtaagtagt

SEQ ID NO: 48099 - RNA, 432 nt, synthetic construct
  misc_feature 1..432: note = derived and/or modified sequence opt6 from anti-HIV_cap256-048-012148_VR-Chain
  source 1..432: mol_type = other RNA
caagtacaattagtagaaagtggaggaggagtagtacaaccaggaagaagtttaagattaagttgtgcagcaagtggatttacatttacacattatgcaatggattgggtaagacaagcaccaggaaaagggttagaatgggtagcagtaataagtagcgatggcagtagtaaaaattatgcagatagtgtaagaggaagatttacaataagtagagataatagtaaaaatacattaagtttattaatgaatggattaagaccagaagatacagcagtatattattgtgcaaaagatgtaggagatgtaaaaaatgatgaatgggcaacagattattatgatttaagtatagcatatccagtacaagatccaagagcagtagtaggagcatttgatttttggggacaaggaacgatggtaacagtaagcgca

SEQ ID NO: 48100 - RNA, 432 nt, synthetic construct
  misc_feature 1..432: note = derived and/or modified sequence opt6 from anti-HIV_cap256-048-011870_VR-Chain
  source 1..432: mol_type = other RNA
caagtacaattagtagaaagtggaggaggagtagtacaaccaggaagaagtttaagattaagttgtgcagtaagtggatttacatttagtttttatggaatgcattgggtaagacaagcaccaggaaaaggattagaatgggtagcagtaataagttatgatggaaataataaatattatgtagatagtgtaaaaggaagatttataataagtagggataatagtaaaaatacattatatctacaaatgaatagtttaagagtagaagatacagcagtatattattgtgcaagagatttgggagaaagagaaaatgaagaatgggcaacagattattatgattttagtatagcatatccaatagaaggaccaagaggagtagtgggagtatttgatatatggggaaggggaacaatggtaacagtaagttca

SEQ ID NO: 48101 - RNA, 432 nt, synthetic construct
  misc_feature 1..432: note = derived and/or modified sequence opt6 from anti-HIV_cap256-048-011530_VR-Chain
  source 1..432: mol_type = other RNA
caagtacatttagtagaaagtggaggaggagtagtacaaccaggaagaagtctaagattaagttgtgcagcaagtggatttagttttaggaattatgcaatggattgggtaagacaagcaccaggaaaaggattagaatgggtagcagtaatatcaagcgatggaagtgataaacattatgcagatagtgtaagaggaagatttacaataagtagagataatagtaaaaatacattatatttacaaatgaatagtttaagagtagaagatacagcagtatattattgtgcaaaagatctaggagcaaataaaaatgatgaatgggcaacagattattatgatttttcaatagcatatccagtaccagatccaagagcagtagtaggagcatttgacatatggggacaaggaacaatggtaacagtatcatca

SEQ ID NO: 48102 - RNA, 432 nt, synthetic construct
  misc_feature 1..432: note = derived and/or modified sequence opt6 from anti-HIV_cap256-048-010968_VR-Chain
  source 1..432: mol_type = other RNA
caagtacaattagtagaaagcggaggaggagtagtacaaccaggaagaagtttaagattaagttgtgcagcaagcggattcatattctcaagttatggaatgcactgggtaagacaagcaccaggaaaaggactagaatgggtagcattaatatcaggagatggatcaaataaatactatgcagatagcgtaaaaggaagatttacaataagcagagacaatagcaaaaacacactatatctacaaatgaatagtttaagagcagaagatagtgcattatatttctgtgcaaaagacttaggagaaagtgataaagaagaatggccatcagactattacgatttcggaagagattttacaggacaagtaccaagagcagtagtaggaatattcgatatgtggggacaaggaacaatggtaacagtaagctca

SEQ ID NO: 48103 - RNA, 426 nt, synthetic construct
  misc_feature 1..426: note = derived and/or modified sequence opt6 from anti-HIV_cap256-048-010224_VR-Chain
  source 1..426: mol_type = other RNA
gaagtacatttagtagaaagtggaggagatttagtgcaaccaggaggaagtttaagattaagttgtgtagtgagtgaatttacatttagtagttatggaatgcattgggtaaggcaagcaccaggaaaaggattagaatgggtagcatttataagatatgatggaagtaataaatattatgcagatagtgtaaaaggaagatttacaataagcagagataatagtaaagtatatttagaaatgaatagtttaagagcagaagatacagcagtatattattgtgcaaaagaagtaggagaaaataaagatgatgaatgggcaagtgattattatgatttaagtatagcatatccaatacatgatccaagagcagtagtaggaggatttgatatatggggacaaggaacaatggtaacagtaagtagt

SEQ ID NO: 48104 - RNA, 432 nt, synthetic construct
  misc_feature 1..432: note = derived and/or modified sequence opt6 from anti-HIV_cap256-048-009749_VR-Chain
  source 1..432: mol_type = other RNA
caagtacaattagtagaaagcggaggaggagtagtacaaccaggaagaagtttaagattaagctgtggagcaagcggattcacattctcaagttatgcaatgcactgggtaagacaagcaccaggaagaggactagaatgggtagcatttacatcaagtgatggatcgaacaaaaactatggagatagcgtaaaaggaagatttacaataagtagagacaatagcaaaaacacactatttctacaaatgaatagcttaagagcagaagatacagcactatattactgtgcaaaagacgtaggagaatacaaaagcgatgaatgggcaacagactattacgatctatcaatagcatacccaatacaagacccaagagcaatggtaggagcattcgatatatggggacaaggaacaatggtaacagtaagctca

SEQ ID NO: 48105 - RNA, 432 nt, synthetic construct
  misc_feature 1..432: note = derived and/or modified sequence opt6 from anti-HIV_cap256-048-009623_VR-Chain
  source 1..432: mol_type = other RNA
caagtacaattagtagaaagcggaggaggagtagtacaaccaggaagaagtttaagattaagttgtgcagcaagtggatttagttttagcaaatacggaatgcattgggtaagacaagcaccaggaaaaggattagaatgggtagcatttgtagcatttgatgaaggagataaatattatgtagacagtgtaaaaggaagatttacaataagtagagataatagtaaaaatacactatcattacaaatgaatagtttaagagcagaagacacagcagtatattattgtgcaaaagaagtaggagaaaataaagatgatgaatgggcaagtgattattatgatttaagcatagcatatccaatacatgatccaagggcagtagtaggaggatttgatatatggggacaaggaacaatggtaacagtaagtagt

SEQ ID NO: 48106 - RNA, 432 nt, synthetic construct
  misc_feature 1..432: note = derived and/or modified sequence opt6 from anti-HIV_cap256-048-008234_VR-Chain
  source 1..432: mol_type = other RNA
caagtacaattagtagaaagtggaggaggagtagtacaaccaggaagaagtttaagattaagctgtgcagcaagtggatttacatttacaaattatgcaatggactgggtaagacaagcaccaggaaaaggattagaatgggtagcagtaataagtagcgatggaagtaataaaaattatgcagatagtgtaaaaggaagatttacaataagtagagataatagtaaaaatacagtatatttacaaatgagtagcttaagaccagaagatacagcagtatattattgtgcaaaagatgtaggagatacaaaaagtgatgaatgggcaacagattattatgatttaagtatagcatatccagtacaagatccaagagcagtagtaggagcatttgatatatggggacaaggaacaatggtaacagtaagtagt

SEQ ID NO: 48107 - RNA, 432 nt, synthetic construct
  misc_feature 1..432: note = derived and/or modified sequence opt6 from anti-HIV_cap256-048-008149_VR-Chain
  source 1..432: mol_type = other RNA
caagtacaattagtagaaagtggaggaggagtagtacaaccaggaagaagtttaagattaagttgtgcagcatcaggatttacatttagtgtatatacaatgcattgggtaagacaagcaccaggaaaaggattagaatgggtagcagtaataagttatgatggaagaaataaatattatgcagatagtgtaaaaggaagatttacaataagtagagataatagcaaaaatacagtatatttacaaatgaatagtttaagagtagaagatacagcagtatattattgtgcaaaagatttaggagcaaataaagatgatgaatgggcaacagattattatgatttaagtgtagcatatccagtaccagatccaagagcagtagtaggagcatttgatgtatggggacaaggaacaatggtaacagtaagtagt

SEQ ID NO: 48108 - RNA, 432 nt, synthetic construct
  misc_feature 1..432: note = derived and/or modified sequence opt6 from anti-HIV_cap256-048-007301_VR-Chain
  source 1..432: mol_type = other RNA
caagtacaattagtagaaagtggaggaggagtagtacaaccaggaagaagtttaagattaagttgtgcagcaagtggatttagtttcaattattatgcaatggattgggtaagacaagcaccaggaaaaggattagaatgggtagcagtgataagtagtgatggaagaaataaaaattatgcagatagcgtaaaaggaagatttacaataagtagagataatagtaaaaatacattatatttacaaatgaatagtttaagtgtagaagatacagcagtatattattgtgcaaaagatttagggaaaaataaagatgatgaatgggcaacagattattatgatataagtatagcgtatccagtaccagatccaagagcagtagtaggagtatttgatatatggggacaaggaacagtagtaacagtaagtagc

SEQ ID NO: 48109 - RNA, 432 nt, synthetic construct
  misc_feature 1..432: note = derived and/or modified sequence opt6 from anti-HIV_cap256-048-007174_VR-Chain
  source 1..432: mol_type = other RNA
caagtacaattagtagaaagtggaggaggagtagtacaaccaggaagaagtttaagactaagctgtgcagcaagtggatttacatttaatagttatggaatggcatgggtaagacaagcaccaggaaaaggattagaatgggtagcattaataagttatgatggaagtaataaatattatgcagatagcgtaagaggaagatttacaataagtagagataatagtaaagatacattatatttacaaatggatggattaagaccagaagatacagcattatattattgtgcaaaagatttaggagaaagtgaatgtgaagaatgggcaagtgattattatgattttggaagagattatccatgtttagcaccaagaggagtgccaggaacatttgatatatggggacaaggaacaatggtaacagtaagtagt

SEQ ID NO: 48110 - RNA, 432 nt, synthetic construct
  misc_feature 1..432: note = derived and/or modified sequence opt6 from anti-HIV_cap256-048-007079_VR-Chain
  source 1..432: mol_type = other RNA
caagtacaattagcagaaagcggaggaggagtagtacaaccaggaagaagtttaagattaagctgtgcagcaagtggatttacatttagtatatatggaatgcattgggtaagacaagcaccaggaaaaggattagaatgggtagcatttatattaagtgatggaacagataaatatagtgcagatagcgtaaaaggaagatttacaataagtagagataatagtaaaaatacactatatttacaaatgaatagtttaagagcagaagatacagcagtatattattgtgcaaaagatttaggaaaagcaaaagatgatgaatgggcaacagattattatgattttagtatagcatatccagtacatgatccaagaggagtagcaggaatatttgatatatggggacaaggaacaatggtaacagtaagtagt

SEQ ID NO: 48111 - RNA, 432 nt, synthetic construct
  misc_feature 1..432: note = derived and/or modified sequence opt6 from anti-HIV_cap256-048-007033_VR-Chain
  source 1..432: mol_type = other RNA
caagtacaattagtagaaagtggaggaggagtagtacaaccaggaagaagtttaagattaagttgtgcagcaagtggatttacatttagtaattttggatttcattgggtaagacaagcaccaggaaaaggattagaatgggtagcagcaataagttttgcaggaaataataaatattatgcagatagtgtaaaaggaagatttacaataagtagagaaaatagtaaaaatatattatatttacaaatgaatagtttaagaggagaagatacagcagtatattattgtgcaaaagatttaagagaatttgaatgtgaagaatgggcaagtgattattatgattttggaagagattatccatgtcaagatccaagaggagtagtaggaacatttgatgtatggggacatggaagtttagtaacagtaagtagt

SEQ ID NO: 48112 - RNA, 432 nt, synthetic construct
  misc_feature 1..432: note = derived and/or modified sequence opt6 from anti-HIV_cap256-048-006128_VR-Chain
  source 1..432: mol_type = other RNA
caagtacaattagtagaaagcggaggaggagtagtacaaccaggaagatcattaagattaagctgtgcagcaagcggatttacatttagcacatatgcaatgcactgggtaagacaagcaccaggaaaaggactagaatgggtagcattaatatcatatgatggaacagataaatattatgcagatagtgtaaaaggaagatttacaataagcagagacaatagtaaaaatacattatatttacaaatgaatagtttaagagtagaagatacagcagtatatcactgtgcaaaagatttaggaggaagtaaaagtgatgaatgggcaacagactattatgattggtcaatagcatatccagtacatgacccaagagcagtagtgggagtatttgatatatggggacaaggaacattagtaacagtaagctca

SEQ ID NO: 48113 - RNA, 432 nt, synthetic construct
  misc_feature 1..432: note = derived and/or modified sequence opt6 from anti-HIV_cap256-048-005999_VR-Chain
  source 1..432: mol_type = other RNA
caagtacaattagtagaaagtggaggaggagtagtacaaccaggaagaagtttaagattaagttgtgcagcaagtggatttacatttacacattttgcaatggattgggtaagacaagcaccaggaaaaggactagaatgggtagcagtaattagtagtgatggatcaagtaaaaattatgcagatagcgtaaaaggaagatttacaataagtagagataatagtaaaaatacagtaagtttacaaatgaatagtttaagaccagaagatacagcagtatattattgtgcaaaagatttaggagcaaataaagatgatgaatgggcaacagattattatgatttaagtatagcatatccagtaccagatccaagagcagtagtaggagcatttgatatatggggacaaggaacaatggtaacagtaagtagt

SEQ ID NO: 48114 - RNA, 432 nt, synthetic construct
  misc_feature 1..432: note = derived and/or modified sequence opt6 from anti-HIV_cap256-048-005394_VR-Chain
  source 1..432: mol_type = other RNA
caagtacaattagtagaaagcggaggaggagtagtacaaccaggaagaagtttaagattaagctgtgcagcaagccaattcacattctcaagttatggaatgcactgggtaagacaagcaccaggaaaaggattagaatgggtagcagcaatatcattcgcaggaacaaacaaatactatgcagatagcgtgaaaggaagattcacaataagtagagacaatagcaaaaacgcactatatttacaaatgaatagcttaagagcagaagatacagcactatattactgtgcaaaagacttaagagaatttgaatgcgaagaatgggcatcagactattacgatttcggaagagattacccatgccaagacccaagaggagtagtaggaacattcgatatatggggacaaggaacaatggtaacagtaagctca

SEQ ID NO: 48115 - RNA, 432 nt, synthetic construct
  misc_feature 1..432: note = derived and/or modified sequence opt6 from anti-HIV_cap256-048-004226_VR-Chain
  source 1..432: mol_type = other RNA
caagtacaattagtagaaagtggaggaggagtagtacaaccaggaagaagtttaagattaagttgtgcagcaagtggatttacatttaataaacatggaatgcattgggtaagacaagcaccaggaaaaggattagaatgggtagcatttgtagcatttgatggaagtgataaatattatgcagatagtgtaaaaggaagatttacaataagtagagataatagcaaaaatacattaagtctacaaatgaataatttgagagcagaagatacagcagtatattattgtgcaaaagaagtaggagataataaagatgatgaatgggcaagtgattattatgatttaagtatagcatatccagtacaagatccaagagcagtagtaggaggatatgatatatggggacaaggaacaatggtaacagtaagcagt

SEQ ID NO: 48116 - RNA, 432 nt, synthetic construct
  misc_feature 1..432: note = derived and/or modified sequence opt6 from anti-HIV_cap256-048-004097_VR-Chain
  source 1..432: mol_type = other RNA
caagtacaattagtagaaagtggaggaggagtagtacaaccaggaagaagtttaagattaagttgtgcagcaagtggatttacatttagtgcatatacagtacattgggtaagacaagcaccaggaagaggattagaatgggtaagtgtaatatcatatgatgatagaaataaatattatgcacatagtgtaaaaggaagatttacaataagtagagataatagtaaaaatacattatatttacaaatgaatagtttaagaagagaagatacagcagtatattattgtgcaaaagatttaggagcaaataaagatgatgaatgggcaacagattattatgatttaagtatagcatatccagtaccagatccaagagcagtagtaggagcatttgatatatggggacaaggaacaatggtaacagtaagttca

SEQ ID NO: 48117 - RNA, 432 nt, synthetic construct
  misc_feature 1..432: note = derived and/or modified sequence opt6 from anti-HIV_cap256-048-003289_VR-Chain
  source 1..432: mol_type = other RNA
caagtacaattagtagaaagtggaggaggagtagtacaaccaggaagaagtctaagattaagttgtgcagcaagtggatttacatttagtaaatatggaatgcattgggtaagacaagcaccaggaaaaggattagaatgggtagcatttgtagcatttgatggatcaagtaaaaattatgcagatagtgtaaaaggaagatttacaataagtagagataatagtaaaaatacagtatcattacaaatgaatagtttaagaccagaagatacagcagtatattattgtgcaaaagatttaggagcaaataaagatgatgaatgggcaacagattattatgatttatcaatagcatatccagtaccagatccaagagcagtagtaggagcatttgatatatggggacaaggaacaatggtaacagtaagtagt

SEQ ID NO: 48118 - RNA, 432 nt, synthetic construct
  misc_feature 1..432: note = derived and/or modified sequence opt6 from anti-HIV_cap256-048-002601_VR-Chain
  source 1..432: mol_type = other RNA
caagtacaattagtagaaagcggaggaggagtagtacaaccaggaagaagtttaagattaagctgtgcagcaagcggattttcattcaataattatgcaatggactgggtaagacaagcaccaggaaaaggactagaatgggtagcagtaatatcaagtgatggaagaaataaaaattatgcagaaagcgtaaaaggaagatttacaataagcagagacaatagcaaaaacacagtatatttacaaatgaatagcttaagagcagaagatacagcagtatattattgtgcaaaagacgtaggagatacaaaaaaagatgaatgggcaacagactattacgatttaagtatagcatatccagtacaagacccacaagcagtagtaggagcattcgatatatggggacaaggaacaatggtaacagtaagttca

SEQ ID NO: 48119 - RNA, 432 nt, synthetic construct
  misc_feature 1..432: note = derived and/or modified sequence opt6 from anti-HIV_cap256-048-002129_VR-Chain
  source 1..432: mol_type = other RNA
caagtacaattagtggaaagtggaggaggagtagtacaaccaggaagaagtttaagattaagttgtgcagcaagtggatttacatttagtacatatgcaatgcattgggtaagacaagcaccaggaaaaggattagaatgggtagcattaataagttatgatggaacagataaatattatgcagatagtgtaaaaggaagatttataataagtagagataatagtagaagtacattatatttacaaatgaatagtttaagattagaagatacagcagtatatcattgtgcaaaagatttaggaggaagtaaaagcgatgaatgggcaacagattattatgatttaagtgtagcatatccagtacaagatccaagagcagtagtaggagtatttgatatatggggacaaggaacaatggtaacagtaagtagt

SEQ ID NO: 48120 - RNA, 432 nt, synthetic construct
  misc_feature 1..432: note = derived and/or modified sequence opt6 from anti-HIV_cap256-048-001875_VR-Chain
  source 1..432: mol_type = other RNA
caagtacaattagtagaaagtggaggaggagtagtacaaccaggaggaagtttaagattaagttgtgcaacaagcggattaacatttagtaattatggaatgcattgggtaagacaagcaccaggaagaggactagaatgggtagcatttacaagatatgatggaacatataattattatgcagatagtgtaaaaggaagatttacaataagtagggataatagtaaaggaacattatatctacaaatggatggattaagaccagaagatacagcattatattattgtgcaaaagatttaggagaaagagaatgtgaagaatgggcaagtgattattatgattttggaagagattttccatgtcaagatccaagaggagtagtaggaacatttgatatatggggacaaggaacaatggtaacagtaagcagt

SEQ ID NO: 48121 - RNA, 432 nt, synthetic construct
  misc_feature 1..432: note = derived and/or modified sequence opt6 from anti-HIV_cap256-048-001302_VR-Chain
  source 1..432: mol_type = other RNA
caagtacaattagtagaaagtggaggaggagtagtacaaccaggaagaagtttaagattaagctgtgcagcaagtggatttacatttagttatagtggaatgcattgggtaagacaagcaccaggaaaaggaatggaatgggtagcagtaataagttatgatggaagtaataaatattatgcagatagtgtaaaaggaagatttacaataagtagagataatagcaaaaatacagtatatttacaaatgaatagcttaagaggagtagatacagcagtatattattgtgcaaaagatttaggaggaggagaagtagaagaatgggcaacagattattatgattggtcaatagcatatccagtagaacatccaagagcagtagtaggagtatttgatatatggggacaaggaacaaaagtaacagtaagtagt

SEQ ID NO: 48122 - RNA, 432 nt, synthetic construct
  misc_feature 1..432: note = derived and/or modified sequence opt6 from anti-HIV_cap256-048-001203_VR-Chain
  source 1..432: mol_type = other RNA
caagtacaattagtagaaagcggaggaggagtagtacaaccaggaagaagtttaagattaagttgtgcagcaagtggatttacattctcaagttatgcaatgcattgggtaagacaagcaccaggaaaaggactagaatgggtagcaataatatcatatgatggaacaataaaatattatgcagatagcgtaaaaggaagatttacaataagtagagacaatagtaaaaatacagtatcattacaaatgaatagtttaagaccagaagatacagcagtatattactgtgcaaaagatgtaggagcaaataaagatgatgaatgggcaacagactattatgatttatcaatagcatatccagtaccggatccaagagcagtagtaggagcatttgatatatggggacaaggaacaatggtaacagtaagttca

SEQ ID NO: 48123 - RNA, 432 nt, synthetic construct
  misc_feature 1..432: note = derived and/or modified sequence opt6 from anti-HIV_cap256-048-000383_VR-Chain
  source 1..432: mol_type = other RNA
caagtacaattagtagaaagcggaggaggagtagtacaaccaggaagaagtttaagattaagttgtacagcatcaggatttacatttaatcattatgcaatggattgggtaagacaagcaccaggaaaaggattagaatgggtagcagtaataagtagtgatggaagtgataaaacatatgcagatagtgtaaaaggaagatttacaataagtagagacaatagtaaaaatacagtatatttacaaatgaatagtttaagagcagaagatacagcagtatattattgtgcaaaagatgtaggaggaagtaaagatgatgaatgggcaacagattattatgatctaagtatagcatatccagtacctgatccaagagcagtagtaggagcatttgatttttggggaccaggaacaatggtaacagtaagtagt

SEQ ID NO: 48124 - RNA, 432 nt, synthetic construct
  misc_feature 1..432: note = derived and/or modified sequence opt6 from anti-HIV_cap256-038-261791_VR-Chain
  source 1..432: mol_type = other RNA
caagtacaattagtagaatttggaggaggagtagtacaaccgggaggaagtttaagattaagctgtgcagcatttggatttacaataagtagttatggaatgcattgggtaagacaagcaccaggaaaaggactacaatgggtagcatttataagatatgatgaaagtagtaaattttatgcagatagtgtaaaaggaagatttacaataagtagagataatagcgaaaatacattatatttacaaatgaatagtttaagagcagaagatacagcagtatattattgtgcaaaagatttaggagaaagtgaaaatgaagaatgggcaacagattattatgattttagtatagcatatccaggacaagatccaagaggagtagtaggaatatttgatatatggggacaaggaacaatggtaacagtaagtagt

SEQ ID NO: 48125 - RNA, 432 nt, synthetic construct
  misc_feature 1..432: note = derived and/or modified sequence opt6 from anti-HIV_cap256-038-241540_VR-Chain
  source 1..432: mol_type = other RNA
caagtacaattagtagaaagtggaggaggagtagtacaaccaggaagaagtttaagattaagttgtgcagcaagtggatttacatttagtaattcagcaatgcattgggtaagacaagcaccaggaaaaggattagaatgggtagcattaataagttatgtaggagggaatatatattatgcagatagtgtaaaaggaagatttacagtaagcagagataatagtaaaaaaacattatatttacaaatgaatagtttaagagtagaagatacagcagtatattattgtgtaaaagatgtaggagaaagtgaaaatgaagaatgggcaagtgattattatgattttggaagagattatccaggacaagatacaagagcagtagtaggagcatttgatatatgggggcaaggaacaatggtgacagtaagttca

SEQ ID NO: 48126 - RNA, 432 nt, synthetic construct
  misc_feature 1..432: note = derived and/or modified sequence opt6 from anti-HIV_cap256-038-235677_VR-Chain
  source 1..432: mol_type = other RNA
ttagtacaattagtagaaagtggaggaggagtagtacaaccaggaggaagtttaagattaagctgtgcagcaagtggatttagatttagtagctatggaatgcattgggtaagacaagcaccaggaaaaggattagaatgggtggcatttataagatatgatggaagttttaaagattatgcagatagtgtaagaggaagatttacaataagtagagaaaatagtaaaaatacattatatttacaaatgaatagtttaagaacagatgatacagcagtatattattgtgcaaaagatttaggagaaagtgaaacagaagaatggccaagtgattattatgattttggaagagattatccaggacaagatccaagaggagtagtaggaacatttgatatatggggacatggaacaatggtaacagtaagttca

SEQ ID NO: 48127 - RNA, 435 nt, synthetic construct
  misc_feature 1..435: note = derived and/or modified sequence opt6 from anti-HIV_cap256-038-234314_VR-Chain
  source 1..435: mol_type = other RNA
gaagtacaattattagaaagtggaggaggattagtacaaccaggaggaagtttaagattaagttgtgcagcaagtggatttacatttagcaggtatgcaatgagttgggtaagacaagcaccaggaaaaggattagaatgggtagcagtaatatcatatgatggatcaaataaatattatgcagatagtgtaaaaggaagatttacaataagtagagataatagcaaaaatacattatatttacaaatgaatagtctaagagcagtagatacagcagtatattattgtgcaaaagatttaggagaaggagaaaatgaagaatgggcaacagattattatgattttagttattggttaccatgtccaaaatatcatggagcatggttagaattattatatatatggggacaaggaacaatggtaacagtaagtagt

SEQ ID NO: 48128 - RNA, 432 nt, synthetic construct
  misc_feature 1..432: note = derived and/or modified sequence opt6 from anti-HIV_cap256-038-234273_VR-Chain
  source 1..432: mol_type = other RNA
gaagtacaattagtagaaagtggaggaggactaatacaaccaggaggaagtttaagattaagctgtgcagcaagtggattcacagtttcaacaaatttcatgagttgggtaagacaagcaccaggaaaaggactagaatgggtagcagtaatatcatacgatggaaataacaaatactatgcagatagcgtaaaaggaagatttacaataagcagagaaaatagcaaaaacacactatatctacaaatgaatagcttaagaacagacgatacagcagtatattactgtgcaaaagacttaggagaaagcgaaacagaagaatggccatcagactattacgatttcggaagagattacccaggacaagacccaagaggagtagtaggaacattcgatatatggggacatggaacaatggtaacagtaagctca

SEQ ID NO: 48129 - RNA, 432 nt, synthetic construct
  misc_feature 1..432: note = derived and/or modified sequence opt6 from anti-HIV_cap256-038-223164_VR-Chain
  source 1..432: mol_type = other RNA
gaagtacaattagtagaaagtggaggaggattagtaagaccaggaggaagtttaagattgagctgtgcagcaagtggattttcattaggaagctattggatgacatgggtaagacaagcaccaggaaaaggactagaatgggtagcagtaataagttatgatggaagtaataaatattatgcagatagtgtaaaaggaagatttacaataagcagagataatagtaaaaatacattatatttacaaatgaatagtttaagagcagaagatacagcattatattattgtgcaaaagatttaggagaaagtgaaaatgaagaatgggcatcagattattatgattttggaagagattatccaggacaagacccaagaggagtagtaggaacatttgatatatggggacaaggaacaatggtaacagtaagtagt

SEQ ID NO: 48130 - RNA, 432 nt, synthetic construct
  misc_feature 1..432: note = derived and/or modified sequence opt6 from anti-HIV_cap256-038-220289_VR-Chain
  source 1..432: mol_type = other RNA
gaagtacaattagtagaaagcggaggaggattagtacaaccaggaggaagcctaagactaagctgtacagcaagtggattcacattctcaagctatgaaatgaactgggtaagacaagcaccaggaaaaggaccagaatgggtggcagtaataagttacgatggaaataacaaatactatgcagatagcgtaaaaggaagatttacaataagcagagaaaatagcaaaaacacactatatctacaaatgaatagtttaagaacagacgatacagcagtatattactgtgcaaaagacttaggagaaagcgaaacagaagaatggccatcagactattacgatttcggaagagattacccaggacaagacccaagaggagtagtaggaacattcgatatatggggacatggaacaatggtaacagtaagctca

SEQ ID NO: 48131 - RNA, 432 nt, synthetic construct
  misc_feature 1..432: note = derived and/or modified sequence opt6 from anti-HIV_cap256-038-220020_VR-Chain
  source 1..432: mol_type = other RNA
caagtacaattagtagaaagcggaggaggagtagtacaaccaggaagaagtttaagattaagttgtgcagcaagtggatttacatttagtagaaatgcaatgcattgggtaagacaagcaccaggaaaaggattagaatgggtagcattaatatcatatgatggaagtaataaatattatgtagatagtgtaaaaggaagatttacaataagtagagataatagtaaaaatacactatatttacaaatgaatagtttaagagcagatgatacagcagtatattattgtgcaaaagatttaggagaaagtgaaacagaagaatggggaacagattattatgattttagtacaggatatccagtacaagatccaagaggagtagtaggagcatttgatatatggggacaaggaacaatggtaagtgtaagtagt

SEQ ID NO: 48132 - RNA, 432 nt, synthetic construct
  misc_feature 1..432: note = derived and/or modified sequence opt6 from anti-HIV_cap256-038-216853_VR-Chain
  source 1..432: mol_type = other RNA
caagtacaattagtagaaagtggaggaggagtagtacaaccaggaagaagtttaagattaagctgtgcagcaagcgggtttacattttcaagttatgcaatgcattgggtaagacaagcaccaggaaaaggattagaatgggtagcagtaataagttatgatggaagtaataaatattatgcagatagtgtaaaaggaagatttacaataagtagagataatagtaaaaatacattatatgtacaaatgaatagtttaagagcagaagatacagcagtatattattgtgcaagagatctaggagaaagtgaaacagaagaatggccaagtgattattatgattttggaagagattatccaggacaagatccaagaggagtagtaggaacatttgatatatggggacatggaacaatggtaacagtaagtagt

SEQ ID NO: 48133 - RNA, 432 nt, synthetic construct
  misc_feature 1..432: note = derived and/or modified sequence opt6 from anti-HIV_cap256-038-213466_VR-Chain
  source 1..432: mol_type = other RNA
gaagtacaattagtagaaagtggaggaggattagtacaaccaggaagaagtttaagagtaagttgtgcagcaagtggatttacatttgaagattatgcaatgcattgggtaagacaagcaccaggaaaaggattagaatgggtagcagtaataagtgatgatggaaataataaatattatgcagatagtgtaaaaggaagatttacaataagcagagataatagtaaaaatacattatatctacaaatgaatagtttaagagtagaagatacagcagtatattattgtgtaaaagatgtaggagaaagtgaaaatgaagaatgggcaagtgattattatgattttggaagagattatccaggacaagatacaagagcagtagtaggagcatttgatatatggggacaaggaacaatggtaacagtaagtagt

SEQ ID NO: 48134 - RNA, 432 nt, synthetic construct
  misc_feature 1..432: note = derived and/or modified sequence opt6 from anti-HIV_cap256-038-213212_VR-Chain
  source 1..432: mol_type = other RNA
caagtacaattagtagaaagtggaggaggagtagtacaaccaggaggaagtttaagattaagttgtgcagcaagtggatttatatttagtgattatggaatgcattgggtaagacaagcaccaggaaaaggattagaatgggtagcaagtatatggcatgatggatcaaaaaaatattatgcagatagtgtaaaaggaagatttacaataagtagagaaaatagtaaaaatacattatatttacaaatgaatagtttaagagcagaagatacagctgtatatcattgtgcaaaagatttaggagaaagtgaaatagaagaatggacatcagactattatgattttggaagagattatccaggacaagacccaagaggagtatttggaacatttgatatatggggacatggaacaatggtaacagtaagttca

SEQ ID NO: 48135 - RNA, 432 nt, synthetic construct
  misc_feature 1..432: note = derived and/or modified sequence opt6 from anti-HIV_cap256-038-213120_VR-Chain
  source 1..432: mol_type = other RNA
caagtacacttagtagaaagcggaggaggattagtaaaaccaggaggaagcctaagattaagctgtgcagcaagtggattcacattctcagactattacatgatatggataagacaagcaccaggaaaaggactagaatgggtagcagtaatatcaagcgatggatcaaacaaaaactatgcagatagtgtaaaaggaagatttacaataagtagagacaatagcaaaaacacactatatctacaaatgaatagtttaagagcagaagatacagcagtatattactgtgcaaaagacttaggagaaagcgaaaacgaagaatgggcaacagactattacgatttcgcaacaggatacccggtacaagacccaagagcagtagtaggagcattcgatatatggggacaaggaacaatggtaacagtaagccca

SEQ ID NO: 48136 - RNA, 432 nt, synthetic construct
  misc_feature 1..432: note = derived and/or modified sequence opt6 from anti-HIV_cap256-038-212592_VR-Chain
  source 1..432: mol_type = other RNA
ttagtacaattagtagaaagtggaggaggagtagtacaaccaggaaaaagtttaagattaagctgtgcagcaagcggatttacatttagtagttatgcaatgcactggataagacaagcaccaggaaaaggactagaatgggtagcagtaataagtgatgatggaagtataaaaaattatgcagatagtgtaaaaggaagatttacaataagcagagacacaagtaaaaaattaatgtatctacaaatgaatagtttaagtgcaaatgatacagcagtatattattgtgcaaaagatttaggagaaagagaaaatgaagaatgggcaagtgactattatgatttcggaagagattatccaggacaagacccaagaggagtagtaggaagtatagatacatggggacatggaacaatggtaacagtaagttca

SEQ ID NO: 48137 - RNA, 432 nt, synthetic construct
  misc_feature 1..432: note = derived and/or modified sequence opt6 from anti-HIV_cap256-038-211790_VR-Chain
  source 1..432: mol_type = other RNA
gaattacaattagtagaaagcggaggaggattagtgcaaccaggaggaagtttaagactaagctgtgtagtaagcggatttacagtatcaacaaattatataagctgggtaagacaagcaccaggaaaaggactagaatgggtagcagtaataagttatgatggaagcaataaatattatgcagatagcgtaaaaggaagatttacaataagtagagacaatagtaaaaatacattatatttacaaatgaatagtctaagagcagaagatacagcattatattattgtgcaaaagatttaggagaaagtgaaaatgaagaatgggcaagtgactattatgatttcggaagagattatccaggacaagacccgagaggagtagtaggaacatttgatatatggggacaaggaacaatggtaacagtaagttca

SEQ ID NO: 48138 - RNA, 432 nt, synthetic construct
  misc_feature 1..432: note = derived and/or modified sequence opt6 from anti-HIV_cap256-038-209916_VR-Chain
  source 1..432: mol_type = other RNA
caagtacaattagtagaaagcggaggaggagtagtacaaccaggaggaagtttaagattaagctgtgcagcaagtggatttacatttagtagttttggaatgcattgggtaaggcaagcaccaggaaaaggattagaatgggtgagctttataagaaatgatggaggaataaggtatagtgcagatagtgtaagaggaagatttacaataagtagagataatagtaaaaatacattatatttacaaatgaatagtttaagaacagatgatacagcagtatattattgtgcaaaagatttaggagaaagtgaaacagaagaatggccaagtgattattatgattttggaagagattatccaggacaagatccaagaggagtagtaggaacatttgatatatggggacatggaacaatggtaacagtaagtagt

SEQ ID NO: 48139 - RNA, 432 nt, synthetic construct
  misc_feature 1..432: note = derived and/or modified sequence opt6 from anti-HIV_cap256-038-207938_VR-Chain
  source 1..432: mol_type = other RNA
caagtacaattagtagaaagtggaggaggagtagtacatccaggaagaagtttaagattaagttgtgcagcaagtggatttacatttagtagttatggaatgcattgggtaagacaagcaccaggaaaaggattagaatgggtagcagtaataagtcatgatggaagtaataaatattatgcagatagtgtaaaaggaagatttacaataagtagagataatagtaaaaatacattatatttacaaatgaatagtttaagagcagaagatacagcagtatattattgtgcaaaagatttaggagaaagtgaaaatgaagaatgggcaagtgattattatgattttggaagagattatccaggacaagatccaagaggagtagtaggagtatttgatatatggggacaaggaacaatggtaacagtaagtagt

SEQ ID NO: 48140 - RNA, 432 nt, synthetic construct
  misc_feature 1..432: note = derived and/or modified sequence opt6 from anti-HIV_cap256-038-202245_VR-Chain
  source 1..432: mol_type = other RNA
caagtacacttagtagaaagcggaggaggagtagtacaaccaggaagaagtttaagattaagctgtacagtaagcggattcacattcggaagctatgcattacactgggtaagacaagcaccaggaaaaggattagaatggttaagtgtaataagttacgatggaaataacaaatactatgcagatagtgtaaaaggaagatttacaataagcagagaaaatagtaaaaacacattatatctacaaatgaatagtttaagagcagaagatacagcagtatatcactgtgcaaaagacttaggagaaagcgaaaaagaagaatgggcatcagactattacgatttcggaagagattacccaggacaagacccaagaggagtagtaggaacattcgatatatggggacatggaacaatggtaacagtaagctca

SEQ ID NO: 48141 - RNA, 432 nt, synthetic construct
  misc_feature 1..432: note = derived and/or modified sequence opt6 from anti-HIV_cap256-038-197721_VR-Chain
  source 1..432: mol_type = other RNA
caagtacaattagtagaaagtggaggaggagtagtacaaccaggaaaaagtttaagattaagctgtgcaggaagtggatttatatttagtaattatccaatgcattgggtaagacaagcaccaggaaaaggattagaatggatggcagatgtaagttatgatggaagtaataaagattatgcagatagtgtaaaaggaagatttacaataagtagagataatagtaaaaatacattatatttacaaatgaatagtttaagagcagaagatacagcagtatattattgtgtaaaagatgtaggagaaagcgaaaatgaagaatgggcatcggattattatgattttggaagagattatccaggacaagatacaagagcagtagtaggagcatttgatatatggggacaaggaacaatggtaacagtaagtagt

SEQ ID NO: 48142 - RNA, 432 nt, synthetic construct
  misc_feature 1..432: note = derived and/or modified sequence opt6 from anti-HIV_cap256-038-196679_VR-Chain
  source 1..432: mol_type = other RNA
gaagtacaattattagaaagtggaggaggattagtacaaccaggaggaagtttaagattaagttgtgcagcaagtggatttacatttagtagttatgcaatgagttgggtaagacaagcaccaggaaaaggattagaatgggtagcagtaataagttatgatggaggaaataaatattatgcagatagtgtaaaaggaagatttacaataagtagagataatagtaaaaatacattatatttacaaatgaatagtctaagagcagaagatacagcattatattattgtgcaaaagatttaggagaaagtgaaaatgaagaatgggcaagtgattattatgattttggaagagattatccaggacaagatagtagaggagtagtaggaacatttgatgtatggggacaaggaacaatggtaacagtaagtagt

SEQ ID NO: 48143 - RNA, 438 nt, synthetic construct
  misc_feature 1..438: note = derived and/or modified sequence opt6 from anti-HIV_cap256-038-196118_VR-Chain
  source 1..438: mol_type = other RNA
caagtacaattagtagaaagcggaggaggagtagtacaaccaggaggaagtttaagattaagttgtgcagcaagtggatttacatttagtacatatggaatgcattgggtaagacaagcaccaggaaaaggattagaatgggtaacatttataagaaatgatggaacaaataaatattatgcagatagtgtaaaaggaagatttacaataagtagggataatacaaaaaatacattatatttacaaatgtatagtttaagagcagaagatacagcagtatattattgtgcaaaagatttaggagaaagtgaaaatgaagatgaagaatgggcaagtgattattatgatttcggaagagattatccaggacaagacagtagaggagtagtaggaacatttgatatgtggggacaaggaacaatggtaacagtaagtagt

SEQ ID NO: 48144 - RNA, 429 nt, synthetic construct
  misc_feature 1..429: note = derived and/or modified sequence opt6 from anti-HIV_cap256-038-195382_VR-Chain
  source 1..429: mol_type = other RNA
caagtacatttagtagaaagtggaggaggagtagtacaaccaggaagaagtttaagattaagttgtgcagcaagtggatttacatttagcaattatccagtacattgggtaagacaagcaccaggaaaaggattagaatgggtagcagtaataagttttgatggaataaataattatgcaggaagtgtaaaaggaagatttataataagcagggataatagcaaaaatacattatatttacaaatgaatagtttaagagcagaagatacagcagtatattattgtgtaaaagatttaggagaatcagaaaaagaagaatggccaagcgattattatgattttggaagagattatccaggacaagatagtagaggagtagtaggagtatttgatatatggggacaagggacaatggtaacagtatcaagt

SEQ ID NO: 48145 - RNA, 432 nt, synthetic construct
  misc_feature 1..432: note = derived and/or modified sequence opt6 from anti-HIV_cap256-038-180001_VR-Chain
  source 1..432: mol_type = other RNA
gaagtacaattagtagaaagcggaggaggattagtacaaccaggaagaagtttaagattaagctgtacagcaagcggatttacatttggagattatgcaatgagttggtttagacaagcaccaggaaaaggattagaatgggtagcagatataagttatgatggaagtaataaatattatgcagatagtgtaaaaggaagattgacaataagcagagataatagtaaaaatacattatatttacaaatgaatagtttaagagcagaagatacagcggtatattattgtgtaaaagatttaggagaaagtgaaaaagaagaatggccaagtgattattatgattttggaagagattatccaggacaagatagtagaggagtagtaggagtatttgatatatggggacaaggaacaatggtaacagtaagtagt

SEQ ID NO: 48146 - RNA, 432 nt, synthetic construct
  misc_feature 1..432: note = derived and/or modified sequence opt6 from anti-HIV_cap256-038-178021_VR-Chain
  source 1..432: mol_type = other RNA
caagtaaaattagtagaaagtggaggaggagtagtacaaccaggaggaagtttaagattaagctgtgcagcagcaggatttatattttcaaatagtggaatgcattgggtaagacaagcaccagataaaggattagaatgggtagcatttgtaccatatgatggaagtaataaatattatgcagatagtgtaaaaggaagatttacaataagtagagataatagtaaaaatacattaagtttacaaatgaatagtttaagaacagaagatacagcagtatattattgtgcaaaagatttaggagaaagcgaaacagaagaatggccaagtgattattatgattttggaagagattatccaggacaagatccaagaggagtagtaggaacatttgatatatggggacacggaacaatggtaacagtaagtagt

SEQ ID NO: 48147 - RNA, 432 nt, synthetic construct
  misc_feature 1..432: note = derived and/or modified sequence opt6 from anti-HIV_cap256-038-177104_VR-Chain
  source 1..432: mol_type = other RNA
gaagtacaattattagaaagcggaggaggattagtacaaccaggaggaagtttaagattaagttgtgcagcaagtggatttacatttagtagttatgcaatgaattgggtaagacaagcaccaggaaaaggattagaatgggtagcagtaataagttatgatggaggagataaatattatgcagatagtgtaaaaggaagatttacaataagtagagataatagtaaaaatacattatatttacaaatgaatagtttaagagtagaagatacagcagtatattattgtgtaaaagatgtaggagaaagtgaaaatgaagaatgggcgagtgattattatgattttggaagagattatccaggacaagatacaagagcagtagtaggagcatttgatatatggggacaaggaacaatggtaacagtaagtagt

SEQ ID NO: 48148 - RNA, 432 nt, synthetic construct
  misc_feature 1..432: note = derived and/or modified sequence opt6 from anti-HIV_cap256-038-171261_VR-Chain
  source 1..432: mol_type = other RNA
caagtacaattagtagaaagtggaggaggagtagtacaaccaggaagaagtttaagattaagttgtgcagcaagtggatttacatttagtagttatgcaatgtattgggtaagacaagcaccaggaaaaggactagaatgggtagcagtaatatcaagtgatggaagtgataaaaattatgcagatagtgtaaaaggaagatttacaataagtagagataatagcaataatacactatatttacaaatgaatagtttaagagcagaagatacagcagtatattattgtgcaagagatttaggagaaagtgaaaatgaagaatggccaagtgattattatgattttggaagagattatccaggacaagatccaagaggagtaataggaacgtttgatgtatggggacaaggaacaatggtaacagtaagtagt

SEQ ID NO: 48149 - RNA, 432 nt, synthetic construct
  misc_feature 1..432: note = derived and/or modified sequence opt6 from anti-HIV_cap256-038-169090_VR-Chain
  source 1..432: mol_type = other RNA
caagtacaattagtagaaagcggaggaggagtagtacaaccaggaagaagtttaagattaagctgtgcagcaagcagatttacatttaaaacatatacaatgcattgggtaagacaagcaccaggaaaaggattagaatgggtagcattaataagttatgatggaagtaataaatattatgcagatagtgtaaaaggaagattaacaataagtagagacaatagtaaaaatacattatatctacaaatgaatagtctaagagcagaagatacggcagtatattattgtgtaaaagatttaggagaaagtgaaaaagaagaatggccaagtgattattatgattttggaagagattatccaggacaagacagtagaggagtagtaggagtatttgatatatggggacaaggaacaatggtaacagtaagtagt

SEQ ID NO: 48150 - RNA, 432 nt, synthetic construct
  misc_feature 1..432: note = derived and/or modified sequence opt6 from anti-HIV_cap256-038-168705_VR-Chain
  source 1..432: mol_type = other RNA
gaagtacaattagtagaaagtggaggaggattagtaaaaccgggaggaagtttaagattaagctgtgcagcaagcggatttacattcagtagttatagtatgaactgggtaagaagagcaccaggaaaaggactagaatgggtagcattaataagttatgatgaaaataaaaaatattatgcggatagcgtaaaaggaagatttacaataagcagagaaaatagtaaaaatacactatatttacaaatgaatagtttaagagcggaagatacagcagtatattactgtgcaaaagacttaggagaaagagaaaatgaagaatgggcatcagactattatgatttcggaagagattatccaggacaagacccaagaggagtagtaggaagtatagatacatggggacatggaacaatggtaacagtaagtagt

SEQ ID NO: 48151 - RNA, 432 nt, synthetic construct
  misc_feature 1..432: note = derived and/or modified sequence opt6 from anti-HIV_cap256-038-167685_VR-Chain
  source 1..432: mol_type = other RNA
caagtacaattagtagaaagtggaggaggagtagtacaaccaggaagaagtttaagattaagctgtgcagcaagtggaataacattctcaagttatgcaatacactgggtaagacaagcaccaggaaaaggactagaatgggtagcagtaatatcatatgatggatcaaataaatattatgcagatagtgtaaaaggaagatttacaataagtagagacaatagtaaaaacacactatatttacaaatgaatagtttaagagcagaagatacagcagtatattactgtgcaaaagacttaggagaaagtgaaaatgaagaatgggcaacagactattatgatttctcaataggatatccaggacaagacccaagaggagtagtaggagcatttgatatatggggacaaggaacaatggtaacagtaagttta

SEQ ID NO: 48152 - RNA, 432 nt, synthetic construct
  misc_feature 1..432: note = derived and/or modified sequence opt6 from anti-HIV_cap256-038-158775_VR-Chain
  source 1..432: mol_type = other RNA
caagtacaattagtagaaagtggaggaggagtagtacaaccaggaggaagtttaagattaagttgtgcagcaagtggatttacatttagtacatatggaatgcattgggtaagacaagcaccaggaaaaggattagaatgggtagcatttataagagataatggaagtaataaatattatgcagatagtgtaaaaggaagatttacaataagcagagataatagtaaaaatacattatatttacaaatgaatagtttaagagcagaagatacagcattatattattgtgcaaaagatttaggagaaagtgaaaatgaagaatgggcaagtgattattatgattttggaagagattatccaggacaagatagtagaggagtagtaggaacatttgatgtatggggacaaggaacaatggtaacagtaagtagt

SEQ ID NO: 48153 - RNA, 432 nt, synthetic construct
  misc_feature 1..432: note = derived and/or modified sequence opt6 from anti-HIV_cap256-038-157318_VR-Chain
  source 1..432: mol_type = other RNA
catgtacaattagtagaaagtggaggaggagtagtacaaccaggaagaagtttaagattaagttgtgcagcaagtggaataacatttagtacatatgatatgcattgggtaagacaagcaccaggaaaaggattagaatgggtagcagtaataagtaatgatggaagtaataaatattatgcagatagtgtaaaaggaagatttacaataagtagagataatagtaaaaatacattatatctacaaatgaatagcttaagagcagaagatacagcattatattattgtgcaaaagatttaggagaaagtgaaaaagaagaatgggcaagtgattattatgattttggaagagattatccaggacaagatccaagaggagtagtagcaacatttgatatatggggacaaggaacaatggtaacagtaagtagt

SEQ ID NO: 48154 - RNA, 432 nt, synthetic construct
  misc_feature 1..432: note = derived and/or modified sequence opt6 from anti-HIV_cap256-038-153058_VR-Chain
  source 1..432: mol_type = other RNA
caagtacaattagtagaaagcggaggaggagtagtacaaccaggaagaagtttaagattaagctgtgcagcaagtggatttacatttagtacatatgcaatgcattgggtaagacaagcaccaggaaaaggattagaatgggtagcagtaatatcatatgatggaagtcattcatattatgcaggaagtgtaaaaggaagatttacaacaagtagagataatagtaaaaatacattaaatttacaaatgaatagtttaagaccagaagatacagcactatattattgtgcaaaagatttaggagaaagtgaaaatgaagaatgggcaagtgattattatgatttcggaagagattatccaggacaagatagtagaggagtagtaggaacatttgatgtatggggacaaggaacaatggtaacagtaagtagc

SEQ ID NO: 48155 - RNA, 432 nt, synthetic construct
  misc_feature 1..432: note = derived and/or modified sequence opt6 from anti-HIV_cap256-038-150027_VR-Chain
  source 1..432: mol_type = other RNA
ttagtacaattagtagaaagtggaggaggagtagtacaaccaggaggaagtttaagattaagttgtgcagcaagtggatttaggtttagtagttatggaatgcattgggtaagacaagcaccaggaaaaggattagaatgggtagcatttataaggtatgatggaagttttaaagattatgcagatagtgtaagaggaagatttacaataagtagagataatagtaaaaatacagtatatgtacaaatgaatagtttaagagcagaagatacagcagtatattattgtgcaaaagatttaggagaaagtgaaaatgaagaatgggcaacagattattatgattttgcaacaggatatccagtacaagatccaagagcagtagtaggagcatttgatatatggggacaaggaacaatggtaacagtaagtcca

SEQ ID NO: 48156 - RNA, 432 nt, synthetic construct
  misc_feature 1..432: note = derived and/or modified sequence opt6 from anti-HIV_cap256-038-146372_VR-Chain
  source 1..432: mol_type = other RNA
caagtacaattagtagaaagcggaggaggagtagtacaaccaggaagaagtttaagactaagttgtgcagcaagcggatttacattcagtagttttggaatgcactgggtaagacaatcaccaggaaaaggattagaatgggtagcagtaatatcatatgatggaaataacaaatactatgcagatagcgtaaaaggaagatttacaataagcagagaaaatagcaaaaacacactatatttacaaatgaatagcttaagaacagacgatacagcagtatattattgtgcaaaagacttaggagaaagtgaaacagaagaatgggcaacagactattacgatttcgcaacaggatatccagtacaagacccaagagcagtagtaggagcattcgatatatggggacaaggaacaatggtaacagtaagccca

SEQ ID NO: 48157 - RNA, 432 nt, synthetic construct
  misc_feature 1..432: note = derived and/or modified sequence opt6 from anti-HIV_cap256-038-141868_VR-Chain
  source 1..432: mol_type = other RNA
gaattaagattagtagaaagcggaggaaatctagtacaaccaggaggaagtttaacattaagttgtgtagcaagcggattcacattcgatagctatggaatgagctgggtaagacaagcaccaggaaaaggactagaatgggtagcattaataagttacgatgaaaataaaaaatactatgcagatagtgtaaaaggaagatttacaataagtagagaaaatagcaaaaacacactatatctacaaatgaatagcttaagagcagaagatacagcagtatattactgtgcaaaagacttaggagaaagagaaaatgaagaatgggcaagtgactattacgatttcggaagagattatccaggacaagacccaagaggagtagtaggaagtatagatacatggggacatggaacaatggtaacagtaagcagt

SEQ ID NO: 48158 - RNA, 432 nt, synthetic construct
  misc_feature 1..432: note = derived and/or modified sequence opt6 from anti-HIV_cap256-038-141616_VR-Chain
  source 1..432: mol_type = other RNA
gaagtacaattattagaaagtggaggaggattagtacaaccaggaggaagtttaagattaagttgtgcagcaagtggatttacatttagtagttatgcaatgagctgggtaagacaagcgccaggaaaaggattagaatgggtagcagtaataagtaaagatggaagtgataatagttatgtagatagtgtaaaaggaagatttacaataagcagagataatagcaaaaatacattatatttacaaatgaatagtttaagagcagaagatacagcagtatattattgtgcaagagatttaggagaaagtgaaaatgaagaatggccaagtgattattatgattttggaagagattatccaggacaagatccaagaggagtaataggaacatttgatgtatggggacaaggaacaatggtaacagtaagtagt

SEQ ID NO: 48159 - RNA, 432 nt, synthetic construct
  misc_feature 1..432: note = derived and/or modified sequence opt6 from anti-HIV_cap256-038-127989_VR-Chain
  source 1..432: mol_type = other RNA
caagcacaattagtagaaagtggaggaggagtagtacaaccaggaagaagtttaagattaagttgtgcagcaagtggatttacatttagtaattttgcaatgcattgggtaagacaagcaccaggaaaaggactagaatgggtagcagtaatgagtgatgatggaagtaataaatattatgcagatagtgtaaaaggaagatttacaataagtagagataatagcgaaaatacattatatttacaaatgaatagcttaagagcagaagatacggcagtatattattgtgcaaaagatttaggagaaagtgaaacagaagaatgggcaacagattattatgattttggaacaggatatccaggacaagatccaagagcaatgataggaacatttgatatatggggaagaggaacaatggtaacagtaagtagt

SEQ ID NO: 48160 - RNA, 432 nt, synthetic construct
  misc_feature 1..432: note = derived and/or modified sequence opt6 from anti-HIV_cap256-038-118109_VR-Chain
  source 1..432: mol_type = other RNA
caagtacaattagtagaaagtggaggaggagtagtacaaccaggaggaagtttaagattaagctgtacagcaagtggatttacatttagtgcatatgatatgcattggataagacaagcaccaggaaaaggactaggatgggtagcatttataacaaatgaaggaagtagtaaaaattatgtagatagtgtaaaaggaagatttacaataagtagagataatagtaaaaatacattatatttacaaatgaatagtttaagagcagaagatacagcagtatattattgtgcaaaagatttaggagaaagcgaaaatgaagaatgggcaacagattattatgattttagtatagcatatccaggacaagatccaagaggagtagtaggaatatttgatatatggggacaaggaacaatggtaacagtaagtagt

SEQ ID NO: 48161 - RNA, 432 nt, synthetic construct
  misc_feature 1..432: note = derived and/or modified sequence opt6 from anti-HIV_cap256-038-112226_VR-Chain
  source 1..432: mol_type = other RNA
gaagtacaattagtagaaagtggaggaggattagtacaaccaggaggaagcctaagattaagttgtgcagcaagtggatttacatttagtagttattggatgacatgggtaagacaagcaccaggaaaaggattagaatgggtagcagtaataagtgatgatggaaataataaatattatgcagatagtgtaaaaggaagatttacaataagcagagataatagtaaaaatacattatatttacaaatgaatagtttaagggtagaagatacagcagtatattattgtgtaaaagatgtaggagaaagtgaaaatgaagaatgggcaagtgattattatgattttggaagagattatccaggacaagatacaagagcagtagtaggagcatttgatatatggggacaaggaacaatggtaacagtaagcagt

SEQ ID NO: 48162 - RNA, 432 nt, synthetic construct
  misc_feature 1..432: note = derived and/or modified sequence opt6 from anti-HIV_cap256-038-105918_VR-Chain
  source 1..432: mol_type = other RNA
gaagtacaattactagaaagcggaggaggattagtacaaccaggaggaagcctaagattaagctgtgcagcaagcggattcacattcaatatacatccaatgcactgggtaagacaagcaccaggaaaaggactagaatgggtagcagtaatatcatacgatggaaataacaaatactatgcagatagcgtaaaaggaagatttacaataagcagagaaaatagtaaaaacacactatatctacaaatgaatagcttaagaacagacgatacagcagtatattactgtgcaaaagacttaggagaaagcgaaacagaagaatggccatcagactattacgattttggaagagattacccaggacaagacccaagaggagtagtaggaacattcgatatatggggacatggaacaatggtaacagtaagctca

SEQ ID NO: 48163 - RNA, 432 nt, synthetic construct
  misc_feature 1..432: note = derived and/or modified sequence opt6 from anti-HIV_cap256-038-104487_VR-Chain
  source 1..432: mol_type = other RNA
ttagtgcaattagtagaaagtggaggaggagtagtacaaccaggaaaaagtttaagattaagttgtgcagcaagcggattcacatttagtagttatgcaatgcattggataagacaagcaccaggaaaaggattagaatgggtagcagtaataagtgatgatggaagtataaaaaattatgcagatagtgtaaaaggaagatttacaataagtagagataatagtaaaaatacattatatctacaaatgaatagtttaagagcagaagatacagcagtatattattgtgcaaaagatttaggagaaagtgaaaatgaagaatgggcaacagattattatggatttagcataggatatccaggacaagatccaagaggagtagtaggaatatttgatatatgggcacaaggaacaatggtaacagtaagtagt

SEQ ID NO: 48164 - RNA, 432 nt, synthetic construct
  misc_feature 1..432: note = derived and/or modified sequence opt6 from anti-HIV_cap256-038-102308_VR-Chain
  source 1..432: mol_type = other RNA
caagtacaattagtagaaagtggaggaggagtagtacaaccaggaggaagtctaagattaagttgtgcagcactagattttccatttagtagttttggaatgcattgggtaagacaaacaccaggaagaggattagaatgggtagcaataatatggagtgatggaagtaatagatattatgtagatagtgtaaaaggaagatttacaataagcagagataatagtaaaaatacattatatttacaaatgaatagtttaagaccagatgatacagcagtatattattgtgtaaaagatttaggagaaagtgaaaatgaagaatgggcaacagattattatgattttagtgtaggatatccaggacaaggaccaagaggagtagtaggaatatttgatatatggggacaaggaacaatggtaacagtaagtagt

SEQ ID NO: 48165 - RNA, 432 nt, synthetic construct
  misc_feature 1..432: note = derived and/or modified sequence opt6 from anti-HIV_cap256-038-091115_VR-Chain
  source 1..432: mol_type = other RNA
caagtacaattagtagaaagcggaggaggagtagtacaaccaggaagaagtttaagattaagctgtgcagtaagtggattcacattctcaagctatggattacactgggtaagacaagcaccaggaaaaggactagaatgggtagcagtaatatcatacgatggatcaaacaaatactatgcagatagtgtaaaaggaagatttacaataagcagagacaatagcaaaaacacactatatttacaaataaatagcttaagagcagaagatacagcggtatattactgtgcaaaagacttaggagaaagtgaaaatgaagaatgggcaacagactattacgatttctcaataggatacccaggacaagacccaagagcagtagtaggagcattcgatatatggggacaaggaacaatggtaacagtaagttca

SEQ ID NO: 48166 - RNA, 432 nt, synthetic construct
  misc_feature 1..432: note = derived and/or modified sequence opt6 from anti-HIV_cap256-038-090262_VR-Chain
  source 1..432: mol_type = other RNA
caagtacaattagtagaaagtggaggaggagtagtacaagcaggaggaagtttaagattaagctgtgcagcaagcggattcacatttaataattatggaatgcactgggtaagacaagcaccaggaaaaggactagaatgggcagcatttataagatatgatggatcaaataaatattatgcagatagtgtaagagggagatttacaataagtagagacaatagtaaaaatacattatatctacaaatgaatagtttaagagcagaagatacagcagtatattactgtgtaaaagacgtaggagaaagtgaaaatgaagaatgggcatcagactattacgatttcggaagagattatccaggacaagacacgagagcagtagtaggagcatttgatatatggggacaaggaacaatggtaacagtaagttca

SEQ ID NO: 48167 - RNA, 432 nt, synthetic construct
  misc_feature 1..432: note = derived and/or modified sequence opt6 from anti-HIV_cap256-038-083260_VR-Chain
  source 1..432: mol_type = other RNA
caagtacaattagtagaaagtggaggaggattagtaaaaccaggagggagcttaagattaagttgtgcagcaagtggatttacatttagtgattattatatgacatggataagacaagcaccaggaaaaggattagaatgggtagcagtaataagttatgatggaggaaataaatattatgcagatagtgtaaaaggaagatttacaataagcagagataatagtaaaaatacattatatttacaaatgaatagtttaagagcagaagatacagcattatattattgtgcaaaagatttaggagaaagtgaaaatgaagaatgggcaagtgattattatgattttggaagagattatccgggacaagatagtagaggagtagtaggaacatttgatgtatggggacaaggaacaatggtaacagtgagtagt

SEQ ID NO: 48168 - RNA, 432 nt, synthetic construct
  misc_feature 1..432: note = derived and/or modified sequence opt6 from anti-HIV_cap256-038-080981_VR-Chain
  source 1..432: mol_type = other RNA
caagtacaattagtagaaagtggaggaggagtagtacaaccaggaagaagtttaagattaagttgtgcagcaagtggatttacatttagtagttatggaatgcattgggtaagacaagcaccaggaaaaggaatggaatgggtagcagtaataagttatgatggaagtaataaatattatgcagatagtgtaaaaggaagatttacaataagtagagataatagtaaaaatacattatatttacaaatgaatagtttaagagcagtagatacagcagtatattattgtgcaaaagatttaggagaaggagaaaatgaagaatgggcaacagattattatgattttagtataggatatccaggacaagatccaagaggagtagtaggagcatttgatatatggggacaaggaacaatggtaacagtaagttca

SEQ ID NO: 48169 - RNA, 432 nt, synthetic construct
  misc_feature 1..432: note = derived and/or modified sequence opt6 from anti-HIV_cap256-038-080873_VR-Chain
  source 1..432: mol_type = other RNA
ttagtacaattagtagaaagtggaggaggagtagtacaaccgggaggaagtttaagattaagttgtgcagcaagtggatttagatttagtagttatggaatgcattgggtaagacaagcaccaggaaaaggattagaatgggtagcatttataagatatgatggaagttttaaagattatgcagatagcgtaagaggaagatttacaataagtagagataatagtaaaaatacagtatatttacaaatgaatagcttaagggcagaagatacagcagtatattattgtgtaaaagatttaggagaaagtgaaaaagaagaatggccaagtgattattatgattttggaagagattatccaggacaagatagtagaggagtagtaggagtatttgatatatggggacaaggaacaatggtaacagtaagtagt

SEQ ID NO: 48170 - RNA, 432 nt, synthetic construct
  misc_feature 1..432: note = derived and/or modified sequence opt6 from anti-HIV_cap256-038-074413_VR-Chain
  source 1..432: mol_type = other RNA
caagtacaattagtagaaagtggaggaggagtagtacaaccgggaggaagtttaagattaagctgtgcagcaagtggatttacatttagtacatatggaatgcattgggtaagacaaccaccaggaaaaggattagaatgggtagcatttataagatatgatggaagtaatacatattatgcagatagtgtaaaaggaagatttacaataagtagagataatagcaaaaatacattatatttacaaatgaatagcttaagagcagaagatacagcagtatattattgtgcaaaagatttaggagaaagtgaaaatgaagaatgggcatcagattattatgattttggaagagattatccaggacaagatccaagaggagtagtaggagtatttgatatatggggacaaggaacaatggtaacagtaagtagt

SEQ ID NO: 48171 - RNA, 432 nt, synthetic construct
  misc_feature 1..432: note = derived and/or modified sequence opt6 from anti-HIV_cap256-038-073153_VR-Chain
  source 1..432: mol_type = other RNA
caagtacaattagtagaaagtggaggaggagtagtacaaccaggaagaagtttaagattaagttgtgcagcaagtggatttacattttcaagttatggaatgcattgggtaagacaagcaccaggaaaaggactagaatgggtagcattaataagttatgatggaacaaataaatattatgcagatagtgtaaaaggaagatttacaataagtagagataatagtaaaaatacattattcttacaaatgaatagtttaagagcagaagatacggcattatattattgtgcaaaagatttaggagaaagtgaaaatgaagaatgggcaagtgattattatgattttggaagagattatccaggacaagatccaagaggagtagtaggaacatttgatatatggggacaaggaacaatggtaacagtaagttca

SEQ ID NO: 48172 - RNA, 432 nt, synthetic construct
  misc_feature 1..432: note = derived and/or modified sequence opt6 from anti-HIV_cap256-038-064227_VR-Chain
  source 1..432: mol_type = other RNA
gaagtacaagtagtagaaagcggaggaggattagtacaaccaggaggaagtttaagattaagctgtgcagcaagtggatttacatttagtaattattggatgagttgggtaagacaagcaccaggaaaaggattagaatgggtagcagtaatgagtttttcaggatcaggaagttattatgcagatagcgtaaaaggaagatttacaataagtagcgatgatagtatgaatacagtatatttacaaatgaatagtttaagagcagaagatacagcagtatattattgtgcaaaagatttaggagaaagagaaaatgaagaatgggcaagtgattattatgattttggaagagattatccaggacaagatccaagaggagtagtaggaagtatagatacatggggacatggaacaatggtaacagtaagtagt

SEQ ID NO: 48173 - RNA, 432 nt, synthetic construct
  misc_feature 1..432: note = derived and/or modified sequence opt6 from anti-HIV_cap256-038-061640_VR-Chain
  source 1..432: mol_type = other RNA
caagtacaattagtagaaagtggaggaggagtagtacaaccaggaagaagtttaagattaagttgtacagcaagccgatttagttttaataattatgcaatgcattgggtaagacaagcaccaggaaaaggattagaatgggtagcaataataagtaaagatggaagtgataatagttatgtagatagtgtaaaaggaagatttacaataagtagagataatagtaaaaatacattatatttacaaatgaatagtttaagagcagaagatacagcagtatattattgtgcaagagatttaggggaaagtgaaaatgaagaatggccaagtgattattatgattttggaagagattatccaggacaagatccaaggggagtaataggaacatttgatgtatggggacaaggaacaatggtaacagtaagtagt

SEQ ID NO: 48174 - RNA, 414 nt, synthetic construct
  misc_feature 1..414: note = derived and/or modified sequence opt6 from anti-HIV_cap256-038-059482_VR-Chain
  source 1..414: mol_type = other RNA
agaggagtacaatgccaagtacaattagtagaatcaggaggaggagtagtacaaccaggattcacattctcaagctatgtaatgcactgggtaagacaagcaccaggaaaaggactagaatgggtagcagatatatcatacgatggatcaaacaaatactatgcagatagcgtaaaaggaagactaacaataagcagagacaatagcaaaaacacactatatctacaaatgaatagcttaagagcagaagatacagcagtatattactgtgtaaaagacttaggagaaagtgaaaaagaagaatggccatcagactattacgatttcgcaacaggatacccagtacaagacccaagagcagtagtaggagcattcgatatatggggacaaggaacaatggtaacagtaagtcca

SEQ ID NO: 48175 - RNA, 432 nt, synthetic construct
  misc_feature 1..432: note = derived and/or modified sequence opt6 from anti-HIV_cap256-038-054000_VR-Chain
  source 1..432: mol_type = other RNA
gaagtacaattagtagaaagtggaggaagtgtagtaagaccaggaggaagtttgagattaagttgtgcagcaagtggatttacatttgatgatagcggaatgagttgggtaagacaaggaccaggaaaaggattagaatgggtagcagtaataagttatgatggaggaaataaatattatgcagatagtgtaaaaggaagatttacaataagtagagataatagtaaaaatacattatatttacaaatgaatagtttaagagcagaagatacagcattatattattgtgcaaaagatttaggagaaagtgaaaatgaagaatgggcaagtgattattatgattttggaagagattatccgggacaagatagtagaggagtagtaggaacatttgatgtatggggacaaggaacaatggtaacagtaagtagt

SEQ ID NO: 48176 - RNA, 432 nt, synthetic construct
  misc_feature 1..432: note = derived and/or modified sequence opt6 from anti-HIV_cap256-038-050554_VR-Chain
  source 1..432: mol_type = other RNA
gaagtacaattactagaaagcggaggagatctagtacaaagtggaggatcattaagattaagctgtgtagcaagcggattcacattcagcacacatgcaatgacatgggtaagacaagcaccaggaaaaggactagaatgggtagcagtaatatcaagtgatggatcaaataaaaactttgcagatagcgtaaaaggaagatttacaataagtagagacaatagcaaaaatacactatatctacaaatgaatagcttaagaccagaagatacagcagtatattactgtgcaaaagacttaggagaaagtgaaaacgaagaatgggcaacagactattacgatttctcaacaggatacccagtacaagacccaagagcagtagtaggagcattcgatatatggggacaaggaacaatggtaacagtaagttca

SEQ ID NO: 48177 - RNA, 432 nt, synthetic construct
  misc_feature 1..432: note = derived and/or modified sequence opt6 from anti-HIV_cap256-038-044256_VR-Chain
  source 1..432: mol_type = other RNA
caagtacaattagtagaaagtggaggaggagtagtacaaccaggaagaagtttaagattaagttgtgcagcaagtggatttacatttagtagctatgcaatgcattgggtaagacaagcaccaggaaaaggattagaatgggtagcagtaataagttatgatggatcaaacaaatatcatgcaggaagtgtaaaaggaagatttataataagtagagataatagtaaaaatacattatatctacaaatgaatagcttaagagcagaagatacagcattatattattgtgcaaaagatttaggagaaagtgaaaatgaagaatgggcaagtgattattatgattttggaagagattatccaggacaagatccaagaggagtagtaggaacatttgatatatggggacaaggaacgatggtaacagtaagttca

SEQ ID NO: 48178 - RNA, 432 nt, synthetic construct
  misc_feature 1..432: note = derived and/or modified sequence opt6 from anti-HIV_cap256-038-040944_VR-Chain
  source 1..432: mol_type = other RNA
caagtacaattagtagaaagcggaggaggagtagtacaaccaggaagaagtttaagattaagttgtgcagcaagtggatttacatttagtaattatgcaatggattgggtaagacaagcaccaggaaaaggattagaatgggtagcagtaataagttatgatggaagtaacaaatattatgcagatagtgtaaaaggaagatttacaataagtagagataatagtaaaaatacattatatttacaaatgaatagtttaagagcagaagatacagcagtatattattgtgcaaaagatttaggagaaagtgaaaatgaagaatgggcaacagattattatgattttagtacaggatatccaggacaagatccaagagcagtagtaggagcatttgatatatggggacaaggaacaatggtaacagtaagcagt

SEQ ID NO: 48179 - RNA, 432 nt, synthetic construct
  misc_feature 1..432: note = derived and/or modified sequence opt6 from anti-HIV_cap256-038-040090_VR-Chain
  source 1..432: mol_type = other RNA
caagtacaattagtagaaagtggaggaggagtagtacaaccaggaagaagtttaagattaagttgtgcagcaagtggatttagttttagtaattacgcaatggattgggtaagacaagcaccaggaaaaggattagaatgggtagcagtaataagtagtgatggaagtaataaaaattatgcagatagtgtaaaaggaagatttacaataagcagagataatagtaaaaatacattatatttacaaatggatagtttaagagcagatgatacagcagtatattattgtgcaaaagatttaggagaaagtgaaaatgaagaatgggcaacagattattatgattttagtataggatatccagtacaagatccaagaggagtagtaggaatatttgatatatggggacaaggaacaatggtaacagtaagtagt

SEQ ID NO: 48180 - RNA, 432 nt, synthetic construct
  misc_feature 1..432: note = derived and/or modified sequence opt6 from anti-HIV_cap256-038-032874_VR-Chain
  source 1..432: mol_type = other RNA
caagtacaattagtagaaagtggaggaggagtagtacaaccaggaggaagtctaagattaagttgtgcagcaagtggatttacatttagtagttatggaatgcattgggtaagacaagcgccaggaaaaggattagaatgggtagcatttataagatatgatggaaataataaatattatgcagatagtgtaaaaggaagatttacaataagtagagaaaatagtaaaaatacattatatttacaaatgaatagtttaagagcagaagatacagcagtatatcattgtgcaaaagatttaggagaaagtgaaaaagaagaatgggcaagtgattattatgattttggaagagattatccaggacaagatccaagaggagtagtaggaacatttgatatatggggacatggaacaatggtaacagtaagtagt

SEQ ID NO: 48181 - RNA, 432 nt, synthetic construct
  misc_feature 1..432: note = derived and/or modified sequence opt6 from anti-HIV_cap256-038-025899_VR-Chain
  source 1..432: mol_type = other RNA
caagtacaattagtagaaagcggaggaggagtagtacaaccaggaaggagtttaagattaagttgtgtagcaagcggatttacatttagtaattatgcaatgtactgggtaagacaagcaccaggaaaaggactagaatgggtaacaataataagttttgatggatcaaatcaatattatgcagatagtgtaaaaggaagatttacaataagcagagaaaatagtaaaaatacactatatttacaaatgaatagcctaagagcagaagatacagcagtatattactgtgcaaaagacttaggagaaagagaaaatgaagaatgggcatcagactattacgatttcggaagagattacccaggacaagacccaagaggagtagtaggaagtatagatacatggggacatggaacaatggtaacagtaagtagt

SEQ ID NO: 48182 - RNA, 432 nt, synthetic construct
  misc_feature 1..432: note = derived and/or modified sequence opt6 from anti-HIV_cap256-038-024581_VR-Chain
  source 1..432: mol_type = other RNA
catatacaattagtagaaagtggaggaggagtagtacaaccaggaggaagtttaagattaagctgtgcagcaagcggattcccatttagtagttttggaatgcattgggtaagacaaacaccaggaagaggattagaatgggtagcaataatatggagcgatggaagtcataaagaatatacagatagtgtaaaaggaagatttacaataagtagagataatagtagaagtacaatggatttacaaatgaataatttaagaccagaagatacagcagtatattattgtgcaaaagatttaggagaaagagaaaatgaagaatgggcaagtgattattatgattttggaagagattatccaggacaagatccaagaggagtagtaggaagtatagatacatggggacatggaacaatggtaacagtaagttca

SEQ ID NO: 48183 - RNA, 432 nt, synthetic construct
  misc_feature 1..432: note = derived and/or modified sequence opt6 from anti-HIV_cap256-038-013345_VR-Chain
  source 1..432: mol_type = other RNA
caagtacaattagtagaaagtggaggaggagtagtacaaccgggaagaagtttaagattaagttgtgcagtaagtggatttacatttagtagttatggaatgcattgggtaagacaagcaccaggaaaaggattagaatgggtagcagcaataagttatgatggaagtaataaatattatgtagatagtgtaaaaggaagatttacaataagtagagataatagtaaaaatacattatatttacaaatgaatagtttaagagcagaagatacagcagtatattattgtgcaagagatttaggagaaagagaaatagaagaatgggcaacagattattatgattttagtataggatatccaggacaagatccaagaggagtagtaggagtatttgatatatggggacaaggaacaatggtaacagtaagtagt

SEQ ID NO: 48184 - RNA, 438 nt, synthetic construct
  misc_feature 1..438: note = derived and/or modified sequence opt6 from anti-HIV_cap256-038-011559_VR-Chain
  source 1..438: mol_type = other RNA
caagtgcaattagtagaaagtggaggaggagtagtacaaccaggaagaagtttaagattaagttgtgaagcaagcggatttacatttagtagctatggaatggattgggtaagacaagcaccaggaaaaggattagaatgggtagcattaataagtcatgatggaagtaataaacattatgcagatagtgtaaaaggaagatttacaataagtagagataatagtagaaatacattatatttacaaatgaatagtttaagagcagaagatacagcattatattattgtgcaaaagatttaggagaaagtgaaaatgaagatgaagaatgggcaagtgattattatgattttggaagggattatccaggacaagatagtagaggagtagtaggaacatttgatatgtggggacaaggaacaatggtaacagtaagtagt

SEQ ID NO: 48185 - RNA, 432 nt, synthetic construct
  misc_feature 1..432: note = derived and/or modified sequence opt6 from anti-HIV_cap256-038-009634_VR-Chain
  source 1..432: mol_type = other RNA
caagtacaattagtagaaagcggaggaggggtagtacaaccaggaagatcattaagattaagctgtgcagcaagcggattcacattcacatcatttggaatgcactgggtaagacaagcaccaggaaaaggactagaatgggtagcagtaataagctacgatggaaataacaaatactatgcagatagcgtaaaaggaagatttacaataagcagagaaaatagcaaaaacacactatatttacaaatgaatagcttaagagcagaagatacagcagtatatcactgtgcaaaagacttaggagaaagcgaaatagaagaatggacaagcgactattacgatttcggaagagattacccaggacaagacccaagaggagtatttggaacattcgatatatggggacatggaacaatggtaacagtaagctca

SEQ ID NO: 48186 - RNA, 432 nt, synthetic construct
  misc_feature 1..432: note = derived and/or modified sequence opt6 from anti-HIV_cap256-038-006730_VR-Chain
  source 1..432: mol_type = other RNA
caagtacaattagtagaaagtggaggaggagtagtacaaccaggaagaagtttaagattaagttgtgcagcaagtgggtttacatttagtagttttggaatgcattgggtaagacaagcaccaggaaaaggattagaatgggtagcagtaataagtaaagatggaagtgataatagttatgtagatagtgtaaaaggaagatttacaataagtagagataatagtaaaaatacattatatttacaaatgaatagcttaagagcagaagatacagcagtatattattgtgcaagagatttaggagaaagtgaaaatgaagaatggccaagtgattattatgattttggaagagattatccaggacaagatccaagaggagtaataggaacatttgatgtatggggacaaggaacaatggtaacagtaagtagt

SEQ ID NO: 48187 - RNA, 432 nt, synthetic construct
  misc_feature 1..432: note = derived and/or modified sequence opt6 from anti-HIV_cap256-038-004887_VR-Chain
  source 1..432: mol_type = other RNA
caagtacaattagtagaaagtggaggaggagtggtacaaccaggaagaagtttaagattaagttgtgcagcaagtggatttagttttagtacaagtggaatgcattgggtaagacaagcaccaggaaaaggaatggaatgggtagcagtaataagctatgatggaagtaataaatattatgcagatagcgtaaaaggaagatttacaataagtagagataatagtaaaaatacattatatttacaaatgaatagtttgagagcggtagatacagcagtatattattgtgcaaaagatttaggagaaggagaaaatgaagaatgggcaacagattattatgattttagtataggatatccagtacaaaatccaagaggattagtaggagcatttgatatatggggacaaggaacaatggtaacagtaagcagc

SEQ ID NO: 48188 - RNA, 432 nt, synthetic construct
  misc_feature 1..432: note = derived and/or modified sequence opt6 from anti-HIV_cap256-038-004840_VR-Chain
  source 1..432: mol_type = other RNA
caagtacaattagtagaaagcggaggaggagtagtacaaccaggaagatcattaagattaagctgtgcagcaagcggattcacattcagcagttttggaatgcactgggtaagacaatcaccaggaaaaggactagagtgggtagcagtaatatcatacgatggaaataacaaatactatgcagatagcgtaaaaggaagatttacaataagcagagaaaatagcaaaaacacactatatctacaaatgaatagtttaagaacagacgatacagcagtatattactgtgcaaaagacttaggagaaagcgaaacagaagaatggccatcagactattacgatttcggaagagattacccaggacaagacccaagaggagtagtaggaacattcgatatatggggacatggaacaatggtaacagtaagttca

SEQ ID NO: 48189 - RNA, 432 nt, synthetic construct
  misc_feature 1..432: note = derived and/or modified sequence opt6 from anti-HIV_cap256-038-002181_VR-Chain
  source 1..432: mol_type = other RNA
gaagtacaattagtagaaagtggaggaggattagtacaaccaggaagaagtctaagattaagttgtgcagcaagtggatttacatttgaagattatgcaatgcattgggtaagacaagcaccaggaaaaggattagaatgggtagcagtaataagttatgatggaagtaataaatattatgtagatagtgtaaaaggaagatttacaataagtagagataatagtaaaaatacattatatctacaaatgaatagtttaagagcagaagatacagcagtatattattgtgcaaaagatttaggagaaagtgaaaatgaagaatgggcaacagattattatgattttagtataggatatccaggacaagatccaagaggagtagtaggaatatttgatatatggggacaaggaacaatggtaacagtaagcagt

SEQ ID NO: 48190 - RNA, 432 nt, synthetic construct
  misc_feature 1..432: note = derived and/or modified sequence opt6 from anti-HIV_cap256-038-001902_VR-Chain
  source 1..432: mol_type = other RNA
caagtacaattagtagaaagtggaggaggagtagtacaaccaggaagaagtttaagattaagctgtgcagcaagtggatttacatttagtagttttggaatgcattgggtaagacaagcaccaggaaaaggactagaatgggtagcagtaataagttatgatggaaataataaatattatgcagatagtgtaaaaggaagatttacaataagtagagaaaatagcgaaaatacattatatttacaaatgaatagtttaagagcagatgatacagcagtatattattgtgcaaaagatttaggagaaagtgaaaatgaagaatgggcaagtgattattatgattttggaagggattatccaggacaagacacaagaggagtagtaggaacatttgatatatggggacatggaacaatggtaacagtaagttca

SEQ ID NO: 48191 - RNA, 432 nt, synthetic construct
  misc_feature 1..432: note = derived and/or modified sequence opt6 from anti-HIV_cap256-038-000976_VR-Chain
  source 1..432: mol_type = other RNA
caagtacaattagtagaaagtggaggaggagtagtacaaccaggaagaagtttaagattaagttgtgcagcaagtggatttacatttagtagttttggaatgcattgggtaagacaagcaccaggaaaaggattagaatgggtggcagtaataagtgatgatggaaataataaatattatgcagatagtgtaaaaggaagatttacaataagtagagataatagtaaaaatacactatatttacaaatgaatagtttaagagtagaagatacagcagtatattattgtgtaaaagatgtaggagaaagtgaaaatgaagaatgggcaagtgattattatgattttggaagagattatccaggacaagatacaagagcagtagtaggagcatttgatatatggggacaaggaacaatggtaacagtaagtagt

SEQ ID NO: 48192 - RNA, 432 nt, synthetic construct
  misc_feature 1..432: note = derived and/or modified sequence opt6 from anti-HIV_cap256-038-000384_VR-Chain
  source 1..432: mol_type = other RNA
caagtgcaattagtagaaagtggaggaggagtagtacaaccaggaaaaagtttaagattaagttgtgcagcaagtggatttacatttagtagttatgtaatgcattgggtaagacaagcaccaggaaaaggattagaatgggtggcagatataagttatgatggaagtaataaatattatgcagatagtgtaaaaggaagattaacaataagtagagataatagtaaaaatacactatatctacaaatgaatagcttaagagcagaagatacagcagtgtattattgtgtaaaagatttaggagaaagtgaaaaagaagaatggccaagtgattattatgattttggaagagattatccaggacaagatagtagaggagtagtaggagtatttgatatatggggacaaggaacaatggtaacagtaagtagt

SEQ ID NO: 48193 - RNA, 321 nt, synthetic construct
  misc_feature 1..321: note = derived and/or modified sequence opt6 from anti-HIV_206-314431_VR-Chain
  source 1..321: mol_type = other RNA
caatttgtattaacacaaccaccaagcgtaagcgcagcaccaggacaaaacgtaacaataagctgtagcggaccaccaagccatatagaaaaaaatgacgtaagctggtaccaaagattaccaggaatggcaccaaaaatggtaatatatgaatcaagaagaagaccactaggaataccagtaagattcacagcatcaagatcaggatcaagcgcaacattagtaataacaggactacaaacagcagacgaagcagattactattgcggaacatgggacggaagaatgaactttggaacaggaacaacagtaacagtacta

SEQ ID NO: 48194 - RNA, 321 nt, synthetic construct
  misc_feature 1..321: note = derived and/or modified sequence opt6 from anti-HIV_206-247594_VR-Chain
  source 1..321: mol_type = other RNA
caatcaatattaacacaaccaccatcagtatcagcagcaccaggacaaaacgtaacaatatcatgttcaggaccaccatcacatatagaaaaaaatgacgtatcatggtaccaaagattcccaggaatggcacccaaaatgataatatatgaatcaaaaagaagaccattcggagtaccaggaagattctcagcatcaagatcaggaaaatcagcaacattagcaataacaggactacaaacaggagacgaagcagactactactgcggaacatgggacggaagaatgaactttggaacaggaacaacagtaacagtacta

SEQ ID NO: 48195 - RNA, 321 nt, synthetic construct
  misc_feature 1..321: note = derived and/or modified sequence opt6 from anti-HIV_206-116890_VR-Chain
  source 1..321: mol_type = other RNA
caatcagtactaacacaaccaccatcagtatcagcagcaccaggacaaaacgtaacaatatcatgctcaggaccaccatcacacatagaaaaaaacgacgtatcatggtaccaacacttaccaggagaagcaccaaaaatgataatatacgaatcatggagaagaccagcaggaataccagcaagattctcagcatcaagatcaggaaaatcaggaacactagcaataacaggactacaaacaggagacgaagcagactactactgcggaacatggaacggaagaatgaacttcggaacaggaacaacagtaacagtacta

SEQ ID NO: 48196 - RNA, 333 nt, synthetic construct
  misc_feature 1..333: note = derived and/or modified sequence opt6 from anti-HIV_206-072383_VR-Chain
  source 1..333: mol_type = other RNA
caatcagtactaacacaaccaccatcagtatcagcagcaccaggacaaagagtaataatatcatgctcaggaaacaattcaacaataggaaacaacttcgtatcatggtaccaacaagtaccaggaacagcaccaaaactactaatatacgaaacaaacagaagaccatcaggaataccagacagattctcaggatcaaaatcaggaacatcagcaacattagcaatatcaggattacaaacaggagacgaagcagacttctactgcacagtatggggagtaagaaaaggagtagcagcagtattcggaacaggaacaagactaacagtacta

SEQ ID NO: 48197 - RNA, 333 nt, synthetic construct
  misc_feature 1..333: note = derived and/or modified sequence opt6 from anti-HIV_206-037527_VR-Chain
  source 1..333: mol_type = other RNA
caatcagtattaacacaaccaccaagcgtaagcgcagcaccaggacaaaaagtaataataagctgtagcggaaacaatagcacaataggaaaaatattagtaagctggtaccaacaagtaccaggaacagcaccaaaattagtaatatatgaaacaaacagaagaccaagcggaataccagacagattctcaggatcaaaatcaggaacaagcgcaacactagcaataacaggactacaaacaggagacgaagcagattacttttgcaaagtatggggagtaagaaaaggagtagcagcagtatttggaacaggaacaaaagtaacagtacta

SEQ ID NO: 48198 - RNA, 333 nt, synthetic construct
  misc_feature 1..333: note = derived and/or modified sequence opt6 from anti-HIV_206-009095_VR-Chain
  source 1..333: mol_type = other RNA
caatcagtactaacacaaccaccatcagtatcagcagcaccagcacaaagagtaataatatcatgctcaggagacaattcaacaataggaaacaacttcgtatcatggtaccaacaagtaccaggagcagcaccaaaactactaatatacgaaacaaacagaagaccatcaggaataccagacagattctcaggatcaaaatcaggaacaacagcaacactagcaatatcaggactacaaacaggagacgaagcagactaccactgcacagtatggggagtaagaaaaggagtagcagcagtattcggaacaggaacaaaagtaacagtacta

SEQ ID NO: 48199 - RNA, 321 nt, synthetic construct
  misc_feature 1..321: note = derived and/or modified sequence opt6 from anti-HIV_176-503620_VR-Chain
  source 1..321: mol_type = other RNA
caaagcgtattaacacaaccaccaagcgtaagcacagcaccaggacaaacagtaacagtaagctgtagcggaggaacaagcaatacaggaaacaatttcgtaagctggtaccaacacttaccaggaacagcaccaaaactattaatatatgaaaataacaaaagaccattaggagtaccagacagattctcaggagcaaaatcaggaacaagcgcaacattagcattaacaggactacaaacaggagacgaaggagattactattgcgcaacatggagcggatcattaaacataggaacaggaacaaaagtaagcgtacta

SEQ ID NO: 48200 - RNA, 321 nt, synthetic construct
  misc_feature 1..321: note = derived and/or modified sequence opt6 from anti-HIV_176-478726_VR-Chain
  source 1..321: mol_type = other RNA
caatcagtactaacacaaccaccatcagtatcagcagcaccaggacaaaacgtaaacatatcatgttcaggaccaccatcacatatagaaagaaatgacgtatcatggtaccaacacttaccaggagcagcaccaaaaatgataatatatgaatcatggagaagaccagcaggaataccagacagattctcagcatcaagatcaggagcatcagcaacattagcaataacaggactacaaacaggagacgaagcagattactactgcggaacatggaacggaagaatgaactttggaacaggaacaacagtaacagtacta

SEQ ID NO: 48201 - RNA, 321 nt, synthetic construct
  misc_feature 1..321: note = derived and/or modified sequence opt6 from anti-HIV_176-245056_VR-Chain
  source 1..321: mol_type = other RNA
caatcagtattaacacaaccaccatcagtatcagcagcaccaggacaaaacgtaacaatatcatgttcaggaccaccatcacatatagaaaaaaacggagtatcatggtaccaacaatttccaggaatggcaccaaaaatggtaatatatgaatcaaaaagaagaccattcggagtaccagcaagattctcagcatcaagatcaggaaaatcagcaacattagcaataacaggactacaaacaggagacgaagcagattactactgcggaacatgggacggaagaatgaactttggaacaggaacaacagtaacagtacta

SEQ ID NO: 48202 - RNA, 321 nt, synthetic construct
  misc_feature 1..321: note = derived and/or modified sequence opt6 from anti-HIV_176-164413_VR-Chain
  source 1..321: mol_type = other RNA
caatcagtactaacacaaccaccatcagtatcagcagcaccaggacaaaaagtaacaatatcatgctcaggaggaacatcaaacataggaaacaactacgtatcatggtaccaaagactaccaggaacagcaccaaaactactaatatacgaaaacaacaaaagaccatcaggaataccagacagattctcaggaccaaaatcaggaacatcagcaacactagcaataacaggactacaaccaggagacgaagcagactactactgcgcaacatggtcaggatcactaaacttcggaacaggaacaaaagtaacagtacta

SEQ ID NO: 48203 - RNA, 333 nt, synthetic construct
  misc_feature 1..333: note = derived and/or modified sequence opt6 from anti-HIV_176-094308_VR-Chain
  source 1..333: mol_type = other RNA
caatcagtattaacacaaccaccaagcgtaagtgcagcaccaggacaaaaagtaataataagttgtagcggaaacaatagcacaataggaaacaatttcgtaagttggtaccaacaagtaccaggaacagcaccaaaactattagtatatgaaacatacagaagaccaagcggaataccagacagaagctcaggatcaaaatcaggaacaacagcaacacaagcaataagcggactacaaacaggagacgaagcagattaccattgcacagtatggggagtaagaaaaggagtagcagcagtatttggaacaggaacaaaagtaacagtacta

SEQ ID NO: 48204 - RNA, 333 nt, synthetic construct
  misc_feature 1..333: note = derived and/or modified sequence opt6 from anti-HIV_176-065321_VR-Chain
  source 1..333: mol_type = other RNA
caatcagtattaacccaaccaccaagcgtaagcgcagcaccaggaagaagagtaataataagctgtagcggaaacaatagcacaataggaaacaatttcgtaagctggtaccaacaagtaccaggaacagcaccaaaactattagtatatgaaacaaacagaagaccaagtggaataccagacagattctcaggatcaaaatcaggaacaagcgcaacattagcaataagcggactacaaacaggagacgaagcagattactattgcacagtatggggagtaagaaaaggagtagcagcagtatttggaacaggaacaaaagtaacagtacta

SEQ ID NO: 48205 - RNA, 324 nt, synthetic construct
  misc_feature 1..324: note = derived and/or modified sequence opt6 from anti-HIV_119-099719_VR-Chain
  source 1..324: mol_type = other RNA
caatcagtactaacacaaccaccatcagtatcagcagcaccaggacaaaaagtaacaatatcatgctcaggatcaaactcatacataggaaacaaatacatatcatggtaccaacaattcccaggaacagcaccaaaactactaatatacgaaaacaacaaaagaccatcaggagtaccagacagattctcagcatcaaaatcagcaacatcagcaacactagcaataacaggactacacacaggagacgaagcagactactactgcgaaacatgcgacggatcaggaggagtattcggaacaggaacaaaagtaacagtacta

SEQ ID NO: 48206 - RNA, 327 nt, synthetic construct
  misc_feature 1..327: note = derived and/or modified sequence opt6 from anti-HIV_119-099536_VR-Chain
  source 1..327: mol_type = other RNA
gaactaacacaaccaccatcagtatcagcagcatcaggacaaaacgtaaacatatcatgctcaggaggatcatcaaacataggatcaaactacgtatcatggtaccaacaattcccaggaacagcaccaaaactattaatatacgaaacaaataaaagaccatcaggaataccagacagattctcaggatcaaaatcaggagcatcagcaacactagcaataacaggactacaaacaggagacgaagcagactactactgcgcaacatgggcagactcactaaactcagcaagagtattcggaacaggaacaaaagtaacagtacta

SEQ ID NO: 48207 - RNA, 333 nt, synthetic construct
  misc_feature 1..333: note = derived and/or modified sequence opt6 from anti-HIV_119-098907_VR-Chain
  source 1..333: mol_type = other RNA
caatcagtactaacacaaccaccatcagtatcagcaacaccaggacaaaaagtaacaatatcatgctcaggatcaaactcaaacataggagacaaatacgtatcatggtaccaacacttcccaggaacagcaccaaaactattagtatatgaaacatacagaagaccatcaggaataccagacagattctcaggatcaaaatcaggaacatcagcaacactagcaataacaggactacaaacaggagacgaagcagactactactgcacaatatggggagtaagaaaaggagtaggagcagtattcggaacaggaacaaaagtaatagtacta

SEQ ID NO: 48208 - RNA, 324 nt, synthetic construct
  misc_feature 1..324: note = derived and/or modified sequence opt6 from anti-HIV_119-098555_VR-Chain
  source 1..324: mol_type = other RNA
caatcagtactaacacaaccaccatcagtatcagcagcaccaggacaaaacgtaacaatatcatgctcaggatcagcatcaaacataggaaaaaacttcgtatcatggtaccaacaactaccaggaacagcaccaaaactactaatatacggatcaaacaacagaccatcaggagtaccagacagattctcaggatcaaaatcaggaacatcagcatcactagcaataacaggactacaaacaggagacgaagcagactactactgcgaaacatgggacggatcaggagcagtattcggaacaggaacaaaagtaacagtacta

SEQ ID NO: 48209 - RNA, 324 nt, synthetic construct
  misc_feature 1..324: note = derived and/or modified sequence opt6 from anti-HIV_119-097828_VR-Chain
  source 1..324: mol_type = other RNA
caatcagtactaacacaaccaccatcagtatcagcagcaccaggacaaaaagtaacaatatcatgctcaggatcatcatcaaacataggaaaaaactacgtatcatggtaccaattactaccaggaacagcaccaagactagtaatatacgaaaacgacgaaagaccatcaggaacaccagacagattctcaggatcaaaatcaggaacatcagcaacactagcaataacaggactacacacaggagacgaagcagactactactgcgaaacatgggacggatcaggaggagtattcggaacaggaacaaaagtaacagtacta

SEQ ID NO: 48210 - RNA, 324 nt, synthetic construct
  misc_feature 1..324: note = derived and/or modified sequence opt6 from anti-HIV_119-096480_VR-Chain
  source 1..324: mol_type = other RNA
caatcagtactaacacaaccaccatcagtatcaggagcaccaggacaaagaataacaatatcatgctcaggatcaacatcaaacataggacaaaactacgtatcatggtaccaacaactaccaggaacagcaccaaaactactaatatcagacaacaacagaagaccatcatggactccagacagattctcaggatcaaaatcaggaacatcagcaacactagcaataacaggactacaaacaggagacgaagcagactactactgcgaaacatgggacggatcaggaggagtattcggaccaggaacaagagtaacagtacta

SEQ ID NO: 48211 - RNA, 324 nt, synthetic construct
  misc_feature 1..324: note = derived and/or modified sequence opt6 from anti-HIV_119-095664_VR-Chain
  source 1..324: mol_type = other RNA
caatcagtactaacacaaccaccatcagtatcagcagcaccaggacaaaaagtaacaatatcatgctcaggaggagcagcaaacataggaaaaaactcagtatcatggtaccaacaactaccaggaacagcaccaaaactactaatatacgacaacaacagaagaccatcaggaacaccagacagattctcaggatcaaaatcaggaacatcagcaacactagcaataagtggactacaaacaggagacgaagcagactactactgcgaaacatggcacggatcaggaggagtattcggaacaggaacaaaagtaacagtacta

SEQ ID NO: 48212 - RNA, 321 nt, synthetic construct
  misc_feature 1..321: note = derived and/or modified sequence opt6 from anti-HIV_119-095212_VR-Chain
  source 1..321: mol_type = other RNA
caatcagtattaacacaaccaccatcagtatcagcagcaccaggacaaaaagtaacaatatcatgctcaggatcaacatcaaacataggaaaatcagacgtattctggtaccaacaactaccaggaacagcaccaaaactactaatatcagaaacatcaagacgaccatcaggaataccagacagattctcaggagcaaaatcaggaacatcagcaacactagcaataacaggactacaaacaggagacgaagcagactacttctgctcaacatggtcaggatcactaaacttcggaacaggaacaagagtaacagtacta

SEQ ID NO: 48213 - RNA, 333 nt, synthetic construct
  misc_feature 1..333: note = derived and/or modified sequence opt6 from anti-HIV_119-094773_VR-Chain
  source 1..333: mol_type = other RNA
caatcagtactaacacaatcaccaacagtatcagcagcaccaggacaaacagtaacaatatcatgctcaggaggaacatcaaatgtaggaaaaaacttcgtatcatggtaccaacaattcccaagaacagcaccaaaactactaatatacgaaaacaacaaaagaccatcaggaataccagacagattctcaggatcaaaatcaggaacctcagcaacactagtaataacaggactacaaacaggagacgaagcagacttctactgcggaacatgggacggaagcctaagaacaggaggagtaataggaacaggaacaagagtaacagtacta

SEQ ID NO: 48214 - RNA, 324 nt, synthetic construct
  misc_feature 1..324: note = derived and/or modified sequence opt6 from anti-HIV_119-094508_VR-Chain
  source 1..324: mol_type = other RNA
caatcagtactaacacaaccaccatcagtatcagcaacaccaggacaaagagtaacagtatcatgctcaggatcatcatcaaacataggaaaccactacgtatcatggtaccaacaagtaccaggaacagcaccaaaactattaatatcagaaaactcaagaagaccatcaggaacaccagacagattctcaggaagcaaaagcggaacatcagcaacattagcaataacaggactacaaacaggagacgaagcagactactactgcgaaacatgggacggatcaggaggagtattcggaacaggaacaaaagtaacagtatta

SEQ ID NO: 48215 - RNA, 324 nt, synthetic construct
  misc_feature 1..324: note = derived and/or modified sequence opt6 from anti-HIV_119-093795_VR-Chain
  source 1..324: mol_type = other RNA
caatcagtattaacacaaccaccatcagtatcagcagcaccaggacaaaaagtaacaatatcatgctcaggatcatcatcaaacataggaaacaactacgtatcatggtaccaatacctaccaggaacagcaccaaaactactaatatcagaaaacaacagaagaccatcaggaacaccagacagattctcaggatcaaaatcaggaacatcagcaacactagcaataacaggactacaaacaggagacgaagcagactactactgcgaaacatgggacggatcaggaggagtattcggaacaggaacaaaagtaacagtccta

SEQ ID NO: 48216 - RNA, 321 nt, synthetic construct
  misc_feature 1..321: note = derived and/or modified sequence opt6 from anti-HIV_119-093732_VR-Chain
  source 1..321: mol_type = other RNA
caaagcgtattaacacaaccaccaagcgtaagcgcagcagcaggacaaaacgtaaacataagctgtagcggaagaaaaagcaatgtaggaggaaattacgtaagctggtaccaacaatttccaggaacagcaccaaaactattaatatatgaagataacaaaagaccaagctggataccagacagattcacagcatcaagatcaggaacaagcgcaacattaggaataacaggactacaaacaggagacgaagcagattacttttgctcaacatggagcggatcattaaactttggaacaggaacaagagtaacagtacta

SEQ ID NO: 48217 - RNA, 333 nt, synthetic construct
  misc_feature 1..333: note = derived and/or modified sequence opt6 from anti-HIV_119-092903_VR-Chain
  source 1..333: mol_type = other RNA
caatcagtactaacacaaccaccatcagtatcagcagcaccaagacaaaaagtaacaatatcatgctcaggatcatcatcaaacataggaaaccactacgtatcatggtaccaacaactaccaggaacagcaccaaaactactaatatacgaaaacaacaaaagaccatcaggaataccagacagattctcaggatcaaaatcaggaacatcagcaacactagcaataacaggactacaaacaggagacgaagcagactactactgcgcaacctgggcaccaagactaaactcagcaagagtattcggaaacggaacaatggtaacagtacta

SEQ ID NO: 48218 - RNA, 333 nt, synthetic construct
  misc_feature 1..333: note = derived and/or modified sequence opt6 from anti-HIV_119-092284_VR-Chain
  source 1..333: mol_type = other RNA
caaagcgtcttaacacaaccaccaagcgtaagcggagcaccaggacaaagagtaacaataagctgtacaggaagctcaagcaatataggaggatatgacgtacactggtaccaacaagtaccaggaacagcaccaaaactattactatatgaaaatgacagaagaccaagcggaataccagacagattctcaggatcaaaatcaggaacaagtgcaacattagtaataacaggactacaaacaggagacgaagcagatttctattgcggaacatgggacggatcattaagaacaggaggagtaataggaacaggaacaagagtaacagtacta

SEQ ID NO: 48219 - RNA, 333 nt, synthetic construct
  misc_feature 1..333: note = derived and/or modified sequence opt6 from anti-HIV_119-091586_VR-Chain
  source 1..333: mol_type = other RNA
caatcagtattaacacaaccaccaagtatgagcgcagcaccaggacaaagagtaacaataagctgtagcggaacatcaagcgatataggaagaaattacgtaagctggtaccaacaatttccaggagcagcaccaaaagtattaatatatgaaaatagcaatagaccaagcggaataccagacagattctcaggatcaaaatcaggaacaagcgcaacattagcaataagcggactacaaacaggagacgaagcagattactgttgcgcagtatggggagtaagaagaggagcaggagcagtatttggagcaggaacaaaagtaacagtacta

SEQ ID NO: 48220 - RNA, 333 nt, synthetic construct
  misc_feature 1..333: note = derived and/or modified sequence opt6 from anti-HIV_119-091023_VR-Chain
  source 1..333: mol_type = other RNA
caatcagtattaacacaaccaccaagcgtaagcgcagcaccaggacaaagagtaacaataagctgtagcggaagcacaagtaatataggaaacaatttcgtaagttggtaccatcacgtaccaggaacagcaccaaaactattaatatatgacaatgtaaaaagaccaacaaatgtaccagacagattctcaggatcaaaatcaggaacaagcgcaacattagcaataagcggactacaaacaggagacgaagcagattactggtgtgcagtatggggagtaagaagaggagcaggagcagtatttggagcaggaacaaaagtaacagtacta

SEQ ID NO: 48221 - RNA, 333 nt, synthetic construct
  misc_feature 1..333: note = derived and/or modified sequence opt6 from anti-HIV_119-090334_VR-Chain
  source 1..333: mol_type = other RNA
caaagtgtattaacacaaccaccaagcgtaagcggagcaccaggacaaagagtaacaataagctgtacaggaagcgcaagcaatataggagactcagacgtacactggtaccaacaattaccaggaacagcaccaaaattattaatatttgacaatgacaaaagaccaagcggaataccagacagattctcaggatcaaaatcaggaacaagcgcaacattagcaataacaggactacaaagtggagacgaagcagattactattgcgcagtatggggagtaagacaaggagcaggagcagtatttggaacaggaacaaaagtaacagtatta

SEQ ID NO: 48222 - RNA, 333 nt, synthetic construct
  misc_feature 1..333: note = derived and/or modified sequence opt6 from anti-HIV_119-088694_VR-Chain
  source 1..333: mol_type = other RNA
caatcagtattaacacaaccaccaagcgtaagcgcagcaccaggacaaaaagtaacaataagctgttcaggaagcagtagcaatataccaataaatggagtaagctggtaccaacaatttccaggaacagcaccaaaactattagtatatgaaacatacagaagaccaagcggaataccagacagattctcaggatcaaaatcaggaacatcagcaacattagcaataacaggactacaaacaggagacgaagcagattactattgcacagtatggggagtaagaaaaggagtaggagcagtatttggaacaggaacaaaagtaacagtacta

SEQ ID NO: 48223 - RNA, 333 nt, synthetic construct
  misc_feature 1..333: note = derived and/or modified sequence opt6 from anti-HIV_119-088499_VR-Chain
  source 1..333: mol_type = other RNA
caatcagtactaacacaaccaccatcagtatcagcagcaccaggacaaaaagtaacaatatcatgctcaggatcaaactcatacataggaaacaaatacgtatcatggtaccaacaattcccaggaacagcaccaaaactactaatatacgaaacaaacaaaagaccatcaggaataccagacagattctcaggatcaaaatcaggaacatcagcaacactagcaataacaggattacaaacaggagacgaagcagactactactgcgcaacatgggcaccaagactaaactcagcacgagtattcggaaacggaacaatggtaacagtacta

SEQ ID NO: 48224 - RNA, 333 nt, synthetic construct
  misc_feature 1..333: note = derived and/or modified sequence opt6 from anti-HIV_119-088298_VR-Chain
  source 1..333: mol_type = other RNA
caaagcgtcttaacacaaccaccaagcgtaagcgcagcaccaaaagaaaaagtaacaataagctgtagcggaggaacaagtaatataggaagaaattacgtaagctggtaccaacaagtaccaggaacagcaccaaaactattaatatatgaaaataacaaaagaccaagcggaataccagacagattctcaggatcaaaatcaggaacaagtgcaacattagtaataacaggactacaaacaggagacgaagcagatttctattgcggaacatggggaggatcattaagaacaggaggagtattaggaacaggaacaagagtaacagtacta

SEQ ID NO: 48225 - RNA, 324 nt, synthetic construct
  misc_feature 1..324: note = derived and/or modified sequence opt6 from anti-HIV_119-087488_VR-Chain
  source 1..324: mol_type = other RNA
caatcagtattaacacaaccaccatcagtatcagcagcaccaggacaaaaagtaacaatattctgctcaggaagatactcaaacatagaatcaaactacgtatcatggtaccaacaactaccaggaacagcaccaaaactattaatacacgaaaacaacagaagaccatcaggaacaccagacagattctcaggatcaaaaagcggaacatcagcaacactagcaataacaggattacacacaggagacgaagcagactactactgcgaaacatgggacggatcaggaggagtatttggaacaggaacaaaagtaacagtacta

SEQ ID NO: 48226 - RNA, 333 nt, synthetic construct
  misc_feature 1..333: note = derived and/or modified sequence opt6 from anti-HIV_119-087423_VR-Chain
  source 1..333: mol_type = other RNA
caatcagtattaacacaaccaccaagcgtaagcgcagcaccaggacaaaaagtaacaataagttgtagcgcaagctcaagcaatataggaaacaattacgtaagctggtaccaacaattaccagcaacagcaccaaaactattaatatatgacacagacaaaagaccaagcggaataccagacagattctcaggatcaaaatcaggaacaagcgcaacattagcaataacaggactacaaacaggagacgaagcagattactattgcacagtatggggagtaagaaaaggagtaggagcagtatttggcacaggaacaaaagtaacagtacta

SEQ ID NO: 48227 - RNA, 324 nt, synthetic construct
  misc_feature 1..324: note = derived and/or modified sequence opt6 from anti-HIV_119-087371_VR-Chain
  source 1..324: mol_type = other RNA
caatcagtattaacacaaccaccaagcttaagcgcagcaccaggacaaagagtaacaataagctgtagcggaggagcaagcaatataggaaaaaatagcgtaagctggtacgtacaagtaccaggaacagcaccaaaactattaatatatgaaaataaccaaagaccaagcggaatatcagacagattcagtggatcaaaatcaggatcaagcgcaacattaggaataacaggactacaaacagcagacgaagcagattactattgcgaaacatgggacggaagcggaggagtattcggaacaggaacaaaagtaacagtatta

SEQ ID NO: 48228 - RNA, 321 nt, synthetic construct
  misc_feature 1..321: note = derived and/or modified sequence opt6 from anti-HIV_119-087279_VR-Chain
  source 1..321: mol_type = other RNA
caatcagtactaacacaaccaccatcagtatcagcagcaccaggacaaaaagtaacaatatcctgctcaggatcatcatcaaacataggaaaaaactacgtatcatggtaccaacaattcccaggaacagcaccaaaactactaatgtacgaaaacaacaaaagaccatcaggagtaccagacagattctcaggatcaaaatcaggaacatcagcaacactagacatatcaggactacaaacaggagacgaagcagactactactgctcaacatggtcaggatcactaaacttcggaacaggaacaagagtaacagtacta

SEQ ID NO: 48229 - RNA, 324 nt, synthetic construct
  misc_feature 1..324: note = derived and/or modified sequence opt6 from anti-HIV_119-087146_VR-Chain
  source 1..324: mol_type = other RNA
caatcagtactaacacaaccaccatcagtatcagcagcaccaggacaaaaagtaacaatatcatgctcaggatcatcatcaaacataggaaaaaactcagtatcatggtaccaacaattcccaggaacagcaccaaaactactaatatacgaaaacaacaaaagaccatcaggaataccagacagattctcaggatcaaaatcaggaacatcagcaacactagcaataacaggactacacacaggagacgaagcagactactactgcgaaacatgggacggatcaggaggagtattcggaacaggaacaaaagtaacagtacta

SEQ ID NO: 48230 - RNA, 324 nt, synthetic construct
  misc_feature 1..324: note = derived and/or modified sequence opt6 from anti-HIV_119-087048_VR-Chain
  source 1..324: mol_type = other RNA
caattcgtactaacacaaccaccatcagtatcagcagcaccaagacaaaaagtaataatatcatgctcaggatcaagctcaaacataggaaaaaactacgtatcatggtaccaacaactaccaggaacagcaccaaaactactaatatacgacaacgacaaaagaccatcaggaatatcagacagattcagcgcaagtaaaagcggaacatcagcaacactagcaataacaggactacacacaggagacgaagcagactactactgcgaaacatgggacggatcaggaggagtattcggaacaggaacaaaagtcacagtacta

SEQ ID NO: 48231 - RNA, 321 nt, synthetic construct
  misc_feature 1..321: note = derived and/or modified sequence opt6 from anti-HIV_119-085802_VR-Chain
  source 1..321: mol_type = other RNA
caatcaatactaacacaaccaccatcagtatcagcagcaccaggacaaagagtaacaataccatgtttcggaggacattcaaatataggatcaaattacgtatcatggtaccaacacttaccaggaacagcaccaaaactattaatatttgaaaataacaaaagaccatcaggaataccagacagattctcaggagcaaaatcaggaacatcagcaacattagcaataacaggactacaaacaggagacgaagcagactacttctgcgcaacatggtcaggaggactaaacttcggaacaggaacaaaagtaacagtacta

SEQ ID NO: 48232 - RNA, 324 nt, synthetic construct
  misc_feature 1..324: note = derived and/or modified sequence opt6 from anti-HIV_119-085784_VR-Chain
  source 1..324: mol_type = other RNA
caatcattcttaacacaaccaccatcagtatcagcagcaccaggacaaaaagtaacaatatcatgctcaggatcaaactcaaacataggaaacaactatgtatcatggtaccaatacctaccaggaacagcaccaaaactattaatatacgaaaacgacagaagaccatcaggaacaccagacagattctcaggatcaaaatcaggaacatcagcaacactagcaataacaggattacaaacaggagacgaagcagactactactgcgaaacatgggacggatcaggaggagtattcggaacaggaacaaaagtaacagtacta

SEQ ID NO: 48233 - RNA, 333 nt, synthetic construct
  misc_feature 1..333: note = derived and/or modified sequence opt6 from anti-HIV_119-085370_VR-Chain
  source 1..333: mol_type = other RNA
caatcagtactaacacaaccaccatcagtatcagcagcaccaggacaaacagtaacaatatcatgctcaggatcatcatcaaacataggaaacacatacgtatcatggtaccaacacctaccaggaacagcaccaaaattactaatatacgacaacaacataagaccatcaggaataccagacagattctcagcatcaaaatcaggaacatcagcaacattagcaataacaggactacaaacaggagacgaagcagactactactgcgcaacctgggcaccatcactaaactcagcaagagtattcggatcaggaacaagagtagcagtacta

SEQ ID NO: 48234 - RNA, 321 nt, synthetic construct
  misc_feature 1..321: note = derived and/or modified sequence opt6 from anti-HIV_119-085276_VR-Chain
  source 1..321: mol_type = other RNA
caatcaatactaacacaaccaccatcagtatccgcagcaccaggacaaagagtaacaatatcatgctcaggatcatcatcaaacataggaaacaactacgtatcatggtaccaacacgtaccaggaacagcaccaaaactattaatatacgaaaacaacagaagaccatcaggaacaccagacagattctcaggagcaaaatcaggaacatcagcaacactagcaataacaggactacaaacaggagacgaagcagactacttctgctcaacatggtcaggatcactaaacttcggaacaggaacaaaagtaacagtacta

SEQ ID NO: 48235 - RNA, 333 nt, synthetic construct
  misc_feature 1..333: note = derived and/or modified sequence opt6 from anti-HIV_119-084885_VR-Chain
  source 1..333: mol_type = other RNA
caatcagtattaacacaaccaccaagcgtaagtgcagcaccaggagaaaaagtaacaataagctgtagtggaagctcaagcaaaataggaaacaatttcgtaagctggtaccaacaagtaccaggaacagcaccaaaactattagtatatgaatcatacagaagaccaagcggaataccagacagattctcaggatcaaaatcaggcacaagcgcaacattagcaataacaggactacaaacaggagacgaagcagattactattgcacagtatggggagtaagaaaaggagtaggagcagtatttggaacaggaacaaaagtaacagtacta

SEQ ID NO: 48236 - RNA, 333 nt, synthetic construct
  misc_feature 1..333: note = derived and/or modified sequence opt6 from anti-HIV_119-084874_VR-Chain
  source 1..333: mol_type = other RNA
caatcagtattaacacaaccaccaagcgtaagcggagcaccaagacaaagagtaacaataagctgtagcggaagcgcaagcaatataggaaaaaatagcgtaagctggtaccaacaagtaccaggaacagcaccaaaactattaatatatgaaaataacaaaagaccaagcggaataccagacagattctcaggatcaaaatcaggaacaagcgcaacattagtaataacaggactacaaacaggagacgaagcagatttctattgcggaacatgggacggaagcttaagaacaggaggagtaataggaacaggaacaagagtaacagtacta

SEQ ID NO: 48237 - RNA, 333 nt, synthetic construct
  misc_feature 1..333: note = derived and/or modified sequence opt6 from anti-HIV_119-084691_VR-Chain
  source 1..333: mol_type = other RNA
caatcagtattaacacaaccaccaagcgtaagcgcagcaccaggacaaaaagtagtaataagctgtagcggaagctcaagcataatagaaaaaaatagcataagctggtaccaacaaggaccaggagcagcaccaaaactattaatatatgaaaatgacaaaagaccaagcggaataccagacagattctcaggatcaaaatcagcaacaagcgcaacattagcaatagtaggactacaaacaggagacgaagcagattactgttgcgcagtatggggagtaagaagaggagcaggagcagtatttggagcaggaacaaaagtaacagtacta

SEQ ID NO: 48238 - RNA, 324 nt, synthetic construct
  misc_feature 1..324: note = derived and/or modified sequence opt6 from anti-HIV_119-083793_VR-Chain
  source 1..324: mol_type = other RNA
caatcagtactaacacaaccaccatcagtatcagcagcaccaggacaaaaagtaacaatatcatgctcaggatcatcatcaaacataggcaaaaactcagtatcatggtaccaacaattaccagcaacagcaccaaaactactaatatacgaatcaaacaaaagaccatcaggaataccagacagattctcaggatcaaaatcaggaacatcagcaacactagcaataacaggactacaaacaggagacgaagcagactactactgcgcaacatgggacggaagagtatcagtaataggaacaggaacaaaagtaacagtacta

SEQ ID NO: 48239 - RNA, 324 nt, synthetic construct
  misc_feature 1..324: note = derived and/or modified sequence opt6 from anti-HIV_119-083163_VR-Chain
  source 1..324: mol_type = other RNA
caaagtgtactaacacaaccaccatcagtatcaggagcaccaggacaaagagtaataatatcatgcacaggatcaagttcaaacatatggggatacgatgtacaatggtatcaacaactaccaggaacagcaccaaaattactattatacgaaaacgatagaagaccatcaggaacaccagatagatttagcggaagcaaaagcggaacatcagcaacattagcaataacaggattacacacaggagatgaagcagactattactgtgaaacatgggatggatcaggaggagtatttggaacaggaacaaaagtaacagtatta

SEQ ID NO: 48240 - RNA, 333 nt, synthetic construct
  misc_feature 1..333: note = derived and/or modified sequence opt6 from anti-HIV_119-082331_VR-Chain
  source 1..333: mol_type = other RNA
caatcagtattaacacaaccaccaagcataagcgcagcaccaggacaaaaagtaacaataagctgtagcggaggatcaagcaatataggagcaaattacgtaagctggtaccaacacttaccaggaacagcaccaaaactattaatatatgaaacaaacaaaagaccaagtggaataccagacagattctcaggatcacaatcaggaacaagtgcaacattagtaataacaggactacaaacaggagacgaagcagatttctattgcggaacatggggaggaagcctaagagcaggaggagtaataggaacaggaacaagagtaacagtacta

SEQ ID NO: 48241 - RNA, 324 nt, synthetic construct
  misc_feature 1..324: note = derived and/or modified sequence opt6 from anti-HIV_119-082070_VR-Chain
  source 1..324: mol_type = other RNA
caaagcgtactaacacaaccaccatcagtatcagcagcaccaggacaaaaagtagtaatatcatgctcaggatcaagctcaataatagaaaaaaactcaatatcatggtatcaacaaggaccaggagcagcaccaaaattactaatatacgaaaacgatagaaggccatcaggaacaccagatagatttagcggaagtaaaagcggaacatcagcaacactagcaataacaggattacaaacaggagatgaagcagactattactgtgaaacatgggatggatcaggaggagtatttggaacaggaacaaaagtaacagtacta

SEQ ID NO: 48242 - RNA, 333 nt, synthetic construct
  misc_feature 1..333: note = derived and/or modified sequence opt6 from anti-HIV_119-081512_VR-Chain
  source 1..333: mol_type = other RNA
caatcagtattaacacaaccaccaagtgtaagcgcagcaccaggacaaaacgtaacatttagctgtagcggaagcaatagcaatataggagacaattacgtaagctggtaccaacaaataccaggaacagcaccaaaattagtaatatatgacaataacaaaagaccaagcggaataccagacagattctcaggatcaaaatcaggaacaagcgcaacattagtaataacaggactacaaacaggagacgaagcagatttctattgcggaacatgggacggaagcctaagaacaggaggagtaataggaacaggaacaagagtaacagtacta

SEQ ID NO: 48243 - RNA, 333 nt, synthetic construct
  misc_feature 1..333: note = derived and/or modified sequence opt6 from anti-HIV_119-080816_VR-Chain
  source 1..333: mol_type = other RNA
caactagtactaacacaaccaccatcagcatcaggaacaccaggacaaagagtaacaatatcatgctcaggatcatcatcaaacataggatcaaacttcgtatcatggtaccaacaaagaccaggaacagcaccaaaactactaatatacgaaacaaacaaaagaccatcaggaataccagacagattctcaggatcaaaatcaggaacatcagcaacactagcaataacaggactacaaacaggagacgaagcagactactactgcgcaacatgggcaccaagactaaactcagcaagagtattcggaaacggaacaatggtaacagtacta

SEQ ID NO: 48244 - RNA, 333 nt, synthetic construct
  misc_feature 1..333: note = derived and/or modified sequence opt6 from anti-HIV_119-079302_VR-Chain
  source 1..333: mol_type = other RNA
caatcagtactaacacaaccaccatcagtatcagcagcaccaggacaaaaagtaacaatatcatgctcaggatcatcatcatacataggaaacaaatacgtatcatggtaccaacaattcccaggaacagcaccaaaactattaatatacgaaaacaacaaaagactatcaggaataccagaccgattctcagcatcaaaatcagcaacatcagcaacactagcaataagcggactacaaacaggagacgaagcagacttctactgcggaacatgggacggatcactaagaacaggaggagtaataggaacaggaacaagagtaacagtacta

SEQ ID NO: 48245 - RNA, 327 nt, synthetic construct
  misc_feature 1..327: note = derived and/or modified sequence opt6 from anti-HIV_119-079292_VR-Chain
  source 1..327: mol_type = other RNA
caatcagtactaacacaaccaccaagcgtatcagcagcaccaggacaaaaagtaacaatatcatgctcaggatcaaactcaaacataggaaacaactacgtatcatggtaccaacaactaccaggaacagcaccaaaactactaatatacgacaacaacaaaagaccatcaggaataccagacagattctcaggatcaaaatcaggaacatcagcaacactaggaataacaggactacaaacaggagacgaagcaaactactactgcggaacatgggacacatcactatcaggagtattcggaacaggaacagaagtaatagtacta

SEQ ID NO: 48246 - RNA, 321 nt, synthetic construct
  misc_feature 1..321: note = derived and/or modified sequence opt6 from anti-HIV_119-079289_VR-Chain
  source 1..321: mol_type = other RNA
caatcagcactaacacaaccaccatcagtatcagcagcaccaggacaaagagtaacaatatcatgctcaggaaacaactcaaacataggaaacaacttcgtatcatggtaccaactactaccaggaacagcaccaaaactactaatatacgaaaacaacaaaagatcatcaggaataccagacagattctcaggatcaaaatcaggaacatcagcaacactaggaataacaggactacaaacaggagacgaagcagactacttctgctcaacatggtcaggatcactaaacttcggaacaggaacaagagtaacagtacta

SEQ ID NO: 48247 - RNA, 324 nt, synthetic construct
  misc_feature 1..324: note = derived and/or modified sequence opt6 from anti-HIV_119-078935_VR-Chain
  source 1..324: mol_type = other RNA
caatcagtattaacacaaccaccaagtgtaagtgcagcaccaggacaaagagtaacaataagctgtagcggaacatcagcaaatatagaaaactattacgtaagctggtaccaacaattaccaggaacagcaccaaaactaataatatatgacgataacaaaagaccaagcggaataccacaaagattctcaggatcaaaatcaggaacaagcgcaacattaggaataacaggactacaaacaggagacgaagcagaatactattgcgaaacatgggacggaagcggaggagtattcggaacaggaacaaaagtaacagtatta

SEQ ID NO: 48248 - RNA, 324 nt, synthetic construct
  misc_feature 1..324: note = derived and/or modified sequence opt6 from anti-HIV_119-078702_VR-Chain
  source 1..324: mol_type = other RNA
caatcagtactaacacaaccaccatcagtatcagcagcaccaggacaaaaagtaacaatatcatgctcaggatcatcatcagtattcggaaaaaactacgtatcatggtaccaacacctaccaggaacagcaccaaaactactaatatacgaaaacacaaaaagaccatcaggaataccagacagattctcaggatcaaaatcaggaacatcagcaacactagcaataacaggactacaaacaggagacgaagcagactactactgcgaaacatgggacggatcaggaggagtattcggatcaggaacaaaagtaacagtacta

SEQ ID NO: 48249 - RNA, 324 nt, synthetic construct
  misc_feature 1..324: note = derived and/or modified sequence opt6 from anti-HIV_119-078593_VR-Chain
  source 1..324: mol_type = other RNA
caatcattcctaacacaaccaccatcagtatcagcagcaccaggacaaaaagtaacaataagctgctcaggatcaaactcaaacataggaaacaactacgtatcatggtaccaacaagtaccaggaacagcaccaaaactactaatatacgaaaacaacaaaagaccatcaggaataccagacagattctcaggatcaaaatcaggaacatcagcaacactagtaataacaggactacacacaggagacgaagcagactactactgcgaaacatgggacggatcaggaggagtattcggaacaggatcaaacgtaacactacta

SEQ ID NO: 48250 - RNA, 333 nt, synthetic construct
  misc_feature 1..333: note = derived and/or modified sequence opt6 from anti-HIV_119-077708_VR-Chain
  source 1..333: mol_type = other RNA
caatcagtattaacacaaccaccaagtttaagcgcagcaccaggacaaaaagtaacaataagctgtagcggaacaacaagcaatataggaaacaattacgtaagctggtaccaacacctaccaggaacagcaccaaaactattaatatatgaaaatacaaaaagaccaagcggaataccagacagattctcaggatcaaaatcaggaacaagcgcaacattaggaataacaggactacaaacaggagacgaagcagattactattgcacagtatggggagtaagaaaaggagtaggagcagtatttggaacaggaacaaaagtaacagtacta

SEQ ID NO: 48251 - RNA, 321 nt, synthetic construct
  misc_feature 1..321: note = derived and/or modified sequence opt6 from anti-HIV_119-076904_VR-Chain
  source 1..321: mol_type = other RNA
caatcagtattaacacaaccaccatcagtatcagcagcaccaggacaaaaagtaacaatatcatgctcaagatcatcatcacacatagaaaactcatacgtatcatggtaccaacacctaccaggaacagcaccaaaactactaatatacgaaaacaacaaaagaccatcaggaataccagacagattctcaggctcaaaatcaggaacatcagcaacactaggaatatccggactacaaacaggagacgaagcagactacttctgctcaacatggtcaggatcattaaacttcggaacaggaacaagagtaacagtacta

SEQ ID NO: 48252 - RNA, 324 nt, synthetic construct
  misc_feature 1..324: note = derived and/or modified sequence opt6 from anti-HIV_119-075862_VR-Chain
  source 1..324: mol_type = other RNA
caatcagtactaacacaaccaccatcaatatcagcagcaccaggacaaaaagtaacaatatcatgctcaggatcagcatcaaacataggaaaaaactcagtatcatggtaccaacaattcccaggaacagcaccaaaactactaatatacgaaaacaacagaagaccatcaggaacaccagacagattctcaggatcaaaatcaggaacatcagcaacactagcaataacaggactacaaacaggagacgaagcagactactactgcgaaacatgggacggatcaggaggagtattcggaacaggaacaaaagtaacagtacta

SEQ ID NO: 48253 - RNA, 333 nt, synthetic construct
  misc_feature 1..333: note = derived and/or modified sequence opt6 from anti-HIV_119-075465_VR-Chain
  source 1..333: mol_type = other RNA
caatcagtattaacacaaccaccaagcgtaagtgcagcaccaggacaaaaagtagtaataagctgtagtggaagctcaagcataataggaaacaattacgtaagctggtaccaacaattaccaggaacagcaccaaaactattaatatatgaaaataacagaagaccgagcggaataccagacagattctcaggatcaaaatcaggaacaagcgcaacattagcaataagcggactacaaacaggagacgaagcagattactgttgcgcagtatggggagtaagaagaggagcaggagcagtatttggagcaggaacaaaagtaacagtacta

SEQ ID NO: 48254 - RNA, 330 nt, synthetic construct
  misc_feature 1..330: note = derived and/or modified sequence opt6 from anti-HIV_119-074822_VR-Chain
  source 1..330: mol_type = other RNA
tcagtattaacacaaccaccaagcgtaagcgcagcaccaggacaaaacataacaataagctgtagcggaggatcaagtaatatagcaaaaaattacataagctggtaccaacacttaccaggaacagcaccaaaaatagtaatatatgacaatgacaaaagaccactaggaataccagacagattctcagcatcaaaatcaggaacaagtgcaacattaggaataacaggattacaaacaggagacgaagcagattactattgcgcagtatggggagtaagaagaggagtaggagcagtatttggagcaggaacaaaagtaatagtacta

SEQ ID NO: 48255 - RNA, 333 nt, synthetic construct
  misc_feature 1..333: note = derived and/or modified sequence opt6 from anti-HIV_119-074629_VR-Chain
  source 1..333: mol_type = other RNA
caatcagtattaacacaaccaccaagcgaaagtgcagcaccaggacaaaaagtaacaataagttgtagcggaggaacaagcaatataggaaacaattacgtaagctggtacagaagattaccaggaacagcaccaaaactattaatatatgaaaataacaggagaccaagcggaataccagacagattctcaggatcaaaatcaggaacaagcgcaacattagcaataagcggactacaaacaggagacgaagcagattactgttgcgcagtatggggagtaagaagaggagcaggagcagtatttggagcaggaacaaaagtaacagtacta

SEQ ID NO: 48256 - RNA, 324 nt, synthetic construct
  misc_feature 1..324: note = derived and/or modified sequence opt6 from anti-HIV_119-074500_VR-Chain
  source 1..324: mol_type = other RNA
caatcagtactaacacaaccaccatcagtatcagcagcaccaggacaaaaagtaacaatgtcatgctcaggatcatcatcaaacataggaaacaactacgtatcatggtaccaatacctaccaggaacagcaccaaaactactaatatacgaaaacgacagaagaccatcaggaataccagacagattctcagcatcaaaatcaggcacatcagcaacactagcaataacaggactacaaacaggagacgaagcagactactactgcgaaacatgggacggatcaggaggagtattcggaacaggaacaaaagtaacagtacta

SEQ ID NO: 48257 - RNA, 333 nt, synthetic construct
  misc_feature 1..333: note = derived and/or modified sequence opt6 from anti-HIV_119-073911_VR-Chain
  source 1..333: mol_type = other RNA
caatcagtattaacacaaccaccaagcgtaagcgcagcaccaggacaaagagtaacaataagctgtagcggaagctcaagcaatatagaaaacaattacgtaagctggtaccaacacttaccaggaacagcaccaaaactattagtatatgacgataacaaaagaccaagcggaataccacacagattctcagcatcaaaatcaggaacaagcgcaacactagcaataacaggactacaaaccggagacgaagcagattactattgcacactatggggagtaagaaaaggagtaggagcagtatttggaacaggaacaaaagtaacagtacta

SEQ ID NO: 48258 - RNA, 324 nt, synthetic construct
  misc_feature 1..324: note = derived and/or modified sequence opt6 from anti-HIV_119-072765_VR-Chain
  source 1..324: mol_type = other RNA
caatcagtactaacacaaccaccatcagtaagcgcagcaccaggacaaaaagtaacaatatcatgctcaggaaactcatcaaacataggaaataacttcgtatcatggtatcaacaagtaccaggaacagcaccaaaactactagtatacgaaacatacagaagaccatcaggaacaccagacagattctcaggatcaaaatcaggaacatcagcaacactagcaatatcaggactacaaacaggagacgaagcagactactactgcggaacatgggacggatcaggaggagtattcggaacaggaacaaaagtaacagtacta

SEQ ID NO: 48259 - RNA, 333 nt, synthetic construct
  misc_feature 1..333: note = derived and/or modified sequence opt6 from anti-HIV_119-072313_VR-Chain
  source 1..333: mol_type = other RNA
caatttgtattaacacaaccaccaagcgtaagcgcagcaccaggacaaaaagtaacaataagctgtagcgcaagctcaagcataataggaaaaaattacgtaagctggtaccaacaatttccaggaacagcaccaaaactattaatatatgaagataacaaaagaccaagcggaataccagacagattctcaggatcaaaatcaggaacaagcgcaacattagcaataacaggactacaaacaggagacgaagcagattactattgcacagtatggggagtaagaaaaggagtaggagcagtatttggaacaggaacaaaagtaacagtacta

SEQ ID NO: 48260 - RNA, 333 nt, synthetic construct
  misc_feature 1..333: note = derived and/or modified sequence opt6 from anti-HIV_119-072280_VR-Chain
  source 1..333: mol_type = other RNA
caatcagtactaacacaaccaccatcagtatcagcagcaccaggacaaaaagtatcaatatcatgctcaggatcagactcaaacctaggagacaactacgtatcatggtaccaacaattcccaggaacagcaccaaaactactaatacacgacaacaataaaagaccatccggaacaccagacagattctcaggatcaaaatcaggaacatcagcaacactagcaataacaggactacaaacaggagacgaagccgactactactgcgcaacatgggcaccaagactaaactcagcaagagtattcggaaacggaacaatggtaacagtacta

SEQ ID NO: 48261 - RNA, 333 nt, synthetic construct
  misc_feature 1..333: note = derived and/or modified sequence opt6 from anti-HIV_119-071693_VR-Chain
  source 1..333: mol_type = other RNA
caatcagtattaacacaaccaccaagcgtaagcgcagcaccaggacaaaaagtagtaataagctgtagcggaagctcaagcataatagaaaaaaatagcataagctggtaccaacaaggaccaggagcagcaccaaaattattaatatatgaaaatgacaaaagaccaagcggaataccagacagattctcaggatcaaaatcaggaacaagcgcaaccttagcaataacaggactacaaacaggagacgaagcagattactattgcacaatatggggagtaagaaaaggagtaggagcagtatttggaacaggaacaaaagtaacagtacta

SEQ ID NO: 48262 - RNA, 321 nt, synthetic construct
  misc_feature 1..321: note = derived and/or modified sequence opt6 from anti-HIV_119-071353_VR-Chain
  source 1..321: mol_type = other RNA
caatcagtactaacacaaccaccatcagcatcagcagcaccaggacaaaaagtaacaatatcatgctcaggatcaaattcaaacatcggaaacaacttcgtatcatggtaccaactattcccaggaacagcaccaaaactactaatatttgaaaacaacaaaagaccctcaggaataccagacagattctcaggagccaaatccggaacatcagcaacactagcaataacaggactacaaacaggagacgaagcagactacttctgctcaacatggtcaggatcactaaacttcggaacaggaacaagagtaacagtacta

SEQ ID NO: 48263 - RNA, 324 nt, synthetic construct
  misc_feature 1..324: note = derived and/or modified sequence opt6 from anti-HIV_119-069711_VR-Chain
  source 1..324: mol_type = other RNA
caatcagtactaacacaaccaccatcagtatcagcagcaccaggacaaaaagtaacaatatcatgctcaggatcatcatcaaacataggaaacaactacgtatcatggtaccaacaactaccaggaacagcaccaaaactactaatatacgacaacaacaacagaccatcaggagtaccagacagattctcaggatcaaaatcaggaacatcagcaacactagcaataacaggactacaaacaggagacgaagcagactactactgcgaaacatgggacgactcaggaggagtattcggaacaggaacaaaagtaacagtatta

SEQ ID NO: 48264 - RNA, 333 nt, synthetic construct
  misc_feature 1..333: note = derived and/or modified sequence opt6 from anti-HIV_119-069061_VR-Chain
  source 1..333: mol_type = other RNA
caatcagtactaacacaaccaccatcagtatcagcagcaccaggacaaaaagtaacaatatcatgctcaggatcatcatcaaacataggatcaaactacgtatcatggtaccaacaactaccaggaacagcaccaaaactactagtatacgacaacaacgaaagaccatcaggaataccagacagattctcaggatcaaaatcaggaacatcagcaacactagcaataacaggactacaaacaggagacgaagcagactactactgcgcaacatgggcaccaagactaaactcagcaagagtattcggaaacggaacaatggtaacagtacta

SEQ ID NO: 48265 - RNA, 324 nt, synthetic construct
  misc_feature 1..324: note = derived and/or modified sequence opt6 from anti-HIV_119-068202_VR-Chain
  source 1..324: mol_type = other RNA
caaagcgtactaacacaagaaccatcagtatcaggagcaccaggacaaagagtaacaatatcatgcacaggatcaaactcaaacataggaggacacgatgtacattggtatcaacaactaccaggaacagcaccaaaattattaatatacgataacgataaaagaccatcaggaataccagatagatttagcggaagcaaaagcgatacatcagcatcactaggaataacaggattacaaacaggagatgaagcagactattactgtgaaacatgggatggatcaggaggagtatttggaacaggaacaaaagtaacagtacta

SEQ ID NO: 48266 - RNA, 324 nt, synthetic construct
  misc_feature 1..324: note = derived and/or modified sequence opt6 from anti-HIV_119-068063_VR-Chain
  source 1..324: mol_type = other RNA
caaagcgcactaacgcaaccaccatcagcatcaggatcactaggacaatcagtaacaatatcatgcacaggaacaagatcagacgtaggaaattactatgtatcatggtatcaacaactaccaggaacagcaccaaaattactaataagcgaaaacaatagaagaccatcaggaacaccagatagatttagcggaagcaaaagcggaacatcagcaacactagcaatatcaggattacaaacaggagatgaagcagactattactgtggaacatgggatggatcaggaggagtatttggaacaggaacaaaagtaacagtacta

SEQ ID NO: 48267 - RNA, 333 nt, synthetic construct
  misc_feature 1..333: note = derived and/or modified sequence opt6 from anti-HIV_119-067980_VR-Chain
  source 1..333: mol_type = other RNA
caatcagtattaacacaaccaccaagcgtaagcgcagcaccaggacaaaaagtaacaataagctgtagcggaaactcaagtaatataggaaacaatttcgtaagctggtaccaacaagtaccaggaacagcaccaaaactattagtatatgaaacatacagaagaccaagcggaataccagacagattctcaggatcaaaatcaggaacaagcgcaacattagcaataacaggactacaaacaggagacgaagcagattaccattgcgcaatatggggagtaagaaaaggagtaggagcagtatttggaacaggaacaaaagtaacagtagta

SEQ ID NO: 48268 - RNA, 324 nt, synthetic construct
  misc_feature 1..324: note = derived and/or modified sequence opt6 from anti-HIV_119-067866_VR-Chain
  source 1..324: mol_type = other RNA
caatcagtactaacacaaccaccatcagtatcagcagcaccaggacaaaaagtaacaatatcatgctcaggatcaacatcaacaataggaaacaactacgtatcatggtaccaacacctaccaggaacagcaccaaaattactaatatacgacaacaacaaaagaccagcaggaataccagacagattcacagcaagcaaatcaggaacatcagcaacactagcaataacaggactacacacaggagacgaagcagactactactgcgaaacatgggacggatcaggaggagtattcggaacaggaacaaaagtaacagtacta

SEQ ID NO: 48269 - RNA, 321 nt, synthetic construct
  misc_feature 1..321: note = derived and/or modified sequence opt6 from anti-HIV_119-067756_VR-Chain
  source 1..321: mol_type = other RNA
caatcagtactaacacaaccaccatcagtatcagcagcaccaggacaaaaagtagtaatatcatgctcaggatcaacatcaaacataggaaaaaacttcgtaagctggtaccaacaactaccaggaacagcaccaaaactactaatatacgaaaactcaagaagaccatcaggaataccagacagattctcaggagcaaaatcaggaacatcagcaacactagcaataacaggactacaaacaggagacgaagcagactacttctgctcaacatggtcaggatcattaaacttcggaacaggaacaagagtaacagtacta

SEQ ID NO: 48270 - RNA, 321 nt, synthetic construct
  misc_feature 1..321: note = derived and/or modified sequence opt6 from anti-HIV_119-066859_VR-Chain
  source 1..321: mol_type = other RNA
caatcagtattaacacaaccaccatcagtatcagcagcaccaggacaaaaagtaacaataacatgctcaggatcagcatcaaacatagaaaacaactacgtatcatggtaccaacaattcccaggaccagcaccaaaactactaatatacgaaaacgacaaaagaccatccggaataccagacagattctcaggatcagcatcaggaacatcagcaacactagcaataacaggactacaaacaggagacgaagcagactacttctgctcaacatggtcaggatcactaaacttcggaacaggaacaagagtaacagtacta

SEQ ID NO: 48271 - RNA, 333 nt, synthetic construct
  misc_feature 1..333: note = derived and/or modified sequence opt6 from anti-HIV_119-065821_VR-Chain
  source 1..333: mol_type = other RNA
caatcagtattaacacaaccaccaagcgtaagcgcaacaccaggacaaagagtaacagtaagctgtagcggaagctcaagcaatataggaaaccattacgtaagctggtaccaacaagtaccaggaacagcaccaaaactattaatatatgacaatagcaatagaccaagcggaataccagacagattctcaggatcaaaatcaggaacaagcgcaacattaggaataacaggactacaaacaggagacgaagcagattactattgcacagtatggggagtaagaaaaggagtaggagcagtatttggaacaggaacaaaagtaacagtacta

SEQ ID NO: 48272 - RNA, 333 nt, synthetic construct
  misc_feature 1..333: note = derived and/or modified sequence opt6 from anti-HIV_119-065191_VR-Chain
  source 1..333: mol_type = other RNA
caatcagtactaacacaaccaccatcagtctcagcagcaccaggacaaaaagtaacaatatcatgctcaggaaacaactcaaacataggaaacaactacgtatcatggtaccaacaactaccaggaacagcaccaaaactattaatattcgaaaaccacaaaagaccatcaggaataccagacagattcagcggatcaaaatcaggaacatcagcaacactaggaataacaggactacaatcaggagacgaagcagactactactgcgcaacatgggcaccaagactaaactcagcaagagtattcggaacaggaacaaaagtaacagtacta

SEQ ID NO: 48273 - RNA, 333 nt, synthetic construct
  misc_feature 1..333: note = derived and/or modified sequence opt6 from anti-HIV_119-064667_VR-Chain
  source 1..333: mol_type = other RNA
caatcagtactaacacaaccaccatcagtatcagcagcaccaggacaaaaagtaacaatatcatgctcaggatcaaactcatacataggaaacaaatacgtatcatggtaccaacaagtaccaggaacagcaccaaaactattaatatacgaaaacaacaaaagaccatcaggaataccagacagattctcaggatcaaaatcaggaacatcagcaacattagtaataacaggactacaaacaggagacgaagcagacttctactgcggaacatgggacggatcactaagaacaggaggagtaataggaacaggaacaagagtaacagtacta

SEQ ID NO: 48274 - RNA, 324 nt, synthetic construct
  misc_feature 1..324: note = derived and/or modified sequence opt6 from anti-HIV_119-063791_VR-Chain
  source 1..324: mol_type = other RNA
caatcagtactaacacaaccaccatcagtatcagcagcaccaggacaaaaagtaccaatatcatgctcaggaaactcatcaaacataggaaacaactacgtatcatggtaccaacaactaccaggaacagcaccaaaactattaatatacgaaaacaacaaaagaccatcaggaataccagacagattctcaggatcaaaatcaggaacatcagcaacactagcaataacaggactacacacaggagacgaagcagactactactgcgaaacatgggacggatcaggaggagtattcggaacaggaacaaaagtaacagtacta

SEQ ID NO: 48275 - RNA, 333 nt, synthetic construct
  misc_feature 1..333: note = derived and/or modified sequence opt6 from anti-HIV_119-062989_VR-Chain
  source 1..333: mol_type = other RNA
caatcagtattaacacaaccaccaagcgtaagcgcagcaccaggacaaagagtaacaataagctgtagcggaagctcatcaaatataggaaacaatttcgtaagctggtaccaacaatttccaggaacagtaccaaaactattaatatatgaaaataacagaagaccaagcggaataccagacagattcagtggatcaaaatcaggaacaagcgcaacattagcaataacaggactacaaacaggagacgaagcagattactattgcgcagtatggggagtaagaagaggagtaggagcagtatttggagcaggaacaaaagtaatagtacta

SEQ ID NO: 48276 - RNA, 321 nt, synthetic construct
  misc_feature 1..321: note = derived and/or modified sequence opt6 from anti-HIV_119-062286_VR-Chain
  source 1..321: mol_type = other RNA
caatcagtattaacacaaccaccaagcgtaagcgcagcaccaggacaaaaagtaacaataagctgtagcggaagcgcaagcaatataggaaaaaatttcgtaagctggtaccaacaattaccaggaacagcaccaaaactattaatatcagaaaataacagacgaccaagcggaacaccagacagattctcaggatcaaaatcaggagcaagcgcaacattagtaataagcggactacaaacaggagacgaagcagattactattgcgcaacatggagcggaagcttaagcataggaacaggaacaaaagtaacagtacta

SEQ ID NO: 48277 - RNA, 321 nt, synthetic construct
  misc_feature 1..321: note = derived and/or modified sequence opt6 from anti-HIV_119-061416_VR-Chain
  source 1..321: mol_type = other RNA
caatcagtactaacacaaccaccatcagtatcagcagcaccaggacaaaaagtagtaatatcatgctcaggaagctcatcaatattcgaaaaaaactcaatatcatggtaccaacaaggaccaggagcagcaccaaaactactaatatacgaaaacgacaaaagaagatcaggaataccagacagattctcaggatcaaaatcagcaacatcaacaacactagcaatagtaggactacaaacaggagacgaagcagactacttctgctcaacatggtcaggatcactaaacttcggaacaggaacaagagtaacagtacta

SEQ ID NO: 48278 - RNA, 321 nt, synthetic construct
  misc_feature 1..321: note = derived and/or modified sequence opt6 from anti-HIV_119-061344_VR-Chain
  source 1..321: mol_type = other RNA
caatcagtactaacacaaccaccatcagtatcagcagcaccaggacaaaaagtaacaatatcatgctcaggatcatcatcagtattcggaaaaaactacgtatcatggtaccaacacctaccaggaacagcaccaaaactactaatatacgaaaacaacaaaagaccatcaggaataccagacagattctcaggagcaaaatcaggaacagcagcaacactagcaataacaggactacaaacaggagacgaagcagactactactgcgcaacatggtcaggatcactaaacttcggaacaggaacaaaagtaacagtacta

SEQ ID NO: 48279 - RNA, 324 nt, synthetic construct
  misc_feature 1..324: note = derived and/or modified sequence opt6 from anti-HIV_119-060240_VR-Chain
  source 1..324: mol_type = other RNA
caatcagtattaacacaaccaccatcagaatacggagcaccaggacataacgtaacagtaagctgtagcggaacaacaagcaatatagaaaacaatttcgtaagctggtacttaatagtaccaggaacagcaccaaaactattaatatttgacaatgacaaaagaccaagcggaataccagacagattctcaggatcaaaatcaggaacaagcgcaacattagcaataacaggactacaaacaggagacgaagcagattactattgcgcaacatgggacggaagagtaagcgtaataggaacaggaacaaaagtaacagtatta

SEQ ID NO: 48280 - RNA, 333 nt, synthetic construct
  misc_feature 1..333: note = derived and/or modified sequence opt6 from anti-HIV_119-060184_VR-Chain
  source 1..333: mol_type = other RNA
caatcagtactaacacaaccaccatcagtatcaggagcaccaggacaaagagtaacaatatcatgctcaggatcatcatcaaatataggatcaaacacagtaaactggtaccaacaactaccaggaacagcaccaaaattactaatatacgacaacaacaaaagaccatcaggaataccagacagattctcaggatcaaaatcaggaacatcagcaacattagtaataacaggactacaaacaggagacgaagcagacttctactgcggaacatgggacggatcactaagaacaggaggagtaataggaacaggaacaagagtaacagtacta

SEQ ID NO: 48281 - RNA, 321 nt, synthetic construct
  misc_feature 1..321: note = derived and/or modified sequence opt6 from anti-HIV_119-058035_VR-Chain
  source 1..321: mol_type = other RNA
caatcagtactaacacaaccaccatcagtatcagcagcaccaggacaaaaagtaacaatatcatgctcaggatcagcatcaaacataggaaaaaacttcgtatcatggtaccaacaattaccaggaacagcaccaaaactactaatatacgaaaacaacagaagaccatcaggaaccccagacagattctcaggagcaaaatcaggaacatcagcaacactagcaataacaggactacaaacaggagacgaagcagactacttctgctcaacatggtcaggatcactaaacttcggaacaggaacaagagtaacagtacta

SEQ ID NO: 48282 - RNA, 321 nt, synthetic construct
  misc_feature 1..321: note = derived and/or modified sequence opt6 from anti-HIV_119-057858_VR-Chain
  source 1..321: mol_type = other RNA
caatcagtattaacacaaccaccatcagtatcagcagcaccaggacaaaacgtaaacatatcatgctcaggaggatcatcaaacataggatcaaactacgtatcatggtaccaacaattcccaggaacagcaccaaaactactaatatacgaaaacaacaaaagaccatcaggaataccagacagattctcaggagcaaaatcaggaacatcagcaacactagcaataacaggactacaaacaggagacgaagcagactacttctgctcaacatggtcaggatcactaaacttcggaacaggaacaagagtaacagtacta

SEQ ID NO: 48283 - RNA, 324 nt, synthetic construct
  misc_feature 1..324: note = derived and/or modified sequence opt6 from anti-HIV_119-057473_VR-Chain
  source 1..324: mol_type = other RNA
caaagcgtactaacacaaccaccatcagtatcagcagcaccaggacaaaaagtaacaatatcatgctcaggatcaagctcaaacataggaaataactatgtatcatggtatcaacatctaccaggaacagcaccaaaattactaatatacgatacatatagtagaccatcaggaataccagatagatttagcggaagcaaaagcggaacatcagcaacactagcaataacaggattacaaacaggagatgaagcagactattactgtggaacatgggatggatcaggaggagtatttggaacaggaacaaaagtaacagtacta

SEQ ID NO: 48284 - RNA, 321 nt, synthetic construct
  misc_feature 1..321: note = derived and/or modified sequence opt6 from anti-HIV_119-057090_VR-Chain
  source 1..321: mol_type = other RNA
caatcagtactaacacaaccaccatcagtatcagcagcaccaggacaaacagtaacaatatcatgctcaggatcaacatcaaacataggaaaaaacgacgtatcatggtaccaacaactaccaggaacagcaccaaaactactaatatcagaaaacaacagaagaccatcaggaacaccagacagattcagcgcatcaaaatcaggaacatccgcaacactagcaataacaggactacaaacaggagacgaagcagactacttctgctcaacatggtcaggatcattaaacttcggaacaggaacaagagtaacagtacta

SEQ ID NO: 48285 - RNA, 333 nt, synthetic construct
  misc_feature 1..333: note = derived and/or modified sequence opt6 from anti-HIV_119-055754_VR-Chain
  source 1..333: mol_type = other RNA
caatcagtactaacacaaccaccatcagtatcagcagcaccaggacaaaaagtaacaatatcatgttcaggaaactcatcatcaataggaaacaacttcgtatcatggtaccaacaactaccaggaacagcaccaaaactactagtatacgaaaattacagaagaccatcaggaataccagacagattctcaggatcaaaatcaggaacatcagcaacactagcaatagacggactacaaacatgggacgaagcagactaccactgcgcaatatggggagtaagaaaaggagtaggagcagtattcggaacaggaacaaaagtaacagtagta

SEQ ID NO: 48286 - RNA, 324 nt, synthetic construct
  misc_feature 1..324: note = derived and/or modified sequence opt6 from anti-HIV_119-054899_VR-Chain
  source 1..324: mol_type = other RNA
caatcagtactaacacaaccaccatcagtatcagcagcaccaggacaaaaagtaacaatatcatgctcaggatcaaactcatacataggaaacaaatacgtatcatggtaccaacaattcccaggaacagcaccaaaactactaatacacgaaaacaacagaagaccatcaggaacaccagacagattctcaggatcaaaatcaggaacatcagcaacactagcaatatcaggactacaaacaggagacgaagcagactactactgcgaaacatgggacggatcaggaggagtattcggaacaggaacaaaagtaacagtacta

SEQ ID NO: 48287 - RNA, 324 nt, synthetic construct
  misc_feature 1..324: note = derived and/or modified sequence opt6 from anti-HIV_119-054501_VR-Chain
  source 1..324: mol_type = other RNA
caatcagtactaacacaaccaccatcagtatcagcagcaccaggacaaaaagtaacaatatcatgctcaggaacatcatcaaacataggaaacaactacgtatcatggtaccaacacctaccaggaacagcaccaaaactactaatattcgaaacaaacaaaagaccatcaggaataccagacagattctcagcatcaaaatcaggaacatcagcaacactagcaataacaggactacaaacaggagacgaagcagactactactgcgaaacatgggacggatcaggaggagtattcggaccaggaacaagagtaacagtatta

SEQ ID NO: 48288 - RNA, 324 nt, synthetic construct
  misc_feature 1..324: note = derived and/or modified sequence opt6 from anti-HIV_119-051867_VR-Chain
  source 1..324: mol_type = other RNA
caaagcgtactaacacaaccaccatcagtatcagcagcaccaggacaaaaagtaacaatatcatgctcaggaaactcatcaaacataggaaacaacttcatatcatggtaccaacaactaccaggaacagcaccaaaactattaatatacgaaaacgacagaagaccatcaggaacaccagacagattctcaggatcaaaatcaggaacatcagcaacactagcaataacaggactacaaacaggagacgaagcagactactactgcgaaacatgggacggatcaggaggagtattcggaacaggaacaaaagtaacagtacta

SEQ ID NO: 48289 - RNA, 324 nt, synthetic construct
  misc_feature 1..324: note = derived and/or modified sequence opt6 from anti-HIV_119-051814_VR-Chain
  source 1..324: mol_type = other RNA
caatcagtactaacacaaccaccatcagtatcagcagcaccaggacaaaaagtaacaatatcatgctcaggatcaaactcaaacataggaaacaaagacgtatcatggtaccaacaaataccagcaacagcaccaaaactactaatatacgaaaacaacaaaagaccatcaggaataccagacagattctcaggatcaaaatcaggaacatcagcaacactagcaataacaggactacaaacaggagacgaagcagactactactgcgcaacatgggacggaagagtatcagtaataggaacaggaacaaacgtaatagtacta

SEQ ID NO: 48290 - RNA, 321 nt, synthetic construct
  misc_feature 1..321: note = derived and/or modified sequence opt6 from anti-HIV_119-051567_VR-Chain
  source 1..321: mol_type = other RNA
caatcagtactaacacaaccaccatcagtatcagcagcaccaggacaaaaagtaacaatatactgctcaggatcaagatcaaacataggaagaaactacgcatcatggtaccaacaactaccaggaacagcaccaaaactactaatattcgacaacaacagaagaccatcaggaataccagacagattctcaggagcaaaatcaggaacatcagcaacactagcaataacaggactacaaacaggagacgaagcagactacttctgctcaacatggtcaggatcactaaacttcggaacaggaacaagagtaacagtacta

SEQ ID NO: 48291 - RNA, 324 nt, synthetic construct
  misc_feature 1..324: note = derived and/or modified sequence opt6 from anti-HIV_119-051483_VR-Chain
  source 1..324: mol_type = other RNA
caatcagtactaacacaaccaccatcagtatcagcagcaccaggacaaaaactaacaatatcatgctcaggaacatcatcaaacataggaaacaactacgtatcatggtaccaacacctaccaggaacagcaccaaaactactaatatacgaaaacaacagaagaccatcaggaataccagaaagattctcagcatcaaaatcaggaacatcagcaacactaggaataacaggactacaaacaggagacgaagcagactactactgcgaaacatgggacgactcaggaggagtattcggaacaggaacaaaagtaacagtacta

SEQ ID NO: 48292 - RNA, 333 nt, synthetic construct
  misc_feature 1..333: note = derived and/or modified sequence opt6 from anti-HIV_119-050913_VR-Chain
  source 1..333: mol_type = other RNA
caatcagtattaacacaaccaccaagcgtaagcgcagcaccaggacaaaaagtaacaataagctgtagtggaggaacaagcaatataggaaacaattacgtaagctggtaccaacaattaccaggaacagcaccaagactattaatatatgaaacaaacaaaagaccaagcggaataccagacagattctttggatcaaaatcaggaacaagcgcaacattagcaataagcggactacaaacaggagacgaagcagattactattgcacagtatggggagtaagaaaaggagtaggagcagtatttggaacaggaacaaaagtaacagtatta

SEQ ID NO: 48293 - RNA, 333 nt, synthetic construct
  misc_feature 1..333: note = derived and/or modified sequence opt6 from anti-HIV_119-050187_VR-Chain
  source 1..333: mol_type = other RNA
caatcagtactaacacaaccaccatcagtatcagcagcaccaggacaaaaagtaacaatatcatgctctggatcatcatcaaacataggaaaaaactcagtatcatggtaccaacaattcccaggaacagcaccaaaactactaatatacgaaaacaacaaaagaccatcaggaataccagacagattctcagactcacaatcaggaacatcagcaacactagcaataacaggactacaaacaggagacgaagcagactactcatgcgcaacatgggcagcatcactaaactcagcaagagtattcggaacaggaacaagagtaacagtacta

SEQ ID NO: 48294 - RNA, 324 nt, synthetic construct
  misc_feature 1..324: note = derived and/or modified sequence opt6 from anti-HIV_119-049069_VR-Chain
  source 1..324: mol_type = other RNA
caaagcgtactaacacaaccaccatcagtatcagcagcaccaggacaaaaagtaacaatatcatgctcaggatcaacatcaaacataggaaaaagcgatgtattttggtatcaacaactaccaggaacagcaccaaaattactaataagcgaaacatcaagaagaccatcaggaacaccagacagatttagcggaagcaaaagcggaacatcagcaacactaacaataacaggattacaaacaggagatgaagcagactattactgtgaagcatgggacggatcaggaggagtatttggaacaggaacaaaagtaacagtacta

SEQ ID NO: 48295 - RNA, 333 nt, synthetic construct
  misc_feature 1..333: note = derived and/or modified sequence opt6 from anti-HIV_119-048517_VR-Chain
  source 1..333: mol_type = other RNA
caatcagtattaacacaaccaccaagcgtaagcgcagcaccaggacaaaaagtaacaataagctgtagcggaagcaaattcaatataggaaacaaagacgtaagttggtaccaacactcaccaggaacagcaccaaaactattaatatatgaaaataacaaaagaccaagcggaataccagacagattctcaggatcaaaatcaggaacaagtgcaacattaggaataagcggactacaaacaggagacgaagcagattactgttgcgcagtatggggagtaagaagaggagcaggagcagtatttggagcaggaacaaaagtaacagtacta

SEQ ID NO: 48296 - RNA, 333 nt, synthetic construct
  misc_feature 1..333: note = derived and/or modified sequence opt6 from anti-HIV_119-048470_VR-Chain
  source 1..333: mol_type = other RNA
caatcagtattaacacaaccaccaagcgtaagcgcagcaccaggacaaaaagtaacaataagctgtagcggaagcacaagcaatataggaaaaaatctagtaagctggtaccaacaatttccaggaacagcaccaaaactattaatatatgaaaataacagaagaccaagcggaataccagacagattctcaggatcaaaatcaggaacaagcgcaacattagtaataacaggactacaaacaggagacgaagcagatttctattgcggaacatggggaggatcactaagagcaggaggagtaataggaacaggaacaagagtaacagtacta

SEQ ID NO: 48297 - RNA, 282 nt, synthetic construct
  misc_feature 1..282: note = derived and/or modified sequence opt6 from anti-HIV_119-048303_VR-Chain
  source 1..282: mol_type = other RNA
tcagtactaacacaaccaccatcagtatcagcagcaccaggacaaaacataacaatatcatgctcaggatcaatatcaaacatagcatcaaacttcatatcatggtaccaacaactaccaggaacagcaccaaaaataataatatacgacaacgaccaaagaccactaggaataccagcaagattctcaggatcaaaatcaggagcatcagcaacactagtaataacaggactacaaacaggagacgaagcagactactactgcggaacatgggacggatca

SEQ ID NO: 48298 - RNA, 333 nt, synthetic construct
  misc_feature 1..333: note = derived and/or modified sequence opt6 from anti-HIV_119-048021_VR-Chain
  source 1..333: mol_type = other RNA
caatcagtactaacacaaccaccatcagtatcagcagcaccaggacaaaaagtaacaatatcatgctcaggatcaagctcaaacataggaaacaactacgtatcatggtaccaacaactaccaggaacagcaccaaaactactaatatacgacaacaacaaaagaccatcaggaataccagacagattctcaggatcaaaatcaggaacaagcgcaacattagtaataacaggactacaaacaggagacgaagcagacttctactgcggaacatgggacggatcactatcaggaggaggagtaataggaacaggaacaagagtaacagtacta

SEQ ID NO: 48299 - RNA, 324 nt, synthetic construct
  misc_feature 1..324: note = derived and/or modified sequence opt6 from anti-HIV_119-047928_VR-Chain
  source 1..324: mol_type = other RNA
caaagcgtactaacacaaccaccatcagtatcagcagcaccaggacaaaaagtaacaatatcatgctcaggatcaaactcaaacataggaaacaactgcgtatcatggtaccaacaagtaccaggaacagcaccaaaactactaatatacgaaaacaacagaagaccatcaggaataccagacagattctcaggatcaaaatcaggaacatcagcaacactagcaatatcaggactacaaacaggagacgaagcagactactactgcggaacatgggacggatcaggaggagtattcggaacagcaacaaaagtaacagtacta

SEQ ID NO: 48300 - RNA, 324 nt, synthetic construct
  misc_feature 1..324: note = derived and/or modified sequence opt6 from anti-HIV_119-047384_VR-Chain
  source 1..324: mol_type = other RNA
caatcagtactaacacaaccaccatcagtatcagcagcaccaggacaaaaagtaacaatatcatgctcaggatcaaactcaaacataggaaacaaagacgtatcatggtacagacaagtaccaccaacagcaccaaaactactaatatacgaaaacaacaaaagaccatcaggaataccagacagattctcaggatcaaaatcaggaacatcagcaacactagcaataacaggactacaaacaggagacgaagcagactactactgcgcaacatgggacggaagagtatcagtattcggaacaggaacaaaagtagcagtacta

SEQ ID NO: 48301 - RNA, 333 nt, synthetic construct
  misc_feature 1..333: note = derived and/or modified sequence opt6 from anti-HIV_119-047145_VR-Chain
  source 1..333: mol_type = other RNA
caatcagtactaacacaaccaccatcagtatcagcagcaccaggacaaacagtaaacatatcatgctcaggatcaaactcaaacataggatcaaaatacgtatcatggtaccaacacttcccaggaacagcaccaaaactactaatatacgaaaacaacaaaagatcatcaggaataccagacagattctcaggatcaaaatcagcaacatcagcaacactagcaataacaggactacaaacaggagacgaagcagactactactgcgcaacatgggcaccatcactaaactcagcaagagtattcggaacaggaacaaaagtaacagtacta

SEQ ID NO: 48302 - RNA, 333 nt, synthetic construct
  misc_feature 1..333: note = derived and/or modified sequence opt6 from anti-HIV_119-046752_VR-Chain
  source 1..333: mol_type = other RNA
caatcagtactaacacaaccaccatcagtatcagcagcaccaggacaaaaagtaacaatatcatgctcaggaaactcatcatcaataggaaacaacttcgtatcatggtaccaacaactaccaggaacagcaccaaaactattagtatacgaaaactacagaagaccatcaggaatatcagacagattctcaggaagcaaatcaggaacatcagcaacactagcaataacaggactacaaacaggagacgaagcagactactactgcacagtatggggagtaagaaaaggagtaggagcagtattcggaacaggaacaaaagtaacagtatta

SEQ ID NO: 48303 - RNA, 324 nt, synthetic construct
  misc_feature 1..324: note = derived and/or modified sequence opt6 from anti-HIV_119-046660_VR-Chain
  source 1..324: mol_type = other RNA
caatcagtactaacacaaccaccatcagtatcagcagcaccaggacaaaaagtaacaatatcatgctcaggatcatcatcaaacataggaaaccactacgtatcatggtaccaacaactaccaggaacagcaccaaaactactaatatacgacaacaacaaaagaccatcaggaataccagacagattctcagcatcaaaatcaggaacatcagcaacactaggaataacaggactacaaacaggagacgaagcagactactactgcgcaacatgggacggaagagtatcagtaataggaacaggaacaaaagtaacagtagta

SEQ ID NO: 48304 - RNA, 333 nt, synthetic construct
  misc_feature 1..333: note = derived and/or modified sequence opt6 from anti-HIV_119-046202_VR-Chain
  source 1..333: mol_type = other RNA
caatcagtactaacacaaccaccatcagtatcagcagcaccaggacaaaaagtaacaatatcatgttcaggatcatcatcaaatataggaaacaattacgtatcatggtaccaacaattaccaggaacagcaccaaaactattagtatacgaaaattaccgaagaccatcaggaataccagacagattctcaggatcaaaatcaggaacatcagcaacactagcaataacaggactacaaacaggagacgaagcagactaccactgcgcaatatggggagtaagaaaaggagtaggagcagtattcggaacaggaacaaaagtaacagtagta

SEQ ID NO: 48305 - RNA, 333 nt, synthetic construct
  misc_feature 1..333: note = derived and/or modified sequence opt6 from anti-HIV_119-045790_VR-Chain
  source 1..333: mol_type = other RNA
caatcagtattaacacaaccaccaagcgtaagcgcagcaccaggacaaaaagtaacaataagctgtagcggatcatcaagcaatataggaaacaattacgtaagttggtaccaatacttaccaggaacagcaccaaaactattattctatgaagataacagaagaccaagcggaacaccagacagattctcaggatcaaaatcaggaacaagcgcaacattagcaataagcggactacaaacaggagacgaagcagattactattgcacaatatggggagtaagaaaaggagtaggagcagtatttggaacaggaacaaaagtaacagtacta

SEQ ID NO: 48306 - RNA, 333 nt, synthetic construct
  misc_feature 1..333: note = derived and/or modified sequence opt6 from anti-HIV_119-044670_VR-Chain
  source 1..333: mol_type = other RNA
caatcagtactaacacaaccaccatcagtatcaggagcaccaggagaaagagtaacaatatcatgcacaggaaacacatcaaatataggaacatacgacgtacaatggtaccaacacctaccaggaacagcaccaagactattaatataccacaacgtaaatctaccatcaggagtaccagacagattctcagcatcaaaatcaggaacatcagcaacactagcaataacaggactacaaacaggagacgaagcagactactactgcacaatatggggagtaagaaaaggagtaggagcagtattcggaacaggaacaaaagtaacagtacta

SEQ ID NO: 48307 - RNA, 321 nt, synthetic construct
  misc_feature 1..321: note = derived and/or modified sequence opt6 from anti-HIV_119-044140_VR-Chain
  source 1..321: mol_type = other RNA
caatcagtactaacacaaccaccatcagtatcagcagcaccaggacaaaaagtaacaatatcatgctcaggaggaacatcaaacataggaaaccacttcgtatcatggtacagacacctaccaggaacagcaccaaaactactaatatacgaaaacaacaacagaccatcaggaataccagacagattctcaggagcaaaatcaggaacaagcgcaacactagcaataacaggactacaaacaggagacgaaggagactactactgcgcaacatggtcaggatcactaaacataggaacaggaacaaaagtaacagtacta

SEQ ID NO: 48308 - RNA, 333 nt, synthetic construct
  misc_feature 1..333: note = derived and/or modified sequence opt6 from anti-HIV_119-042776_VR-Chain
  source 1..333: mol_type = other RNA
caatcagtattaacacaaccaccaagcgtaagcgcagcaccaggacaaaaagtaacaataagctgtagcggaagctcaagcaatataggaaacaattacgtaagctggtaccaacacttaccaggaacagcaccaaaactattaatatatgaatcagcaagaagaccaagcggaacaccagacagattctcaggatcaaaatcaggaacaagcgcaacattagcaataacaggactacaaacaggagacgaagcagattactattgcacactatggggagtaagaaaaggagtaggagcagtatttggaacaggaacaagagtaacagtacta

SEQ ID NO: 48309 - RNA, 333 nt, synthetic construct
  misc_feature 1..333: note = derived and/or modified sequence opt6 from anti-HIV_119-042581_VR-Chain
  source 1..333: mol_type = other RNA
caatcagtattaacacaaccaccaagcgtatcagcagcaccaggacaaaaagtaacaataagctgtagcggaagctcaagtaatataggaaacaatttcgtaagctggtaccaacaattaccaggaacagcacccaaactattaatatttgaaacacacagaagaccaagtggaataccagacagattctcaggatcaaaatcaggaacaagcgcaacattagcaataacaggactacaaagcggagacgaagcagattactattgcgcagtatggggagtaagacaaggagcaggagcagtatttggaacaggaacaaaagtaacagtacta

SEQ ID NO: 48310 - RNA, 333 nt, synthetic construct
  misc_feature 1..333: note = derived and/or modified sequence opt6 from anti-HIV_119-040905_VR-Chain
  source 1..333: mol_type = other RNA
caatcagtactaacacaaccaccatcagtatcagcagcaccaggacaaaaagtaacaatatcatgctcaggaaactcatcaaacataggagacaacttcgtatcatggtaccaacaattaccaggaatagcaccaaaactattagtatacgaaacaaacaaaagaccatcaggaataccagacagattcgcaggctcaaaatcaggaacatcagcaacattagtaataacaggactacaaacaggagacgaagcagacttctactgcggaacatgggacggatcactaagaacaggaggagtaataggaacaggaacaagagtaacagtacta

SEQ ID NO: 48311 - RNA, 321 nt, synthetic construct
  misc_feature 1..321: note = derived and/or modified sequence opt6 from anti-HIV_119-040322_VR-Chain
  source 1..321: mol_type = other RNA
caatcagtactaacacaaccaccatcagtatcagcagcaccaggacaaaaagtagtaatatcatgctcaggatcatcatcaataatagaaaaaaactcaatatcatggtaccaacaaggaccaggagcagcaccaaaactactaatatacgaaaacgacaaaagaccatcaggaataccagacagattctcaggatcaaaatcaggaacaacaggaacattagcaataacaggactacaaacaggagacgaagcagactacttctgcgcaacatggtcaggaagactaaacataggaacaggaacaaaagtaacagtacta

SEQ ID NO: 48312 - RNA, 324 nt, synthetic construct
  misc_feature 1..324: note = derived and/or modified sequence opt6 from anti-HIV_119-039892_VR-Chain
  source 1..324: mol_type = other RNA
caatcagtattaacacaaccaccatcagtatcagcagcaccaggacaaaaagtaacaatatcatgctcaggatcaaacgcaaacataggaaacaaagacgtatcatggtaccaacaactaccagcaacagcaccaaaactactaatatacgaatcaaacaaaagaccatcaggaataccagacagattctcaggatcaaaatcaggaacatcagcaacactagcaataacaggactacaaacaggagacgaagcagactactactgcgcaacatgggacggaagagtatcaggaataggaacaggaacaaaagtaacagtacta

SEQ ID NO: 48313 - RNA, 324 nt, synthetic construct
  misc_feature 1..324: note = derived and/or modified sequence opt6 from anti-HIV_119-039764_VR-Chain
  source 1..324: mol_type = other RNA
caatcagtactaacacaaccaccatcagtatcagcagcaccaggacaaaaagtaacaatatcatgctcaggatcagcatcaaacataggaaaaaacttcgtatcatggtaccaacaagtaccaggaacagcaccaaaactactaatatacgaaaacaacagaagaccatcaggaacaccagacagattctcaggatcaaaatcaggaacatcaggaacactagcaatatcaggactacaaacaggagacgaagcagactactactgcgaaacatgggacggaagcggaggagtattcggaacaggaacaaaagtaacagtacta

SEQ ID NO: 48314 - RNA, 333 nt, synthetic construct
  misc_feature 1..333: note = derived and/or modified sequence opt6 from anti-HIV_119-039188_VR-Chain
  source 1..333: mol_type = other RNA
caatcagtattaacacaaccaccaagtttaagtggagcaccaggacaaacagtaacaataagctgtagcggaagctcaagcaatataggaaacaattacgtaagctggtaccaacaattaccaggaacagcaccaaaactattaatatatgactcaaacagaagaccaagcggaataccagacagattctcaggatcaaaatcaggaacaagcgcaacattagcaataagcggactacaaacaggagacgaagcagattactgttgcgcagtatggggagtaagaagaggagcaggagcagtatttggagcaggaacaaaagtaacagtacta

SEQ ID NO: 48315 - RNA, 321 nt, synthetic construct
  misc_feature 1..321: note = derived and/or modified sequence opt6 from anti-HIV_119-039058_VR-Chain
  source 1..321: mol_type = other RNA
caatcagtactaacacaaccaccatcagtatcaggagcaccaggacaaagagtaacaatatcatgcacaggatcatcatcaaacataggaaacaactacgtatcatggtacagaagactaccaggaacagcaccaaaactactaatatacgaaaacaacaaaagaccatcaggaataccagacagattctcaggagcaaaatcaggaacatcagcaacattagcaataacaggactacaaacaggagacgaagcagactacttctgctcaacatggtcaggatcactaaacttcggaacaggaacaagagtaacagtacta

SEQ ID NO: 48316 - RNA, 321 nt, synthetic construct
  misc_feature 1..321: note = derived and/or modified sequence opt6 from anti-HIV_119-038837_VR-Chain
  source 1..321: mol_type = other RNA
caatcagtactaacacaaccaccatcagtatcagcagcaccaggacaaaaagtaacaatatcatgctcaggaggaacatcaaacataggaaacaacttcgtatcatggtaccaacacttaccaggaacagcaccaaaactactaatatttgaaaacaacaaaagaccatcaggagtaccagacagattctcaggagcaaaatcaggaacatcagcaacactagcaataacaggactacaaacaggagacgaaggagactactactgcgcaacatggtcaggatcactaaacataggaacaggaacaaaagtaacagtacta

SEQ ID NO: 48317 - RNA, 321 nt, synthetic construct
  misc_feature 1..321: note = derived and/or modified sequence opt6 from anti-HIV_119-038396_VR-Chain
  source 1..321: mol_type = other RNA
caatcagtactaacacaaccaccatcagtatcagcaacaccaggacaaaaagtaacaatatcatgctccggatcaaactcaaacataggaaacaaatacgtatcatggtaccaactattcccaggaacagcaccaaaattactaatatcagaaaacaacagaagaccatcaggaacaccagacagattctcaggatcaaaatcaggaacatcagcaacactagcaataacaggactacaaacaggagacgaagcagactactactgcgcaacatggtcaggatcactaaacataggaacaggaacaaaagtaacagtacta

SEQ ID NO: 48318 - RNA, 321 nt, synthetic construct
  misc_feature 1..321: note = derived and/or modified sequence opt6 from anti-HIV_119-036918_VR-Chain
  source 1..321: mol_type = other RNA
caatcagtactaacacaaccaccatcagtatcagcagcaccaggacaaaaagtaacaatatcatgctcaggagcaacatcaaacatatgggaccactacgtatcatggtacctacaagtaccaggaacagcaccaagactattaatatacgacaacgacaaaagaccatcaggaataccagacagattctcaggatcaaaatcaggaacatcagcaacactagcaataacaggactacaaacaggagacgaaggagactactactgcgcaacatggtcaggatcactaaacataggaacaggaacaaaagtaacagtacta

SEQ ID NO: 48319 - RNA, 324 nt, synthetic construct
  misc_feature 1..324: note = derived and/or modified sequence opt6 from anti-HIV_119-036592_VR-Chain
  source 1..324: mol_type = other RNA
caatcagtactaacacaaccaccaagcgtaagcgcagcaccaggacaaaaagtaacaataagctgtagtggaagcaatagtaatacaggaaacaaagacgtaagctggtaccaacaagtaccagcaacagcaccaaaactactaatatatgaatcaaacaaaagaccaagcggaataccagacagattctcaggatcaaaatcaggaacaagcgcgacattagcaataacaggactacaaacaggagacgaagcagattactattgcgcaatatgggacggaagagtaagcgtaataggaacaggaacaaaagtaacagtatta

SEQ ID NO: 48320 - RNA, 324 nt, synthetic construct
  misc_feature 1..324: note = derived and/or modified sequence opt6 from anti-HIV_119-036310_VR-Chain
  source 1..324: mol_type = other RNA
caatcagtactaacacaaccaccatcagtctcagcagcaccaggacaaaaagtaacaatatcatgctccggatcaacatcaaacataggacaaaactacgtatcatggtaccaacaactaccaggaacagcaccaaaactactaatatacgaaaacaacagaagaccatcaggatcaccagacagattctcaggatcaaaaagcggaacatcagcaacactagcaataacaggactacaaacaggagacgaagcagactactactgcgaaacatgggacggatcaggaggagtattcggaacaggaacaaaagtaacagtacta

SEQ ID NO: 48321 - RNA, 333 nt, synthetic construct
  misc_feature 1..333: note = derived and/or modified sequence opt6 from anti-HIV_119-035618_VR-Chain
  source 1..333: mol_type = other RNA
caatcagtattaacacaaccaccaagtgtaagtgcagcaccaggacaaaaagtaacaataagctgtagcggaagctcattcacaataggaaacaatcacgtaagctggtaccaacaattaccaggaacagcaccaaaactattaatatttgaatcacacaaaagaccaagcggagtaccagacagattctcaggatcaaaatcaggaacaagtgcaacattagcaataacaggactacaaacaggagacgaagcagattactattgcacagtatggggagtaagaaaaggagtaggagcagtatttggaacaggaacaaaagtaacagtacta

SEQ ID NO: 48322 - RNA, 321 nt, synthetic construct
  misc_feature 1..321: note = derived and/or modified sequence opt6 from anti-HIV_119-035569_VR-Chain
  source 1..321: mol_type = other RNA
caatcagtattaacacaaccaccatcagtatcaggagcaccaggacaaacagtaacaatatcatgcacaggatcatcatcaaacataggaggatacgacgtacactggtaccaacaattaccaggaacagcaccaaaactattaatatacgaaaacaacagaagaccatcaggaacaccagacagattctcaggagcaaaatcaggaacatcagcaacattagcaataacaggactacaaacaggagacgaaggagactactactgcgccacatggtcaggatcactaaacataggaacaggaacaaaagtaacagtacta

SEQ ID NO: 48323 - RNA, 324 nt, synthetic construct
  misc_feature 1..324: note = derived and/or modified sequence opt6 from anti-HIV_119-035466_VR-Chain
  source 1..324: mol_type = other RNA
caatcagtactaacacaaccaccatcagtatcagcagcagcaggacaaaacgtaaacataagctgctcaggaaaaaaatcaaacataggaaacaactacgtatcatggtaccaacaattcccaggaacagcaccaaaactactaatatacggaaacacaaacagaccatcaggaataccagacagattctcaggatcaaaatcaggaacatcagcaacattagcaataacaggactacaaacaggagacgacgcagactactactgcgaaacatgggacggatcaggaggagtattcggaacaggaacaaaagtaacagtacta

SEQ ID NO: 48324 - RNA, 333 nt, synthetic construct
  misc_feature 1..333: note = derived and/or modified sequence opt6 from anti-HIV_119-035157_VR-Chain
  source 1..333: mol_type = other RNA
caatcagtactaacacaaccaccatcagtatcagcagcaccaggacaaaaagtaacaatatcatgctcaggatcatcatcaaacataggaaacaacttcgtatcatggtaccaacaaagaccaggaacagcaccaaaactactaatatacgaaacaaacaaaagaccatcaggaataccagacagattctcaggatcaaaatcaggaacatcagcaacattagcaataacaggactacaaacaggagacgaagcagactactactgcgcaacatgggcaccaagactaaactcagcaagagtattcggaaacggaacaatggtaacagtacta

SEQ ID NO: 48325 - RNA, 333 nt, synthetic construct
  misc_feature 1..333: note = derived and/or modified sequence opt6 from anti-HIV_119-035121_VR-Chain
  source 1..333: mol_type = other RNA
caatcagtactaacacaaccaccatcagtatcagcagcaccaggacaaaaagtaacaatatcatgctcaggatcaacatcatacataggaaacaaatacgtatcatggtaccaacaatttccaggagcagcaccaaaactactaatatacgaaaataacaaaagaccatcaggaataccagacagattctcagcaagcaaatcagcaacatcagcaacactagcaataacaggactacaaacaggagacgaagcagactactgctgcgcagtatggggagtaagaagaggagcaggagcagtattcggagcaggaacaaaagtaacagtatta

SEQ ID NO: 48326 - RNA, 324 nt, synthetic construct
  misc_feature 1..324: note = derived and/or modified sequence opt6 from anti-HIV_119-035046_VR-Chain
  source 1..324: mol_type = other RNA
caatcagcattaacacaaccagcaagcgtaagcggaagcccaggacaaagtataacaataagctgtacaggaacatcaagcgatgtaggatacgattacgtaagctggtacagacaagtaccagcaacaacaccaaaattattaatatatgaaaataacaaaagaccaagcggaataccagacagattctcaggatcaaaatcaggaacaagcgcaacattagcaataacaggactacaaacaggagacgaagcagattactattgcgcaacatgggacggaagagtaagtgtaataggaacaggaacaaaagtaacagtagta

SEQ ID NO: 48327 - RNA, 324 nt, synthetic construct
  misc_feature 1..324: note = derived and/or modified sequence opt6 from anti-HIV_119-034754_VR-Chain
  source 1..324: mol_type = other RNA
caatcagtactaacacaaccaccatcagtatcagcagcaccaggagaaaaagtaacaatatcatgctcaggatcatcatcaaacataggaaacaactacgtatcatggtaccaacaactaccaggaacagtaccaaaactactaatatacgacaacaacaaaagaccaagcggaacaccagacagattctcaggatcaaaatcaggaacatcagcaacactagcaataacaggactacaaacaggagacgaagcagactactactgcgaaacatgggacggatcaggaggagtattcggaacaggaacaaaagtaacagtatta

SEQ ID NO: 48328 - RNA, 324 nt, synthetic construct
  misc_feature 1..324: note = derived and/or modified sequence opt6 from anti-HIV_119-034318_VR-Chain
  source 1..324: mol_type = other RNA
caaagcgtactaacacaaccaccatcagtatcagcagcaccaggacaaaaaataacaatatcatgctcaggatcaagctcaaacataggaaataacgacgtatcatggtatcaacaactaccaggaacagcaccaaaattactaatatacgaaaacgacagaagaccatcaggaacaccagacagattcagcggaagtaaaagcggaacatcagcaacactagcaataacaggactacaaacaggagacgaagcagactattactgtgaaacatgggacggatcaggaggagtatttggaacaggaacaaaagtaacagtacta

SEQ ID NO: 48329 - RNA, 333 nt, synthetic construct
  misc_feature 1..333: note = derived and/or modified sequence opt6 from anti-HIV_119-033780_VR-Chain
  source 1..333: mol_type = other RNA
caatcagtactaacacaaccaccaagcgtatcagcagcaccaggacaaagagtaacaataagctgtagcggaacatcaagcaatataggagaaaattacgtaagctggtaccaacaaataccaggaacagcaccaaaactattaatatatgaaaataacaaaagaccaagcggaataccagacagattctcaggatcaaaatcaggaacaagcgcaacattagtaataacaggactacaaacaggagacgaagcagatttctattgcggaacatggggaggaagtttaagaacaggaggagtattaggaacaggaacaagagtaacagtacta

SEQ ID NO: 48330 - RNA, 333 nt, synthetic construct
  misc_feature 1..333: note = derived and/or modified sequence opt6 from anti-HIV_119-033632_VR-Chain
  source 1..333: mol_type = other RNA
caatcagtattaacacaaccaccaagcgtaagcgcagcaccaggacaaagagtaacaataagctgtagcggaggatcaagcaatataggaagcaattacgtaagctggtaccaacaattaccaggaacagcaccaaaactattaatatatcaaaataacaaaagaccaagcggaataccagacagattcagtggatcaaaatcaggaacaagcgcaacattaggaataacaggactacaaacaggagacgaagcagattactattgcacagtatggggagtaagaaaaggagtaggagcagtatttggaacaggaacaaaagtaacagtatta

SEQ ID NO: 48331 - RNA, 333 nt, synthetic construct
  misc_feature 1..333: note = derived and/or modified sequence opt6 from anti-HIV_119-033183_VR-Chain
  source 1..333: mol_type = other RNA
caatcagtattaacacaaccaccaagcgtaagcgcagcaccaggacaaatggtaacaataagctgtagcggaggagcaagcaatctaggaaaaaatagcgtaagctggtaccaacaattaccaggaacagcaccaaaactattaatatatgaagataacagaagaccaagcggaacaccagacagattctcaggatcaagatcaggaacaagcgcaacattagcaataacaggactacaaacaggagacgaagcagattactattgcacaatatggggagtaagaaaaggagtaggagcagtatttggaacaggaacaaaagtaacagtacta

SEQ ID NO: 48332 - RNA, 333 nt, synthetic construct
  misc_feature 1..333: note = derived and/or modified sequence opt6 from anti-HIV_119-030696_VR-Chain
  source 1..333: mol_type = other RNA
caatcagtattaacacaaccaccaagcgtatcaggagcaccaggacaaatagtaacattatcatgtacaggagcaatgacaaatataggaaacaatgacgtacactggtaccaacacttaccaggaacaggaccaaaactattaatatacgaaaataacaaaagaccatcaggaataccagacagattctcaggatcaaaatcaggaacatcagcaacattagtaataacaggactacaaacaggagacgaagcagacttctactgcggaacatgggacggatcactaagaacaggaggagtaataggaacaggaacaagagtaacagtacta

SEQ ID NO: 48333 - RNA, 324 nt, synthetic construct
  misc_feature 1..324: note = derived and/or modified sequence opt6 from anti-HIV_119-030059_VR-Chain
  source 1..324: mol_type = other RNA
caatcagtactaacacaaccaccatcagtatcagcagcaccaggacaaaaagtagtaatatcatgctcaggatcatcatcaataatagaaaaaaactcaatatcatggtaccaacaaggaccaggagcagcaccaaaactactaatatacgaaaacgacaaaagaccatcaggaatatcagacagattctcaggatcaaaatcagcaacatcagcaacactagcaataacaggactacacacaggagacgaagcagactactactgcgaaacatgggacggatcaggaggagtattcggaacaggaacaaaagtaacagtacta

SEQ ID NO: 48334 - RNA, 333 nt, synthetic construct
  misc_feature 1..333: note = derived and/or modified sequence opt6 from anti-HIV_119-029589_VR-Chain
  source 1..333: mol_type = other RNA
caaagcgtattaacacaaccaccaagcgtaagcgcagcaccaggacaaaaagtaacaataagctgtagcggaacatcaagcaatataggaaacaatttcgtaagctggtaccaactattaccaggaacagcaccaagactattaatatatgacaataacaaaagaccaagcggaacaccagacagattctcaggatcaaaatcaggaacaagtgcaacattaggaataacaggactacaaacaggagacgaagcagatttctattgcggaacatgggacggatcattaagaacaggaggagtaataggaacaggaacaagagtaacagtacta

SEQ ID NO: 48335 - RNA, 324 nt, synthetic construct
  misc_feature 1..324: note = derived and/or modified sequence opt6 from anti-HIV_119-029448_VR-Chain
  source 1..324: mol_type = other RNA
caaagcgtactaacacaaccaccatcagtatcagcagcaccaggacaaaaagtaacaatatcatgctcaggaaacagctcaaacataggaaaaaactcagtatcatggtatcaccaactaccaggaacagcaccaaaactactaatatacgaaaacgacagaagaccatcaggaacaccagacagattcagcggaagcaaaagcggaacatcagcaacactagcaataacaggactacaaacaggagacgaagcagactactactgcgaaacatgggacggatcaggaggagtattcggaacaggaacaaaagtaacagtacta

SEQ ID NO: 48336 - RNA, 333 nt, synthetic construct
  misc_feature 1..333: note = derived and/or modified sequence opt6 from anti-HIV_119-029220_VR-Chain
  source 1..333: mol_type = other RNA
caatcagtattaacacaaccaccaagcgtaagcgcagcaccaggacaaaaagtaacaataagctgtagcggaagcacaagcaatataggacaaaattacgtaagctggtaccaacaattaccaggaacagcaccaaaactattaatatatgaaaatgacagaagaccaagcggaataccagacagattctcaggatcaaaatcaggaacatcagcaacattagcaataagcggactacaaacaggagacgaagcagattactgttgcgcagtatggggagtaagaagaggagcaggagcagtatttggaccaggaacaaaagtaacagtacta

SEQ ID NO: 48337 - RNA, 333 nt, synthetic construct
  misc_feature 1..333: note = derived and/or modified sequence opt6 from anti-HIV_119-028317_VR-Chain
  source 1..333: mol_type = other RNA
caatcagtattaacacaaccaccaagcgtaagcgcagcaccaggacaaaaagtaacaataagctgtagcggaagctcaagcaatataggaaacgattacgtaagctggtaccaacaattaccaggaacagcaccaaaattattaatatatgaaaataacaaaagaccaagtggaataccagacagattctcaggatcaaaatcaggaacaagcgcaacattagcaataacaggactacaaacaggagacgaagcagattactattgcacaatatggggagtaagaaaaggagtaggagcagtatttggaacaggaacaaaagtaacagtatta

SEQ ID NO: 48338 - RNA, 324 nt, synthetic construct
  misc_feature 1..324: note = derived and/or modified sequence opt6 from anti-HIV_119-028165_VR-Chain
  source 1..324: mol_type = other RNA
caatcagtactaacacaaccaccatcagtatcagcagcaccaggacaaacagtaacaatatcatgctcaggaataacatcaaacataggaaaaaacgacgtatcatggtaccaacaactaccaggaacagcaccaaaactactaatatcagaaaacaacagaagaccatcaggaataccagacagattctcaggaagcaaatcaggaacatcagcaacattagcaataacaggactacaaacaggagacgaagcagactactactgcgcaatatgggacggaagagtatcagtaataggaacaggaacaaaagtaacagtacta

SEQ ID NO: 48339 - RNA, 324 nt, synthetic construct
  misc_feature 1..324: note = derived and/or modified sequence opt6 from anti-HIV_119-027147_VR-Chain
  source 1..324: mol_type = other RNA
caatcagtactaacacaaccaccatcagtatcagcagcaccaggacaaacagtaacaatatcatgctcaggatcaacatcagacataggaaaaaacgacgtatcatggtaccaacaactaccaggaatagcaccaaaactactaatatcagaaaacaacagaagaccatcaggaacaccagacagattctcaggatcaaaatcaggaacatcagcaacactagcaataacaggactacaaacaggagacgaagcagactactactgcgaaacatgggacggatccggagcagtattcggaacaggaacaaaagtaacagtacta

SEQ ID NO: 48340 - RNA, 333 nt, synthetic construct
  misc_feature 1..333: note = derived and/or modified sequence opt6 from anti-HIV_119-026743_VR-Chain
  source 1..333: mol_type = other RNA
caatcagtactaacacaaccaccatcagtatcagcagcaccaggacaaaacgtaacaatatcatgctcaggatcatcatcaaacataggaaacaacttcgtatcatggtaccaacaaagaccaggaacaggaccaaaactactaatatacgaaacaaacagaagaccatcaggaataccagacagattctcaggatcaaaaagcggaacatcagcaacactagcaataacaggactacaaacaggagacgaagcagactactactgcgcaacatgggcaccatcactaaactcagcaagagtattcggaacaggaacaaaagtaacagtacta

SEQ ID NO: 48341 - RNA, 333 nt, synthetic construct
  misc_feature 1..333: note = derived and/or modified sequence opt6 from anti-HIV_119-026508_VR-Chain
  source 1..333: mol_type = other RNA
caatcagtactaacacaaccaccatcagtatcagcagcaccaggacaaaaagtaacaatatcatgcagcggatcatcatcaacaataggaaacaactacatatcatggtaccaagtactaccaggaacagcaccaaaattagtaatattcaaaaacaacgaaagaccatcaagagtaccagacagattctcaggatcaaaatcaggaacatcagcaacactaggaataacaggactacaactaggagacgaaggagactactactgcggaacatgggaaacatcactatcaggaggaggagtattcggaacaggaacaaaagtaacagtacta

SEQ ID NO: 48342 - RNA, 324 nt, synthetic construct
  misc_feature 1..324: note = derived and/or modified sequence opt6 from anti-HIV_119-025683_VR-Chain
  source 1..324: mol_type = other RNA
caatcagtactaacacaaccaccatcagtatcagcagcaccaggacaaaaagtaacaatatcatgctcaggatcatcatcaaacataggaaacaactacgtatcatggtaccaacaactaccaggaacagcaccaaaactactaatatacgaaaacaacaaaagaccatcaggaataccagacagattctcagactcacaatcaggaacatcagcaacactagcaataacaggactacaaacaggagacgaagcagactactactgcgaaacatgggacggatcaggaggagtattcggaacaggaacaaaagtaacagtacta

SEQ ID NO: 48343 - RNA, 333 nt, synthetic construct
  misc_feature 1..333: note = derived and/or modified sequence opt6 from anti-HIV_119-025614_VR-Chain
  source 1..333: mol_type = other RNA
caatcactattaacacaacccccaagcgtaagtgcagcaccaggacaaaacgtaataataagctgtagcggaagctcaagcaatataggtaaaaattacgtagcatggtaccaacaagtacccggaacagcaccaaaaatagtagtatttgaaacaacaaatagaccaagcggaataccagacagattcagtggatcaaaatcaggaacaagcgcaacattagcaataacaggactacaaaccggagacgaagcagattactattgcacagtatggggagtaagaaaaggagtaggagcagtatttggaacaggaacaaaagtaacagtacta

SEQ ID NO: 48344 - RNA, 324 nt, synthetic construct
  misc_feature 1..324: note = derived and/or modified sequence opt6 from anti-HIV_119-025548_VR-Chain
  source 1..324: mol_type = other RNA
caaagcatactaacacaaccaccatcagtatcagcagcaccaggacaaaaagtaacaatatcatgctcaggatcaagctcaaacataggaaataactatgtatcatggtatcaacatgtaccaggaacagcaccaaaattactaatatacgaaaacaatagaagaccatcaggaacaccagacagattcagcggaagcaaaagcggaacatcagcaacactagcaataacaggactacaatcaggagacgaagcagactactactgcggaacatgggacggatcaggaggagtattcggaacaggaacaaaagtaacagtacta

SEQ ID NO: 48345 - RNA, 333 nt, synthetic construct
  misc_feature 1..333: note = derived and/or modified sequence opt6 from anti-HIV_119-025526_VR-Chain
  source 1..333: mol_type = other RNA
caatcagtactaacacaaccaccaagcgtaagcgcagcaccaggacaaaaagtaacaataagctgtagcggaagcgcaagcaatataggaaaaaatttcgtaagctggtaccaacaattaccaggaacagcaccaaaactattaatatatgaaaataacagaagaccaagcggaacaccagacagattctcaggatcaaaatcaggaacaagcgcaacattagcaataacaggactacaaacaggagacgaagcagattactattgcacagtatggggagtaagaaaaggagtaggagcagtctttggaacaggaacaaaagtaacagtacta

SEQ ID NO: 48346 - RNA, 324 nt, synthetic construct
  misc_feature 1..324: note = derived and/or modified sequence opt6 from anti-HIV_119-023552_VR-Chain
  source 1..324: mol_type = other RNA
caatcagtactaacacaaccaccatcagtatcagcagcaccaggacaaacagtaacaatatcatgctcaggatcaacatcaaacataggaaaaaacgacgtatcatggtaccaacaactaccaggaacagcaccaaaactactaatatcagaaaacaacagaagaccatcaggaacaccagacagattctcagcatcaaaatcaggaacatcagcaacactagcaataacaggactacaaacaggagacgaagcagactactactgcgaaacatggcacggatcaggaggagtattcggaacaggaacaaaagtaacagtacta

SEQ ID NO: 48347 - RNA, 321 nt, synthetic construct
  misc_feature 1..321: note = derived and/or modified sequence opt6 from anti-HIV_119-023092_VR-Chain
  source 1..321: mol_type = other RNA
caatcagtattaacacaaccaccatcagtaagcgcagcaccaggacaaaaagtaacaatatcatgctcaggatcaacatcagacctaggacaaacaagagtatcatggtaccaacaattaccaagatcagcaccagaactattaatatttgaaaacaacagaagaccatcaggaataccagacagattctcaggagcaaaatcaggaacatcagcaacattagcaataacaggactacaaacaggagacgaagcagactacttctgctcaacatggtcaggatcactaaacttcggaacaggaacaagagtaacagtacta

SEQ ID NO: 48348 - RNA, 324 nt, synthetic construct
  misc_feature 1..324: note = derived and/or modified sequence opt6 from anti-HIV_119-022793_VR-Chain
  source 1..324: mol_type = other RNA
caatcagtattaacacaaccaccaagcgtaagcgcagcaccaggacaaaaagtaacaataagttgtagcggaggaacaagcaatataggaaacaattacgtaagctggtacagaagactaccaggaacagcaccaaaactattaatatatgaaaataacaaaagaccaagcggaataccagacagattctcaggagcaaaatcaggaacaagcgcaacattaggaataacaggactacaaacaggagacgaagcagattactattgcgaaacatgggacgatagcggaggagtattcggaacaggaacaaaagtaacagtatta

SEQ ID NO: 48349 - RNA, 324 nt, synthetic construct
  misc_feature 1..324: note = derived and/or modified sequence opt6 from anti-HIV_119-022395_VR-Chain
  source 1..324: mol_type = other RNA
caatcagtactaacacaaccaccatcagtatcagcagcaccaggacaaacagtaacaatatcatgctcaggatcaacatcaaacataggaaaaaacgacgtatcatggtaccaacaattaccaggaacagcaccaaaactactaatatcagacaacaacagaagaccatcatggacaccagacagattctcaggaagtaaatcaggaacatcagcaaccctagcaataacaggactacaaacaggagacgaagcagactactactgcgaaacatgggacggatcaggaggagtattcggaccaggaacaagagtaacagtacta

SEQ ID NO: 48350 - RNA, 333 nt, synthetic construct
  misc_feature 1..333: note = derived and/or modified sequence opt6 from anti-HIV_119-022334_VR-Chain
  source 1..333: mol_type = other RNA
caaagtgtactaacacaaccaccatcagtatcagcagcaccaggacaaaacgtaaacatatcatgctcaggaggatcaagcaacataggatcaaactacgtatcatggtaccaacaattcccaggaacagcaccaaaacacctaatatacgaaaacaacaaaagaccatcaggaataccagacagattctcagactcacaatcaggaacatcagcaacactaggaataacaggactacaaacaggagacgaagcagactactactgcggaacatgggacggatcactaagaacaggaggagtaataggaacaggaacaagagtaacagtacta

SEQ ID NO: 48351 - RNA, 321 nt, synthetic construct
  misc_feature 1..321: note = derived and/or modified sequence opt6 from anti-HIV_119-021866_VR-Chain
  source 1..321: mol_type = other RNA
caatcagtcttaacacaaccaccatcagtatcagcagcaccaggacaaagagtaacaataagctgttcaggatcagcatcaaatataggaaaaaatttcgtatcatggtaccaacaattaccaggaaaagcaccaaaactaataatatatgaagtaacaaaaagaccaagcggagtaccagcaagattctcaggatcaaaatcaggaacatcagcaacattagcaataacaggactacaaacaggagacgaagcagattacttctgctcaacatggtcaggatcattaaactttggaacaggaacaagagtaacagtacta

SEQ ID NO: 48352 - RNA, 324 nt, synthetic construct
  misc_feature 1..324: note = derived and/or modified sequence opt6 from anti-HIV_119-021278_VR-Chain
  source 1..324: mol_type = other RNA
caatcagtactaacacaaccaccatcagtatcagcagcaccaggacaaaaagtaacaatatcatgctcaggatcagcatcaaacataggaaaaaacttcgtatcatggtaccaacaactaccaggaacagcaccaaaactactaatatacgaaaacaacagaagaccatcaggaacaccagacagattctcaggatcaagatcaggaacatcagcaacattaggaataacaggactacaaacaggagacgaagcacactactactgcgaaacatgggacgactcaggaggagtattcggaacaggaacaaaagtaacagtatta

SEQ ID NO: 48353 - RNA, 333 nt, synthetic construct
  misc_feature 1..333: note = derived and/or modified sequence opt6 from anti-HIV_119-021183_VR-Chain
  source 1..333: mol_type = other RNA
caatcagtattaacacaaccaccatcagtatcagcagcaccaggacaaaaagtaacaatatcatgttcaggaaactcatcaaatataggaaacaatttcgtatcatggtaccaacaatttccaggaacagcaccaaaactattagtatttgaaacacacagaagaccatcaggaataccagacagattctcaggatcaaaatcaggaacatcagcaacattagcaataacaggactacaaacaggagacgaagcagattactattgcgcagtatggggagtaagaagaggagtaggagcagtatttggagcaggaacaaaagtaacagtacta

SEQ ID NO: 48354 - RNA, 333 nt, synthetic construct
  misc_feature 1..333: note = derived and/or modified sequence opt6 from anti-HIV_119-019376_VR-Chain
  source 1..333: mol_type = other RNA
caatcagtattaacacaaccaccaagcgtaagcgcagcaccaggacaaaaagtaacaataagttgtagcggaagctcaagcaatataggaaacaattacgtaagctggtaccaacaagtaccaggaacagcaccaaaactattagtatatgaaacatacagaagaccaagcggaataccagacagattctcaggatcaaaatcaggaacaagcgcaacattagcaataacaggactacaaacaggagacgaagcagattactattgcacaatatggggagtaagaaaaggagtaggagcagtatttggaacaggaacaaaagtaacagtacta

SEQ ID NO: 48355 - RNA, 321 nt, synthetic construct
  misc_feature 1..321: note = derived and/or modified sequence opt6 from anti-HIV_119-019238_VR-Chain
  source 1..321: mol_type = other RNA
caatcagtactaacacaaccaccatcagtatcagcagcaccaggacaaaaagtaacaatatcatgctcaggaacatcatcaaacataggaaacaaccacgtatcatggtaccaacaagtaccaggaacagcaccaaaactactaatatacgaaaacaacaaacgaccatcaggaataccagcaagattctcagcagcaaaatcaggaacatcagcaacactagcaataacaggactacaaacaggagacgaagcagactacttctgcgcaacatggtcaggaagactaaacataggaacaggaacaaaagtaacagtacta

SEQ ID NO: 48356 - RNA, 333 nt, synthetic construct
  misc_feature 1..333: note = derived and/or modified sequence opt6 from anti-HIV_119-018500_VR-Chain
  source 1..333: mol_type = other RNA
caatcagtactaacacaaccaccatcagtatcagcagcaccaggacaaaaagtaaacatatcatgctcaggatcatcatcaaacataggaaacaacttcgtatcatggtaccaacaaagaccaggaacagcaccaaaattactaatatacgaaacaaacagaagaccatcaggaataccagacagattctcaggctcaaaatcaggaacatcagcaacactagcaataacaggactacaaacaggagacgaagcagactactactgcgcaacatgggcagcatcactaacatcagcaagagtattcggaataggaacaaaagtaacagtacta

SEQ ID NO: 48357 - RNA, 324 nt, synthetic construct
  misc_feature 1..324: note = derived and/or modified sequence opt6 from anti-HIV_119-018318_VR-Chain
  source 1..324: mol_type = other RNA
caatcagtactaacacaaccaccaagcgtatcagcagcaccaggacaaacagtaataatatcatgctcaggatcaacatcaaacataggaaaaaacgacgtatcatggtaccaacaactaccaggaacagcaccaaaactactaatatcagaaaacaacagaagaccatcaggaacaccagacagattctcaggatcaaaatcaggaacatcagcaacactagcaataacaggactacaaacaggagacgacgcagactactactgcgaaacatgggacggatcaggaggagtattcggaacaggaacaaaagtaacactagta

SEQ ID NO: 48358 - RNA, 333 nt, synthetic construct
  misc_feature 1..333: note = derived and/or modified sequence opt6 from anti-HIV_119-018218_VR-Chain
  source 1..333: mol_type = other RNA
caatcagtattaacacaaccaccaagcgtaagcgcagcaccaggacaaaaagtaacaataagctgtagcggaaactcaagcaatataggaaacaatttcgtaagctggtaccaacaattaccaggaacagcaccaaaactattaatatatgaaaataacagaagaccaagtggaataccagacagattctcaggatcaaaatcaggaacaagcgcaacattagcaataagcggactacaaacaggagacgaagcagattactggtgcgcagtatggggagtaagaagaggagcaggagcagtatttggagcaggaacaaaagtaacagtacta

SEQ ID NO: 48359 - RNA, 324 nt, synthetic construct
  misc_feature 1..324: note = derived and/or modified sequence opt6 from anti-HIV_119-017876_VR-Chain
  source 1..324: mol_type = other RNA
caatcagtactaacacaaccaccatcagtatcagcagcaccaggacaaaaagtaacaatatcatgctcaggatcaacatcaaaaataggacaaaactcagtatcatggtaccaacaactaccaggaacagcaccaaaactactaatatacgaaaacgacagaagaccatcaggaacacccgacagattctcagcatcaaaatcaggaacatcagcaacactagcaataacaggactacaaacaggagacgaagcagactactactgcgaaacatgggacgactcaggcggcgtattcggaacaggaacaaaagtaacagtacta

SEQ ID NO: 48360 - RNA, 324 nt, synthetic construct
  misc_feature 1..324: note = derived and/or modified sequence opt6 from anti-HIV_119-017740_VR-Chain
  source 1..324: mol_type = other RNA
caaagcgtactaacacaaccaccatcagtatcagcagcaccaggacaaaaagtaacaatatcatgctcaggatcaaactcaaacataggaaacaaagacgtatcatggtacagacaagtaccagcaacagcaccaaaactaccaatatacgaaaacaaaaacgaaccatcaggagtaccagacagattctcaggatcaaaatcaggaacatcagcaacactagcaataacaggactacaaacaggagacgaagcagactactactgcgcaacatgggacggaagagtatcagtaataggaacaggaacaaaagtaacagtagta

SEQ ID NO: 48361 - RNA, 321 nt, synthetic construct
  misc_feature 1..321: note = derived and/or modified sequence opt6 from anti-HIV_119-017128_VR-Chain
  source 1..321: mol_type = other RNA
caatcagtactaacacaaccaccatcagtatcagcagcaccaggacaaaaagtaacaatatcatgctcaggaagctcatcaaacataggaaacaactacgtatcatggtaccaacaactaccaggaacagcaccaaaactactaatatacgaaaacaacaaaagaccatcaggaataccagacagattctcaggagcaaaatcaggaacatcagcaacattagcaataacaggactacaaacaggagacgaagcagactacttctgctcaacatggtcaggatcactaaacttcggaacaggaacaagagtaacagtacta

SEQ ID NO: 48362 - RNA, 324 nt, synthetic construct
  misc_feature 1..324: note = derived and/or modified sequence opt6 from anti-HIV_119-017044_VR-Chain
  source 1..324: mol_type = other RNA
caatcagtactaacacaaccaccatcagtatcagcagcaccaggacaaaaagtaacaatatcatgctcaggatcaaactcaaacataggaaacaactacgtatcatggtaccaccacctaccaggaacagcaccaagactactaatatacgacaacaacaaaagaccatcaggaataccagacagattctcaggatcaaaatcaggaacatcagcaacactagcaataacaggactacaaacaggagacgaagcagactactactgcgcaacatgggacggaagagtatcagtaataggaacaggaacacaagtaacagtacta

SEQ ID NO: 48363 - RNA, 321 nt, synthetic construct
  misc_feature 1..321: note = derived and/or modified sequence opt6 from anti-HIV_119-016644_VR-Chain
  source 1..321: mol_type = other RNA
caatcagtactaacacaaccaccatcagtatcagcagcaccaggacaaaaagtaacaatatcatgctcaggaggaacatcaaacataggaaacaactacgtatcatggtaccaacaactaccaggaacagcaccaaaactactaatatacgaaaacaacaaaagaccatcaggaataccagcaagattctcagcagcaaaatcaggaacatcagcaacactagcaataacaggattacaaacagaagacgaagcagactactactgcgcaacatggtcaggatcactaaacataggaacaggaacaaaagtaacagtacta

SEQ ID NO: 48364 - RNA, 333 nt, synthetic construct
  misc_feature 1..333: note = derived and/or modified sequence opt6 from anti-HIV_119-015878_VR-Chain
  source 1..333: mol_type = other RNA
caatcagcactaacacaaccaccatcagcatcaggatcaccaggacaatcagtaacaatatcatgctcaggatcatcatcaaacataggaaacaacttcgtatcatggtaccaacaaagaccaggaacagcaccaaaactactaatatacgaaacaaacaaaagaccatcaggaataccagacagattctcaggctcaaaatcaggaacatcagcaacactagcaataacaggactacaaacaggagacgaagcagactactactgcgcaacatgggcaccaagactaaactcagcaagagtattcggaaacggaacaatggtaacagtacta

SEQ ID NO: 48365 - RNA, 321 nt, synthetic construct
  misc_feature 1..321: note = derived and/or modified sequence opt6 from anti-HIV_119-015538_VR-Chain
  source 1..321: mol_type = other RNA
caatcagtattaacacaaccaccatcagtatcagcaacaccaggacaaaaagtaacaatatcatgctcaggatcatcatcaaacataggaaacaactacgtatcatggtacagaagactaccaggaacagcaccaaaacacttaatatacgaaacaaacaacagaccatcaggagtaccagcaagactatcagcagcaaaatcaggaacatcagcaacactagcaataacaggactacaaacagaagacgaagcagactactactgcgcaacatggtcaggatcactaaacataggaacaggaacaaaagtaacagtacta

SEQ ID NO: 48366 - RNA, 321 nt, synthetic construct
  misc_feature 1..321: note = derived and/or modified sequence opt6 from anti-HIV_119-015455_VR-Chain
  source 1..321: mol_type = other RNA
caatcagtactaacacaaccaccatcagtatcagcaacaccaggacaaaaagtaacaatatcatgctcaggatcaaactcaaacataggaaacaaagacgtatcatggtaccaacacttcccaggaacagcaccaaaactactaatatacgaaaacaacaaaagaccatcaggaataccagacagattctcaggatcaaaatcagcaacatccgcaacactaacaataacaggactacaaacagaagacgaagcagactactactgcgcaacatggtcaggatcactaaacataggaacaggaacaaaagtaacagtacta

SEQ ID NO: 48367 - RNA, 321 nt, synthetic construct
  misc_feature 1..321: note = derived and/or modified sequence opt6 from anti-HIV_119-014425_VR-Chain
  source 1..321: mol_type = other RNA
caatcagtactaacacaaccaccatcagtatcagcagcaccaggacaaaaagtaacaatatcatgctcaggaggaacatcaaacataggaaacaactacgtatcatggtaccaacacctaccaggaacagcaccaaaactactaatatacgaaaacaacaaaagaccatcaggaataccagacagattctcaggagcaaaatcaggaacatcagcaacactagcaataacaggactacaaacaggagacgaaggagactactactgcgcaacatggtcaggatcactaaacataggaacaggaacaaaagtaacagtacta

SEQ ID NO: 48368 - RNA, 324 nt, synthetic construct
  misc_feature 1..324: note = derived and/or modified sequence opt6 from anti-HIV_119-013582_VR-Chain
  source 1..324: mol_type = other RNA
caaagcatggtaacacaatcaccatcagtatcagcagcaccaggacaaaaagtaacaatatcatgctcaggaacaagcagtaacataggacaaaactacgtatcatggtatcaacaactaccaggaacagcaccaaaattactaataagcgaaaacaacagaagaccatcaggaacaccagacagattcagcggaagcaaaagcggaacatcagcaacactagcaataacaggactacaaacaggagacgaagcagactactactgcgaaacatgggacggatcaggaggagtattcggaacaggaacaaaagtaacagtacta

SEQ ID NO: 48369 - RNA, 333 nt, synthetic construct
  misc_feature 1..333: note = derived and/or modified sequence opt6 from anti-HIV_119-013364_VR-Chain
  source 1..333: mol_type = other RNA
caatcagtattaacacaaccaccaagcgtaagcgcagcaccaggacaaaaagtaacaataagttgtagcggaagctcaagtaatataggaaacaattacgtaagctggtaccaacaattaccaggaacagcaccaaaactattaatatatgacaataacaaaagaccaagcggaataccagacagattctcaggatcaaaatcaggaacaagcgcaacattagcaataacaggactacatacaggagacgaagcagattactattgcacagtatggggagtaagaaaaggagtaggagcagtatttggaacaggaacaaaagtaacagtacta

SEQ ID NO: 48370 - RNA, 333 nt, synthetic construct
  misc_feature 1..333: note = derived and/or modified sequence opt6 from anti-HIV_119-012886_VR-Chain
  source 1..333: mol_type = other RNA
caatcaatattaacacaaccaccaagcgtaagcgcagcaccaggacaaaaagtaacaataagctgtagcggaagctcaagcacaataggaacaaattacgtaagctggtaccaacaatttccaggaacagcaccaaaattattagtatttgaaacacacagaagaccaagcggaataccagacagattctcaggatcaaaatcaggaacaagcgcaacattagcaataacaggactacaaacaggagacgaagcagattactattgcgcagtatggggagtaagaagaggagtaggagcagtatttggagcaggaacaaaagtaacagtacta

SEQ ID NO: 48371 - RNA, 333 nt, synthetic construct
  misc_feature 1..333: note = derived and/or modified sequence opt6 from anti-HIV_119-012249_VR-Chain
  source 1..333: mol_type = other RNA
caatcagtattaacacaaccaccaagcgtaagcggagcaccaggacaaaaagtaacaataagctgtagcggaagctcaagcaatataggaagaaattacgtatcatggtaccaacaactaccaggaacagcaccaaaactattaatatatgaaaataacaaaagaccaagcggaataccagacagattcagtggatcaaaatcaggaacaagcgcaacattagtaataacaggactacaaacaggagacgaagcagatttctattgcggaacatgggacggaagcctaagtggaggaggagtaataggaacaggaacaagagtaacagtacta

SEQ ID NO: 48372 - RNA, 324 nt, synthetic construct
  misc_feature 1..324: note = derived and/or modified sequence opt6 from anti-HIV_119-012161_VR-Chain
  source 1..324: mol_type = other RNA
caatcattcctaacacaaccaccatcagtatcagcagcaccaggacaaaaagtaacaatatcatgctcaggatcaaactcaaacataggaaaaaactacgtatcatggtaccaatacctaccaggaacagtaccaaaattactaatatacgaaaacgacaaaagaccatcaggaataccaggaagattctcagcatcaaaatcaggaacatcagcaacactagcaataacaggactacaaacaggagacgaagcagactactactgcggaacatgggacggatcaggaggagtattcggaacaggaacaaaagtaacagtacta

SEQ ID NO: 48373 - RNA, 324 nt, synthetic construct
  misc_feature 1..324: note = derived and/or modified sequence opt6 from anti-HIV_119-012110_VR-Chain
  source 1..324: mol_type = other RNA
caaagcgtactaacacaaccaccatcagtatcagcagcaccaggacaaacagtaacaatatcatgctcaggatcaacatcaaacatagggaaaaacgatgtatcatggtatcaacaactaccaggaacagcaccaaaattactaataagcgaaaacaatagaagaccatcaggaacaccagatagatttagcggaagcaaaagcggaacatcagcaacactagcaatatcaggattacaaacaggagatgaagcagactattactgtggaacatgggatggatcaggaggagtatttggaacaggaacaaaagtaacagtacta

SEQ ID NO: 48374 - RNA, 333 nt, synthetic construct
  misc_feature 1..333: note = derived and/or modified sequence opt6 from anti-HIV_119-012100_VR-Chain
  source 1..333: mol_type = other RNA
caagcagtactaacacaaccaccatcagtatcagcagcaccaggacaaaaagtagcaatatcatgctcaggatcatcatcaaacataggaaacaattacgtatcatggtaccaacaactaccaggaacagtaccaaaactactaatatacgacacagacaaaagaccatcaggaataccagacagattctcaggatcaaaatcaggaacatcagcaacactaggaataacaagactacaaacaggagacgaagcagactactactgcgcaacatgggcaccaagactaaactcagcaagagtattcggaaacggaacaatggtaacagtacta

SEQ ID NO: 48375 - RNA, 324 nt, synthetic construct
  misc_feature 1..324: note = derived and/or modified sequence opt6 from anti-HIV_119-011651_VR-Chain
  source 1..324: mol_type = other RNA
caatcagtactaacacaaccaccatcagtatcagcagcaccaggacaaaaagtaacaatatcatgctcaggaaactcatcaaacataggaaacaactacgtatcatggtaccaacaactaccaggaacagcaccaaaactactaatatacgaaaacaacaaaagaccatcaggaataccagacagattctcaggatcaaaatcaggaacatcagcaacactagcaataacaggactacaaacaggagacgaagcagactactactgcgcaacatgggacggaagagtatcagtattcggaacaggaacaaaagtagcagtacta

SEQ ID NO: 48376 - RNA, 333 nt, synthetic construct
  misc_feature 1..333: note = derived and/or modified sequence opt6 from anti-HIV_119-011479_VR-Chain
  source 1..333: mol_type = other RNA
caatcagtattaacacaaccaccaagcgtaagcgcaacaccaggacaaaaagtaacaataagctgtagtggaagtaatagcaatataggaaacaaatacgtaagctggtaccaacactttccaggaacagcaccaaaactattaatatatgaaaataacagaagaccaagcggaataccagacagattctcaggatcaaaatcaggaacaagcgcaacattagcaataacaggactacaaacaggagacgaagcagattactattgcacaatatggggagtaagaaaaggagtaggagcagtatttggaacaggaacaaaagtaacagtacta

SEQ ID NO: 48377 - RNA, 333 nt, synthetic construct
  misc_feature 1..333: note = derived and/or modified sequence opt6 from anti-HIV_119-011232_VR-Chain
  source 1..333: mol_type = other RNA
caatcagtattaacccaaccaccgagcgtaagcgcagcaccaggacaaaacgtaaacataagctgtagcggaggatcaagcaatataggaagcaattacgtaagctggtaccaacaatttccaggaacagcaccaaaactattaatatatgacgatgacaaaagaccaagcggaataccacacagattctcagcatcaaaatcaggaacaagcgcaacattagcaataagcggactacaaacaggagacgaagcagattactgttgcgcagtatggggagtaagaagaggagcaggagcagtatttggagcaggaacaaaagtaacagtacta

SEQ ID NO: 48378 - RNA, 333 nt, synthetic construct
  misc_feature 1..333: note = derived and/or modified sequence opt6 from anti-HIV_119-011175_VR-Chain
  source 1..333: mol_type = other RNA
caatcagtattaacacaaccaccaagcgtaagcgcagcaccaggacaaaaagtaacaataagctgtagtggaagtaatagctatataggaaacaaatatgtaagctggtaccaacaatttccaggaacagcaccaaaattattaatatatgaaaataacagaagaccaagcggaataccagacagattctcaggatcaaaatcaggaacaagcgcaacactagcaataagcggactacaaacaggagacgaagcagattactgttgcgcagtatggggagtaagaagaggagcaggagcagtatttggaccaggaacaaaagtaacagtacta

SEQ ID NO: 48379 - RNA, 321 nt, synthetic construct
  misc_feature 1..321: note = derived and/or modified sequence opt6 from anti-HIV_119-008396_VR-Chain
  source 1..321: mol_type = other RNA
caatcagtactaacacaaccaccatcagtatcagcagcaccaggacaaaaagtaacaataagctgctcaggatcatcatcaaacataggaaacaactacgtatcatggtaccaacaagtaccaggaacagcaccaaaactattagtatacgaaaacacaagaagaccatcaggagtaccagacagattctcaggagcaaaatcaggaacatcagcaacactagcaataacaggactacaaacaggagacgaaggagactactactgcgcaacatggtcaggatcactaaacataggaacaggaacaaaagtaacagtacta

SEQ ID NO: 48380 - RNA, 324 nt, synthetic construct
  misc_feature 1..324: note = derived and/or modified sequence opt6 from anti-HIV_119-007148_VR-Chain
  source 1..324: mol_type = other RNA
caatcagtactaacacaaccaccaagcgtatcagcagcaccaggacaaaaagtaacaatatcatgctcaggatcaacatcaaacataggcaaaaactacgtatcatggtaccaacacctaccaggaacagcaccaaaattactactatacgaaaacgacagaagaccatcaggaacaccagacagattctcaggatcaaaatcaggaacatcagcaacattagcaataacaggactacacacaggagacgaagcagactactactgcgaaacatgggacggatcaggaggagtattcggaacaggaacaaaagtaacagtacta

SEQ ID NO: 48381 - RNA, 333 nt, synthetic construct
  misc_feature 1..333: note = derived and/or modified sequence opt6 from anti-HIV_119-007029_VR-Chain
  source 1..333: mol_type = other RNA
caatcagtattaacacaaccaccaagcgtaagtgcagcaccaggacaaaaagtaacaataagctgtagcggaaactcaagtaatataggaaacaatttcgtatcatggtaccaacaagtaccaggaacagcaccaaaactattactatatgaaacatacagaagaccaagcggaatatcagacagattctcaggatcaaaatcaggaacaagcgcaacattagcaataacaggactccaaacaggagacgaagcagattactattgcacagtatggggagtacgaaaaggagtaggagcagtatttggaacaggaacaaaagtaacagtacta

SEQ ID NO: 48382 - RNA, 324 nt, synthetic construct
  misc_feature 1..324: note = derived and/or modified sequence opt6 from anti-HIV_119-004707_VR-Chain
  source 1..324: mol_type = other RNA
caaagcgtactaacacaaccaccatcagtatcagcagcaccaggacaaaaagtaacaatatcatgctcaggatcaacatcaaacataggaaaaaacgacgtatcatggtatcaacaattaccaggaacagcaccaaaactactaataagcgaaaacaacagaagaccatcaggaacaccagacagattcagcggaagcaaaagcggaacatcagcaacattagcaataacaggactacaaacaggagacgaagcagactactactgtgaaacatgggacggatcaggaggagtattcggaacaggaacaaaagtaacagtacta

SEQ ID NO: 48383 - RNA, 333 nt, synthetic construct
  misc_feature 1..333: note = derived and/or modified sequence opt6 from anti-HIV_119-003910_VR-Chain
  source 1..333: mol_type = other RNA
caatcagtattaacacaaccaccaagcgtaagcgcagcaccaggacaaaaagtagcaataagctgtagtggaaacacaagctcaataggaaacaatttcgtaagctggtaccaacaagtaccaggaacagcaccaaaactattagtatatgaaacatacagaagaccaagcggaataccagacagattctcaggatcaaaatcaggaacaagtgcaacattagcaataacaggactacaaacaggagacgaagcagattactattgcacagtatggggagtaagaaaaggagtaggagcagtatttggaacaggaacaaaagtaacagtacta

SEQ ID NO: 48384 - RNA, 321 nt, synthetic construct
  misc_feature 1..321: note = derived and/or modified sequence opt6 from anti-HIV_119-002450_VR-Chain
  source 1..321: mol_type = other RNA
caatcagtactaacacaaccaccatcagtatcaggagcaccaggacaaagagtaacaatatcatgcacaggatcatcatcaaacataggaaacaactacgtatcatggtaccaaggactaccaggaacagcaccaaaactactaatatatgaaaacaacaaaagaccatcaggaataccagacagattctcaggagcaaaatcaggaacagcagcaacattagcaataacaggactacaaacaggagacgaagcagactactactgcgcaacatggtcaggatcactaaacttcggaacaggaacaaaagtaacagtacta

SEQ ID NO: 48385 - RNA, 321 nt, synthetic construct
  misc_feature 1..321: note = derived and/or modified sequence opt6 from anti-HIV_119-001552_VR-Chain
  source 1..321: mol_type = other RNA
caatcagtattaacacaaccaccatcagtatcagcagcaccaggacaaaaagtaacaatatcatgctcaggatcaaactcatacctaggaaacaaatacgtatcatggtaccaacaattcccaggaacagcaccaaaactactaatatacgaaaacaacaaaagaccatcaggaataccagacagattctcagcatcaaaatcagcagcatcagcaacattagcaataacaggactacaaacaggagacgaaggagactactactgcgcaacatggacaggatcactaaacataggaacaggaacaaaagtaacagtacta

SEQ ID NO: 48386 - RNA, 333 nt, synthetic construct
  misc_feature 1..333: note = derived and/or modified sequence opt6 from anti-HIV_059-188169_VR-Chain
  source 1..333: mol_type = other RNA
caatcagtactaacacaaccaccatcagtatcagcagcaccaggacaaaaagtaacaatatcatgctcaggatcaacatcaaacataggagacaactacgtatcatggtaccaacaagtaccaggaacagcaccaaaactactaatatacgaaaacaacagaagaccatcaggaacaccagacagattctcaggatcaaaatcaggaacatcagcaacactagcaataacaggactacaaacaggagacgaagcagactactactgcggaacatgggacacatcactatcaacaggaggagtattcggaacaggaacaaaagtaacagtacta

SEQ ID NO: 48387 - RNA, 333 nt, synthetic construct
  misc_feature 1..333: note = derived and/or modified sequence opt6 from anti-HIV_059-183739_VR-Chain
  source 1..333: mol_type = other RNA
caatcagtattaacacaaccaccaagcgtatcagcagcaccaggacaaaaagtaacaatatcatgctcaggatcaacatcaaacataggaaaaaactacgtatcatggtaccaacaactaccaggaacagcaccaaaactactaatatacgaaaacaacagaagaccatcaggaacaccagacagattctcaggatcaaaatcaggaacatcagcaacactaggaatatcaggactacaaacaggagacgaagcagactactactgcggaacatgggacacatcactatcaggaggaggagtattcggaacaggaacaaaagtaacagtatta

SEQ ID NO: 48388 - RNA, 333 nt, synthetic construct
  misc_feature 1..333: note = derived and/or modified sequence opt6 from anti-HIV_059-182376_VR-Chain
  source 1..333: mol_type = other RNA
caatcagtattaagccaaccaccatcagtatcagcagcaccaggacaaaaagtaacaatatcatgttcaggatcatcatcaaatataggaaactattacgtatcatggtaccaacaatttccaggaacagcaccaaaactattaatatataaaaatgacaatagaccaagcggaataccagacagattctcaggatcaaaatcaggaacatcagcaacattaggaatatcaggactacaaacaggagacgaagcagattactattgcggaacatggggaacatcattatcaggaggaggagtatttggaacaggaacaaaagtaacagtacta

SEQ ID NO: 48389 - RNA, 333 nt, synthetic construct
  misc_feature 1..333: note = derived and/or modified sequence opt6 from anti-HIV_059-182199_VR-Chain
  source 1..333: mol_type = other RNA
caatcagtactaacacaaccaccatcagtatcagcagcaccaggacaaaacataacaatatcatgctcaggatcatcatcaaacataggatcacactcaatatcatggtaccaacacctaccaggaacagcaccaaaaatagtaatatacgacaacgacaaaagaccactaggaataccagacagattctcaggatcaaaatcaggaacatcagcaacactaggaataacaggactacaaacaggagacgaagcagactactactgcggaacatgggacacatcactatcaggaggaggagtattcggaccaggaacaaaagtaacagtacta

SEQ ID NO: 48390 - RNA, 324 nt, synthetic construct
  misc_feature 1..324: note = derived and/or modified sequence opt6 from anti-HIV_059-169202_VR-Chain
  source 1..324: mol_type = other RNA
cactcagtactaacacaaccaccatcagtatcagcagcaccaggacaaaaagtaacaatatcatgctcaggatcatcatcaaaaataggaaacaacttcgtatcatggtaccaacaactaccaggaacagcaccaaaactactaatatacgaaaacaacaaaagaccatcaggaataccagacagattctcaggatcaaaatcaggaacaagcgcaacactagcaataacaggactacaaacaggagacgaagcagactactactgcggaacatgggacggaagagtatcagtaataggatcaggaacaaaactaacagtatta

SEQ ID NO: 48391 - RNA, 324 nt, synthetic construct
  misc_feature 1..324: note = derived and/or modified sequence opt6 from anti-HIV_059-155645_VR-Chain
  source 1..324: mol_type = other RNA
caatcagcattaacacaaccagcatcagtatcaggatcaccaggacaatcaataacaatatcatgcacaggaacatcatcagacgtaggatacaactacgtatcatggtaccaacaactaccaggaacagcaccaaaactactaatatacgaaaacaacaaaagaccatcaggaataccagacagattctcaggatcaaaatcaggaacatcagcaacactagcaataacaggactacaaacaggagacgaagcagactactactgcggaacatgggacggaagactatcagtaataggaacaggaacaaaagtaacagtacta

SEQ ID NO: 48392 - RNA, 333 nt, synthetic construct
  misc_feature 1..333: note = derived and/or modified sequence opt6 from anti-HIV_059-151619_VR-Chain
  source 1..333: mol_type = other RNA
caatcagtattaacacaaccaccatcagtatcagcagcaccaggacaaaaagtaacaatatcatgttcaggatcatcatcaaatataggaaacaatttcgtatcatggtaccaactattaccaggaacaccaccaaaactattaatattcaaaaataacgaaagaccatcaggaataccagacagattctcaggatcaaaatcaggaacatcagcaacactaggaataacaggactacaaacaggagacgaaggagactactactgcggaacatgggacacatcactatcaggaggaggagtattcggaacaggaacaagagtaacagtacta

SEQ ID NO: 48393 - RNA, 333 nt, synthetic construct
  misc_feature 1..333: note = derived and/or modified sequence opt6 from anti-HIV_059-146503_VR-Chain
  source 1..333: mol_type = other RNA
caaagcgtattaacacaaccaccaagtgtaagcgcaacaccaggacaaaaagtaacaataagctgtagcggaagcgcaagcaatataggaaacaattacgtaagctggtaccaacaatttccaggaacagcaccaaaactattaatatatgacacaaacaaaagaccaagcggaataccagacagattctcaggatcaaaatcaggaacaagcgcaatattaggaataacaggactacaaataggagacgaagcagattactattgcggaacatgggacacatcattaagcggaggaggagtatttggaacaggaacaaaagtaacagtacta

SEQ ID NO: 48394 - RNA, 324 nt, synthetic construct
  misc_feature 1..324: note = derived and/or modified sequence opt6 from anti-HIV_059-136098_VR-Chain
  source 1..324: mol_type = other RNA
caatcagtattaacacaaccaccaagcgtaagcgcagcaccaggacaaagagtaacaataagctgtagcggaagctcaagcaatataggaaacaattacgtaagctggtaccaacaattaccaggaacagcaccaaaactattaatatatgaaaataacagaagaccaagcggaataccagacagattctcaggatcaaaatcaggaacaagcgcaacattagcaataacaggactacaaacaggagacgaaggagattactattgcgcaagatgggacggaagattaagcgtaataggaagtggaaccaaagtaacagtatta

SEQ ID NO: 48395 - RNA, 333 nt, synthetic construct
  misc_feature 1..333: note = derived and/or modified sequence opt6 from anti-HIV_059-105516_VR-Chain
  source 1..333: mol_type = other RNA
caatcagcactaacacaaccaccatcagtatcagcagcaccaggacaaaaagtaacaatatcatgctcaggatcatcatcaaacataggaaacaattacgtatcatggtaccaacaactaccaggaacagcaccaaaactactaatatacgacaacaacaaaagaccatcaggaataccagacagattctcaggatcaaaatcaggaacatcagcaacattagcaatagcaggactacaaacaggagacgaagcaaactactactgcggaacatgggacggatcactaagaacaggaggagtattcggaacaggaacaaaagtaacagtacta

SEQ ID NO: 48396 - RNA, 333 nt, synthetic construct
  misc_feature 1..333: note = derived and/or modified sequence opt6 from anti-HIV_059-095709_VR-Chain
  source 1..333: mol_type = other RNA
caaagcgtattaacacaaccaccaagcgtaagcgcagcaccaggacaaaaagtaacaataagctgtagcggaagatcaagcaatataggaaacaatttcgtaagctggtaccaactattaccaggaacagcaccaaaattattaatatataaaaataacgaaagaccaagcggaataccagacagattctcagcatcaaaatcaggaacaagcgcaacattaggaataacaggactacaaacaggagacgaagcagattactattgcggaacatgggacacatcattaagcggaggaggagtatttggaacaggaacaaaagtaacagtacta

SEQ ID NO: 48397 - RNA, 333 nt, synthetic construct
  misc_feature 1..333: note = derived and/or modified sequence opt6 from anti-HIV_059-069468_VR-Chain
  source 1..333: mol_type = other RNA
caaagtgtattaacacaaccaccatcagtatcaggagcaccaagacaatcagtaataatatcatgcacaggatcaagctcaaacataggaggattcgatgtacactggtatcaacaactaccaggaacagcaccaaaattattaatatacgaaaacaacagaagaccatcaggaacaccagacagatttagcggaagcaaaagcggaacatcagcaacactagcaataacaggattacaaacaggagacgaagcagactattactgtggaacatgggatggatcactatcaacaggaggagtaataggaacaggaacaaaagtaacagtatta

SEQ ID NO: 48398 - RNA, 333 nt, synthetic construct
  misc_feature 1..333: note = derived and/or modified sequence opt6 from anti-HIV_059-060026_VR-Chain
  source 1..333: mol_type = other RNA
caatcagtattaacacaaccaccaagcgtaagcgcagcaccaggacaaaaagtaacaataagttgtagcggaagctcatcaaatataggaaacaattacgtaagctggtaccaacaattaccaggaacagtaccaaaactactaatatataaaaatgacaaaagaccaagcggaataccagacagattctcaggatcaaaatcagcaacaagcgcaacattaggaataacaggactacaaacaggagacgaagcagattactattgcggaatatgggacacaagtttaagcgcaggaggagtatttggaacaggaacaagagtaacagtacta

SEQ ID NO: 48399 - RNA, 333 nt, synthetic construct
  misc_feature 1..333: note = derived and/or modified sequence opt6 from anti-HIV_059-053668_VR-Chain
  source 1..333: mol_type = other RNA
caatcagtactaacacaaccaccctcagtatcagcagcaccaggacaaaaagtaacaatatcatgctcaggatcatcatcaaacataggaaacaactacgtatcatggtaccaacaactaccaggaacagcaccaaaactactaatatacgaaaacaacaaaagatcatcaggaataccagacagattctcaggaagcaaaagcggaacatcagcaacactagcaataacaggattacaaacaggagacgaagcagactactactgcggaacaagagactcatcattatcaggaggaggagtaataggaacaggaacaaaagtaacagtacta

SEQ ID NO: 48400 - RNA, 333 nt, synthetic construct
  misc_feature 1..333: note = derived and/or modified sequence opt6 from anti-HIV_059-052864_VR-Chain
  source 1..333: mol_type = other RNA
caatcagtactaacacaaccaccatcactatcagcagcaccaggacaaagagtaacaatatcatgctcaggatcatcatcaaacataggaaacaactacgtatcatggtaccaacaactaccaggaacagcaccaaaactactaatatacgaatcaaacaaaagaccatcaggaacaccagacagattctcaggatcaaaatcaggaacatcagcaacactagcaataacaggactacaaacaggagacgaagcagactactactgcggaacatgggacgcatcactatcatcaggaggagtaatgggaacaggaacaaaagtaacagtacta

SEQ ID NO: 48401 - RNA, 333 nt, synthetic construct
  misc_feature 1..333: note = derived and/or modified sequence opt6 from anti-HIV_059-050968_VR-Chain
  source 1..333: mol_type = other RNA
caaagcgtattaacacaagcaccaagcgtaagcgcagcaccaggagaaaaagtaacaataagctgtagcggaacatcaagcaatataggatactattacgtaagctggtaccaacaatttccaggaacagcaccaaaagtagtaatatatgaaaataacagaagaccaagcggaacaccagacagattctcaggatcaaaatcaggaacaagcgcaacattagcaataacaggactacaaacaggagacgaagcagattactattgcggaacatggggaggatcattaagcacaggaggagtaataggaacaggaacaaaagtaacagtacta

SEQ ID NO: 48402 - RNA, 333 nt, synthetic construct
  misc_feature 1..333: note = derived and/or modified sequence opt6 from anti-HIV_059-046422_VR-Chain
  source 1..333: mol_type = other RNA
caatcagtactaacacaaccaccatcagtatcagcagcaccaggacaaaaagtaacaatatcatgctcaggatcatcatcaacaataggaaacaattacatatcatggtaccaactactaccaggaacaccaccaaactacctaatattcaaaatatcagaaagaccatcaggagtaccagacagattctcaggatcaaaatcaggaacatcagcaacactacacataacaggactacaaacaggagacgaaggagactactactgcggaacatgggacacatcactatcaggaggaggagtattcggaacaggaacaaaagtaacagtacta

SEQ ID NO: 48403 - RNA, 333 nt, synthetic construct
  misc_feature 1..333: note = derived and/or modified sequence opt6 from anti-HIV_059-045120_VR-Chain
  source 1..333: mol_type = other RNA
caatcagtattaacacaaccaccaagcgtaagcgcagcaccaggacaaaaagtagcaataagctgtagcggaagctcaagcacaataggaaacaattacgtaagctggtaccaactattaccaggaacaccaccaaaactattaatatttaaaagtcacgaaagaccaagcggaataccagacagattctcaggatcaaaatcaggaacaagcgcaacattaggaataacaggactacaaacaggagacgaaggagattactattgcggaacatgggacagctcattaagcgtaggaggagtatttggaacaggaacaaaagtaacagtacta

SEQ ID NO: 48404 - RNA, 333 nt, synthetic construct
  misc_feature 1..333: note = derived and/or modified sequence opt6 from anti-HIV_059-039932_VR-Chain
  source 1..333: mol_type = other RNA
caatcagtactaacacaaccaccatcagtatcagcagcaccaggacaaaaagtaacaataagctgctcaggatcatcatcaataataggaaaaaactacgtatcatggtaccaacacctaccaggaacagcaccaaaactactaatatacgaaaacaacaaaagaccatcaggaataccagacagattctcaggatcaaaatcaggaacatcagcaacattagcaatagcaggactacaaacaggagacgaagcaaactactactgcggaacatggggaggatcactatcaacaggaggagtattcggaacaggaacaaaagtaacagtacta

SEQ ID NO: 48405 - RNA, 333 nt, synthetic construct
  misc_feature 1..333: note = derived and/or modified sequence opt6 from anti-HIV_059-038595_VR-Chain
  source 1..333: mol_type = other RNA
caatcagtattaacacaaccaccaagcgtaagtgcagcaccaggacaaaaagtaacaataagttgtagcggaagatcaagcaacataggaaacaatttcgtaagctggtaccaacaattaccaggaacagcaccaaaactattaatatatgaaaataacaaaagaccaagtggaataccagacagattctcaggatcaaaatcaggaacaagcgcaacattaggaataacaggactacaaacaggagacgaagcagattactattgcggaacatgggacacatcattaagcgcaggaggagtatttggaagcggaacaaaagtaatagtacta

SEQ ID NO: 48406 - RNA, 333 nt, synthetic construct
  misc_feature 1..333: note = derived and/or modified sequence opt6 from anti-HIV_059-035082_VR-Chain
  source 1..333: mol_type = other RNA
caatcagtactaacacaaccaccatcagtatcagcagcaccaggacaaaaagtaacaatatcatgctcaggatcaacatcaaacataggaaaatcattcgtatcatggtaccaacaattaccaggaacagcaccaaaactactaatatacgacaacaacagaagaccaagcggaacaccagacagattctcaggatcaaaatcaggaacatcagcaacactagcaataacaggactacaaacaggagacgaagcagactactactgcggaacatggggaggatcactatcaacaggaggagtaataggaacaggaacaaaagtaacagtacta

SEQ ID NO: 48407 - RNA, 333 nt, synthetic construct
  misc_feature 1..333: note = derived and/or modified sequence opt6 from anti-HIV_059-029204_VR-Chain
  source 1..333: mol_type = other RNA
caatcagtactaacacaaccaccatcagtatcagcagcaccaggacaaaaagtaacaatatcatgctcaggatcaacatcaaacataggaaaaatactagtatcatggtaccaacaactaccaggaacagcaccaaaaccatcaatatacgacaacaacagaagaccatcaggaaccccagacagattctcaggatcaaaatcaggaacatcagcaacactagcaataacaggactacaaacaggagacgaagcagactactactgcggaacatgggacggatcactatcaacaggaggagtaataggaacaggaacaaaagtaacagtacca

SEQ ID NO: 48408 - RNA, 324 nt, synthetic construct
  misc_feature 1..324: note = derived and/or modified sequence opt6 from anti-HIV_059-025235_VR-Chain
  source 1..324: mol_type = other RNA
caatcagtactaacacaaccaccatcagtatcaggagcaccaggacaaaaaataacaatatcatgctcaggatcaacatcaaacataggaaaatcatacgtatcatggtaccaacaactaccaggaacagcaccaaaactactaatatacgaaaacaacagaagaccatcaggaacaccagacagattctcaggatcaaaatcaggaacatcagcaacactagcaataacaggactacaaacaggagacgaagcagactactactgcggaacatgggacggatcaggaggagtaataggaacaggaacaaaagtaacagtacta

SEQ ID NO: 48409 - RNA, 333 nt, synthetic construct
  misc_feature 1..333: note = derived and/or modified sequence opt6 from anti-HIV_059-015192_VR-Chain
  source 1..333: mol_type = other RNA
caatcagtactaacacaaccaccatcagtatcagcagcaccaggacaaaaagtaacaatatcatgctcaggatcatcatcaacaataggagacaaatacgtatcatggtaccaactactaccaggaacagcaccaaaactactaatatacaaaaacaacaaaagaccatcaggaataccagacagattctcaggatcaaaatcaggaacatcagcaacactaggaataacaggactacaaacaggagacgaagcagactactactgcggaacatgggacacatcactatcagtaggaggagtattcggaacaggaacaaaagtaacagtacta

SEQ ID NO: 48410 - RNA, 333 nt, synthetic construct
  misc_feature 1..333: note = derived and/or modified sequence opt6 from anti-HIV_059-007060_VR-Chain
  source 1..333: mol_type = other RNA
caatcagtactaacacaaccaccatcagtatcagcagcaccaggacaaaaagtaacaatatcatgctcaggatcatcatcaaacataggaaacaaatacgtatcatggtaccaacaactaccaggaacagcaccaaaactactaatatacgaaaacaaaaaaagaccatcaggaataccagacagattctcaggatcaaaatcaggaacatcagcaacactaggaataacaggactacaaacaggagacgaagcagactacttctgcggaacatgggacacatcactatcaggaggaggagtattcggatcaggaacaaaagtaacagtacta

SEQ ID NO: 48411 - RNA, 324 nt, synthetic construct
  misc_feature 1..324: note = derived and/or modified sequence opt6 from anti-HIV_059-006953_VR-Chain
  source 1..324: mol_type = other RNA
caaagcgtactaacacaaccaccatcagtatcagcagcaccaggacaaaaagtaacaatatcatgctcaggatcaagctcaaacataggagtaagctggtaccaacaagtaccaggaacagcaccaaaactattaatatatgacaatgacaaaagaccaacaggaataccagacagattctcaggatcaaaatcaggaacaagcgcaatattagcaataacaggactacaaacaggagacgaaggagattactattgcggaacatgggaaacaagcctaagcggaggaggagtatttggaacaggaacaaaagtaacagtacta

SEQ ID NO: 48412 - RNA, 333 nt, synthetic construct
  misc_feature 1..333: note = derived and/or modified sequence opt6 from anti-HIV_059-005953_VR-Chain
  source 1..333: mol_type = other RNA
cactcagtactaacacaaccaccatcagtatcagcagcaccaggacaaaaagtaacaatatcatgctcaggaacatcatcaaacataggaaaaaactacgtatcatggtaccaacaactaccaggaacagcaccaaaactactaatatacgaaaacaacagaagaccatcaggaacaccagacagattctcaggatcaaaatcaggaacatcagcaacactagcaataacaggactacaaacaggagacgaagcagactactactgcggaacatgggacacatcactatcaacaggaggagtattcggaacaggaacaaaagtaacagtacta

SEQ ID NO: 48413 - RNA, 324 nt, synthetic construct
  misc_feature 1..324: note = derived and/or modified sequence opt6 from anti-HIV_059-003725_VR-Chain
  source 1..324: mol_type = other RNA
caatcagtactaacacaaccaccatcagtatcagcagcaccaggacaaaaactaacaatatcatgctcaggatcaacatcaaaaataggaaacaactacgtatcatggtaccaacacctaccaggaacagcaccaaaactactagtatacgaaaacaacaaaagaccatcaggaataccagacagattcagcggatcaaaatcaggaacatcagcaacactagcaataacaggactacaaacaggagacgaagcagactactactgcggaacatgggacggaagactatcagtaataggaacaggaacaaaagtaacagtacta

SEQ ID NO: 48414 - RNA, 333 nt, synthetic construct
  misc_feature 1..333: note = derived and/or modified sequence opt6 from anti-HIV_059-002618_VR-Chain
  source 1..333: mol_type = other RNA
caattagtattaacacaaccaccaagcgtaagcgcagcaccaggacaaaaagtaacaataagctgtagcggaagctcaagcaatataggaaacaatttcgtaagctggtaccaacaattaccaggaacagcaccaaaactattaatatatgaaaataacaaaagaccaagcggaataccagacagattctcaggatcaaaatcaggaacaagcgcaacattaggaataacaggactacaaacaggagacgaagcagattactattgcggaacatgggacacaagattaagcgcaggaggagtatttggaacaggaacaaaagtaacagtacta

SEQ ID NO: 48415 - RNA, 324 nt, synthetic construct
  misc_feature 1..324: note = derived and/or modified sequence opt6 from anti-HIV_059-001522_VR-Chain
  source 1..324: mol_type = other RNA
caatcagtactaacacaaccaccatcagtatcagcagcaccaggacaaaaagtaacaatatcatgctcaggatcaaactcaaacataggaaacaactacgtatcatggtaccaacaactaccaggaacagcaccaaaactactaatatacgaaaacaacaaaagaccatcaggaataccagacagattctcaggatcaaaatcaggaacatcagcaacactagcaataacaggactacaaacaggagacgaagcagactactactgcggaacatgggacggaagactatcagtaataggagcaggaacaaaagtaatagtagta

SEQ ID NO: 48416 - RNA, 333 nt, synthetic construct
  misc_feature 1..333: note = derived and/or modified sequence opt6 from anti-HIV_059-000731_VR-Chain
  source 1..333: mol_type = other RNA
caatcagtactaacacaaccaccatcagtatcagcagcaccaggacaaaaagtaacaatatcatgcagcggatcaacatcaaacataggaaacaaatacgtatcatggtaccaacaagtaccaggaacagcaccaaaactactaatatacgaaaacaacagaagaccatcaggaataccagacagattctcaggatcaaaatcaggaacatcagcaacactagcaataacaggactacaaacaggagacgaagcagactactactgcggaacatgggacgcaagcctaagaacaggaggagtaataggaacaggaacaaaagtaacagtacta

SEQ ID NO: 48417 - RNA, 333 nt, synthetic construct
  misc_feature 1..333: note = derived and/or modified sequence opt6 from anti-HIV_059-000634_VR-Chain
  source 1..333: mol_type = other RNA
caatcagtactaacacaaccaccatcagtatcagcagcaccaggacaaaaagtaacaatatcatgctcaggatcatcatcaacaataggaaacaactacgtatcatggtaccaagtagtaccaggaacagcaccaaaactattaatatacaaaataaacgaaagaccatcaggaataccagacagattctcaggatcaaaatcaggaacatcagcaacactaggaataacaggactacaaacaggagacgaagcagactactactgcggaacatgggacacatcactatcaggaggaggagtattcggcccaggaacaaaagtaacagtacta

SEQ ID NO: 48418 - RNA, 333 nt, synthetic construct
  misc_feature 1..333: note = derived and/or modified sequence opt6 from anti-HIV_048-250757_VR-Chain
  source 1..333: mol_type = other RNA
caatcagtactaacacaaccaccatcagtatcaggagcaccaggacaaagagtaacaatatcatgcacaggaacaacatcaaacataggatcaaactacgtagcatggtaccaacaattaccaggaacagcaccaaaactactaatatacgacaacgacaaaagaccatcaggaataccagacagattctcaggatcaaaatcaggaacatcagcaacactaggaataacaggactacaaacaggagacgaagcagactactactgcggaacatgggacacatcactatcagcaggaggagtattcggaacaggaacaaaagtaacagtacta

SEQ ID NO: 48419 - RNA, 333 nt, synthetic construct
  misc_feature 1..333: note = derived and/or modified sequence opt6 from anti-HIV_048-250716_VR-Chain
  source 1..333: mol_type = other RNA
caatcagtattaacacaaccaccaagcgtaagcgcagcaccaggacaaaaagtaacaataagctgtagcggaagctcaagcaatataggaaacaaatacgtaagctggtaccaacaattaccaggaacagcaccaaaactattaatatatgaaaattcaaaaagaccaagcggaataccagacagattctcaggatcaaaatcaggaacaagcgcaacattaggaataacaggactacaaacaggaggacaagcagattactattgcggaacatgggacacatcattaagcgcaggaggagtatttggaagcggaacaaaagtaacagtacta

SEQ ID NO: 48420 - RNA, 333 nt, synthetic construct
  misc_feature 1..333: note = derived and/or modified sequence opt6 from anti-HIV_048-250463_VR-Chain
  source 1..333: mol_type = other RNA
caatcagtactaacacaaccaccatcagtatcagccgcaccaggacaaaaagtaacaatatcatgctcaggatcaagatcaaacaacggaaacaactacgtatcatggtaccaacaactaccaggaacagcaccaaaactactaatatacgaaaacaacaaaagaccatcaggaataccagacagattctcaggatcaaaatcaggaacatcagcaacactagccataacaggactacaaacaggagacgaagcagactactactgcggaacatgggactcatcactatcaggaggaggagtaataggaacaggaacaaaactaacagtacta

SEQ ID NO: 48421 - RNA, 333 nt, synthetic construct
  misc_feature 1..333: note = derived and/or modified sequence opt6 from anti-HIV_048-248153_VR-Chain
  source 1..333: mol_type = other RNA
caatcagcattaacacaaccagcatcagtaagcgcatcatttggacaaagcataacaataagctgtacaggagcagcaagcgatgtaggatacaattacgtaagctggtaccaacaattaccaggaacaacaccaaaactattaatatatagaaataaccaaagaccaagcggaataccagacagattctcaggatcaaaatcaggaacatcagcaacattaggaataacaggactacaaacaggagacgaagcagattactattgcggaacatgggacacaagcctaagcgcaggaggagtatttggaacaggaacaaaagtaacagtacta

SEQ ID NO: 48422 - RNA, 333 nt, synthetic construct
  misc_feature 1..333: note = derived and/or modified sequence opt6 from anti-HIV_048-247532_VR-Chain
  source 1..333: mol_type = other RNA
caatcagtactaacacaaccaccatcagtatcagcagcaccaggacaacaagtaacaatatcatgctcaggaacaacatcaaacataggaacaaactacgtatcatggtaccaacaaatgccaccagcagcaccaaaactactaatatacgacaacaaaaaaagaccatcagacataccagacagattctcaggatcaaaatcaggaacatcagcaacactaggaataacaggactacaaacaggagacgaagcagactactactgcggaacatgggacacatcactatcagcaggaggagtattcggaacaggaacaaaagtaacagtacta

SEQ ID NO: 48423 - RNA, 333 nt, synthetic construct
  misc_feature 1..333: note = derived and/or modified sequence opt6 from anti-HIV_048-245846_VR-Chain
  source 1..333: mol_type = other RNA
caatcagtattaacacaaccaccaagcgtatcagcaacaccaggacaaagagtaacaatatcatgtacaggatcatcatcaaatataggaggatatgatgtatcatggtaccaagtattaccaggaacagcaccaaaactattaatatatgacagtgacaaaagaccatcaggaataccagacagattctcaggatcacaatcaggaacatcagcaacactaggaataacaggactacaaacaggagacgaagcagattactattgcggaacatgggacacatcattatcaggaggaggagtatttggaacaggaacaaaagtaacagtacta

SEQ ID NO: 48424 - RNA, 333 nt, synthetic construct
  misc_feature 1..333: note = derived and/or modified sequence opt6 from anti-HIV_048-244016_VR-Chain
  source 1..333: mol_type = other RNA
caaagcgtattaacacaaccaccaagcgtaagcggagcaccaggacaaagagtaacaataagctgtacaggaagctcaagcaatataggaggatatgacgtacactggtaccaacaattaccaggaacagcaccaaaactattaatatataaaaatgacaaaagaccaagcggaataccagacagattctcaggatcaaaatcaggaacaagcgcaatattaggaataacaggattacaaacaggagacgaagcagattactattgcggagcatgggacacatcattaagcgcaggaggagtatttggaacaggaacaaaagtaacagtacta

SEQ ID NO: 48425 - RNA, 333 nt, synthetic construct
  misc_feature 1..333: note = derived and/or modified sequence opt6 from anti-HIV_048-243682_VR-Chain
  source 1..333: mol_type = other RNA
caatcactattaacacaaccaccaagcgtaagcgcagcaccaggacaaaaagtaacaataagctgtacaggaagctcaagcaatataggaggatatgacgtacactggtaccaacaattaccaggaacagcaccaaaactattaatatatgaaaataacaaaagaccaagcggaataccagacagattctcaggatcaaaatcaggaacaagcgcaacattaggaataacaggactacaaacaggagacgaagcagattactattgcggaacatgggattcgagcttaagcgcaggaggagtatttggaacaggaacaaaagtaacagtacta

SEQ ID NO: 48426 - RNA, 333 nt, synthetic construct
  misc_feature 1..333: note = derived and/or modified sequence opt6 from anti-HIV_048-243588_VR-Chain
  source 1..333: mol_type = other RNA
caatcactactaacacaaccaccatcagtatcagcaccaccaggacaaatggtatcaatatcatgctcaggatcatcacacaacataggagacaactacgtatcatggtaccaacacctaccaggaacagcaccaaaactactaatatacgacaacaactcaagaccaagcggaataccagacagattctcaggatcaaaatcaggaacatcagcaacactaggaataacaggactacaaacaggagacgaagcagactactactgcggaacatgggacacatcactatcaggaggaggagtattcggaacaggaacaaaagtaacagtacta

SEQ ID NO: 48427 - RNA, 333 nt, synthetic construct
  misc_feature 1..333: note = derived and/or modified sequence opt6 from anti-HIV_048-241775_VR-Chain
  source 1..333: mol_type = other RNA
caatcagtactagcacaaccaccatcagtatcaggagcaccaggacaaagagtaacaatatcatgcacaggatcatcatcaaacataggagaatacgacgtacactggtaccaacaactaccaggaacagcaccaaaactactaatatacgaaaacaacaaaagaccatcaggaataccagacagattctcaggatcaaaatcaggaacatcagcaacactaggaataacaggattacaaacaggagacgaagcagactactactgcggaacatgggactcatcattatcagcaggaggagtattcggaacaggaacaaaagtaacagtacta

SEQ ID NO: 48428 - RNA, 333 nt, synthetic construct
  misc_feature 1..333: note = derived and/or modified sequence opt6 from anti-HIV_048-237996_VR-Chain
  source 1..333: mol_type = other RNA
caaagtgtattaacacaaccaccatcagtaagtggagcaccaggacaaagagtaacaatatcatgtacaggaagtagttcaaatataggaggatatgatgtacattggtatagacaattaccaggaacagcaccaaaattactaatatatgatacagtaaaaagaccatcaggaataccagatagatttagtggaagtaaaagtggaacatcagcaacattaggaataacaggattacaaacaggagatgaagcagattattattgtggaacatgggatacatcattatcagcaggaggagtatttggaacaggaacaaaagtaacagtatta

SEQ ID NO: 48429 - RNA, 330 nt, synthetic construct
  misc_feature 1..330: note = derived and/or modified sequence opt6 from anti-HIV_048-237730_VR-Chain
  source 1..330: mol_type = other RNA
agcgtattaacacaaccaccaagcgtaagcggagcaccaggacaaagagtaacaataagctgtacaggaacaaatagcaatttcggaagcaattacgcacactggtaccaacaagtaccaggaacagcaccaaaactattaatatatagcaataacgcaagaccaagcggaataccagacagattctcaggatcaaaatcaggaacaagcgcaacattaggaataacaggactacaaacaggagacgaagcagattactattgcggaacatgggacacatcattaagcgcaggaggagtatttggaacaggaacaaaagtaacagtacta

SEQ ID NO: 48430 - RNA, 333 nt, synthetic construct
  misc_feature 1..333: note = derived and/or modified sequence opt6 from anti-HIV_048-237253_VR-Chain
  source 1..333: mol_type = other RNA
caatcagtactaacacaaccaccatcagtatcagcagcaccaggacaaaaagtaacagtatcatgttcaggatcatcatcaaatataggatcaaatgacgtatcatggtaccaacaatttccaggagcagcaccaaaactattaatatacaaaaataacgaaagaccatcaggaataccagacagattctcaggatcaaaatcaggaacatcagcaacactaggaataacaggactacaaacaggagacgaagcagactactactgcggaacatgggacacatcactatcagcaggaggagtattcggaacaggaacaaaagtaacagtatta

SEQ ID NO: 48431 - RNA, 333 nt, synthetic construct
  misc_feature 1..333: note = derived and/or modified sequence opt6 from anti-HIV_048-234100_VR-Chain
  source 1..333: mol_type = other RNA
caaagcatgttaacacaaccaccaagcgtaagcgcagcaccaggagaaaaagtaacaataagctgtagcggaagctcaagcaatataggaaaaacattcgtaagctggtaccaacaagtaccaggaacagcaccaaaactattaatatataaaaatgacaatagaccaagcggaataccagacagattctcaggatcaaaatcaggaacaagcgcaacattaggaataagcggactacaaacaggagacgaagcagattactattgcggaacatgggacacatcattaagcggaggaggagtatttggaacaggaacaaaagtaacagtatta

SEQ ID NO: 48432 - RNA, 333 nt, synthetic construct
  misc_feature 1..333: note = derived and/or modified sequence opt6 from anti-HIV_048-230882_VR-Chain
  source 1..333: mol_type = other RNA
caaagcgtattaacacaaccaccaagtgtaagcgcagcaccaggacaaaaagtaacaataagctgtagcggaaactcaagtaatataggaagcaatttcgtaagctggtaccaacaattaccaggaacagcaccaaaactattaatatatgaaaataacaaaagaccaagcggaataccagacagattctcaggatcaaaatcaggaacaagtgcaacattaggaataacaggactacaaacaggagacgaagcagattactattgcggaacatgggacacatcattaagcccaggaggagtatttggtacaggaacaaaagtaacagtacta

SEQ ID NO: 48433 - RNA, 333 nt, synthetic construct
  misc_feature 1..333: note = derived and/or modified sequence opt6 from anti-HIV_048-229473_VR-Chain
  source 1..333: mol_type = other RNA
caaagcgtattaacacaaccaccaagcgtaagcgcagcaccaggacaaaaagtaacaataagctgtagcggaagctcaagcaatataggaaacaattacgtatcatggtaccaacaatttccaggaacagcaccaaaactattaatatatgaaaataacaaaagaccaagcggaataccagacagattctcaggatcaaaatcaggaacaacagcaacattagcaataacaagactacaaacaggagacgaagcagattactattgcggaacatggggaggatcattaagcgcaggaggagtatttggaacaggaacaaaagtaacagtacta

SEQ ID NO: 48434 - RNA, 333 nt, synthetic construct
  misc_feature 1..333: note = derived and/or modified sequence opt6 from anti-HIV_048-228238_VR-Chain
  source 1..333: mol_type = other RNA
caatcagtactaacacaaccaccatcagtatcagcagcacccggacaaaaagtaacaatatcatgctcaggatcatcatcaaacataggaataaactacgtatcatggtaccaacaactaccaggaacagcaccaaaactactaatatacgacaacacaaaaagaccacaaggaataccagacagattctcaggatcaaaatcaggaacatcagcaacactagcaataacaggactacaaacaggagacgaagcagactactactgcggaacatgggacggatcactatcaacaggaggagtaataggaacaggaacaaaagtaacagtacta

SEQ ID NO: 48435 - RNA, 333 nt, synthetic construct
  misc_feature 1..333: note = derived and/or modified sequence opt6 from anti-HIV_048-228027_VR-Chain
  source 1..333: mol_type = other RNA
caatcactattaacacaaagcccaagcgcaagcggaccaccaggacaaagagtaacaataagctgtagcggaagcaatagcaatataggaagcaatacagtaaactggtaccatcacttaccaggagcagcaccaaaactattaatatatgaaaatagcaaaagaccaagcggaataccagacagattctcaggatcaaaatcaggaacaagcgcaacattaggaataacaggactacaaacaggagacgaagcagattactattgcggaacatgggacacaagtttaagcgcaggaggagtatttggatcaggaacaaaagtaacagtacta

SEQ ID NO: 48436 - RNA, 333 nt, synthetic construct
  misc_feature 1..333: note = derived and/or modified sequence opt6 from anti-HIV_048-227795_VR-Chain
  source 1..333: mol_type = other RNA
caatcagtattaacacaaccaccaagcgtaagcgcagcaccaggacaaaaagtaacaataagctgtagcggaagctcaagcaatatagaaagcagaagcgtacactggtaccaacaaaaaccaggacaagcaccagtattagtaatatattacgatagcgatagaccaagtggaataccagacagattctcaggatcaaaatcaggaacagcagcaacactaggaataacaggactacaaacaggagacgaagcagattactattgcggaacatgggacacaagcctaagcgcaggaggagtatttggaacaggaacaaaagtaacagtacta

SEQ ID NO: 48437 - RNA, 333 nt, synthetic construct
  misc_feature 1..333: note = derived and/or modified sequence opt6 from anti-HIV_048-227770_VR-Chain
  source 1..333: mol_type = other RNA
caatcagtactaacacaaccaccatcagtatcaggagcaccaggacaaagagtaacaatatcatgcacaggatcatcatcaaacataggaccaagagacgtacactggtaccaacaactaccaggaacagtaccaaaactactaatatacgacacatacacaagaccatcaggaataccagacagattctcaggatcaaaatcaggagcatcagcaacactagacataacaggactacaaacaggagacgaagcagactactactgcggaatatgggacacatcactatcagcaggaggagtattcggaacaggaacaaaagtaacagtacta

SEQ ID NO: 48438 - RNA, 333 nt, synthetic construct
  misc_feature 1..333: note = derived and/or modified sequence opt6 from anti-HIV_048-225298_VR-Chain
  source 1..333: mol_type = other RNA
caatcagcattaacacaaccaagatcagtatcaggatcaccaggacaatcagtaacaataagctgcacaggaacatcaaacgacgtaggatacgactacgtatcatggtaccaacaactaccaggaacagcaccaaaactactaatatacgacataaacaaaagaccatcaggaataccagacagattctcaggatcaaaatcaggaacatcagcaacactaggaataacaggactacaaacaggagacgaagcagactactactgcggaacatgggacacatcactatcagcaggaggagtattcggaacaggaacaaaagtaacagtacta

SEQ ID NO: 48439 - RNA, 327 nt, synthetic construct
  misc_feature 1..327: note = derived and/or modified sequence opt6 from anti-HIV_048-225090_VR-Chain
  source 1..327: mol_type = other RNA
gaactaacacaaccaccatcagtatcaggagcaccaggacaaagagtaacaatatcatgcacaggatcatcatcaaacataggaggatatgacgtacattggtaccaacaactaccaggaacagcaccaaaactactaatatacgacaacaacaaaagaccatcaggaataccagacagattctcaggatcaaaatcaggaacatcagcaacactaggaataacaggactacaaacaggagacgaagcagactactactgcggaacatgggacacatcactatcaacaggaggagtattcggaacaggaacaaaagtaacagtacta

SEQ ID NO: 48440 - RNA, 333 nt, synthetic construct
  misc_feature 1..333: note = derived and/or modified sequence opt6 from anti-HIV_048-224187_VR-Chain
  source 1..333: mol_type = other RNA
caatcagtactaacacaaccaccatcagcatcaggaacaccaggacaaagagtaacaatatcatgttcaggatcatcagcaaatataggaacaaattacgtattctggtaccaacacttaccaggaacaacaccaagactactaatattcagaaataacgaaagaccatcaggaataccagacagattctcaggatcaaaatcaggaacatcagcaacactaggaattacaggactacaaacaggagacgaagcagactactactgcggaacatgggacacatcactatcagcaggaggagtatttggaacaggaacaaaagtaacagtacta

SEQ ID NO: 48441 - RNA, 333 nt, synthetic construct
  misc_feature 1..333: note = derived and/or modified sequence opt6 from anti-HIV_048-223055_VR-Chain
  source 1..333: mol_type = other RNA
caatcagtactaacacaaccaccatcagtatcagcagcaccaggacaaaaagtaacaatatcatgctcaggatcatcatcaaatataggaaacaactacgtatcatggtaccaacaattcccaggaacagcaccaaaagtattaatatacggaaactcaaaaagaccatcaggaataccagacagattctcaggatcaaaatcaggaacatcagcaacactaggaataacaggactacaaacaggagacgaagcagactactactgcggaacatgggacacatcactatcagcaggaggagtattcggatcaggaacaaaagtaacagtacta

SEQ ID NO: 48442 - RNA, 333 nt, synthetic construct
  misc_feature 1..333: note = derived and/or modified sequence opt6 from anti-HIV_048-222711_VR-Chain
  source 1..333: mol_type = other RNA
caaccagtattaacacaaccaccaagcgtaagcggagcaccaggacaacgagtaacaataagctgtacaggaagctcaagcaatataggaggatatgacgtacactggtaccaacaagtaccaggaacagcaccaaaactattaatatttgaaaataacagaagaccaagcggaataccagacagattctcaggatcaaaatcaggaacaagcgcaacattagcaataacaggactacaaacaggagacgaagcagattactattgcggaacatgggacggaagtttaagcacaggaggagtaataggaacaggaacaaaagtaacagtacta

SEQ ID NO: 48443 - RNA, 333 nt, synthetic construct
  misc_feature 1..333: note = derived and/or modified sequence opt6 from anti-HIV_048-221209_VR-Chain
  source 1..333: mol_type = other RNA
caatcagtattaacacaaccaccaagcgtaagcggagcaccaggacaaagagtaacaataagctgtacaggaaactcaagcaatataggagactatgacgtacactggtaccaacaagtagcaggaacagcaccaaaactattaatatttaaaaataacgaaagaccaagcggaataccagacagattctcaggatcaaaatcaggaacaagcgcaacattaggaataacaggactacaaacaggagacgaagcagattactattgcggaacatgggacacaagtttaagcgcaggaggagtatttggatcaggaacaaaagtaacagtacta

SEQ ID NO: 48444 - RNA, 333 nt, synthetic construct
  misc_feature 1..333: note = derived and/or modified sequence opt6 from anti-HIV_048-220629_VR-Chain
  source 1..333: mol_type = other RNA
caatcagcattaacacaaccagcatcagtatcaggaagcctaggacaatcaataacaatatcatgtacaggaacatcaagagatgtaggatactcatacgtatcatggtaccaacacttaccaggaacagccccaaaactattaatatatgaaaataacaaaagaccatcaggaataccagacagattctcaggatcaaaatcaggaacatcagcaacattaggaataacaggactacaaacaggagacgaagcagactactattgcggaacatgggactcatcattatcagcaggaggagtatttggaacaggaacaaaagtaacagtacta

SEQ ID NO: 48445 - RNA, 333 nt, synthetic construct
  misc_feature 1..333: note = derived and/or modified sequence opt6 from anti-HIV_048-219430_VR-Chain
  source 1..333: mol_type = other RNA
caatcagtactaacacaaccaccatcagtatcagcagcaccaggacaaatggtaacaatatcatgctcaggaagcacatcaaatataggaataaactacgtatcatggtaccaacacgtaccaggaacagcaccaaaactattaatatacgacaacaacaaaagaccatcaggaataccagacagattctcaggatcaaaatcaggaacatcagcaacactaggaataacaggactacacacaggagacgaagcagactactactgcggaacatgggacacatcactatcagcaggaggagtattcggaacaggaacaaaagtaacagtacta

SEQ ID NO: 48446 - RNA, 333 nt, synthetic construct
  misc_feature 1..333: note = derived and/or modified sequence opt6 from anti-HIV_048-216250_VR-Chain
  source 1..333: mol_type = other RNA
caatcagtattaacacaaccaccaagcgtaagtgcagcaccaggacaaaaagtaacaataagctgtacaggaacaacaagcgatttcggatacaattgcgtaagctggtaccaacaacatccaggcagagcaccaaaagtaataatatcaggagtaaacaaaagaccaagcggaataccagacagattctcaggatcaaaatcaggaacaagcgcaacattaggaataacaggactacaaacaggagacgaagcagattactattgcggaacatgggacagctcattaagcgcaggaggagtatttggaacaggaacaaaagtaacagtgcta

SEQ ID NO: 48447 - RNA, 321 nt, synthetic construct
  misc_feature 1..321: note = derived and/or modified sequence opt6 from anti-HIV_048-216133_VR-Chain
  source 1..321: mol_type = other RNA
acacaaccaccatcactatcagcaacaccaggacaaagagtatcaatatcatgttcaggaggaggaagtaacataggaaataatgatgtattttggtttcaacaattcccaggagcaggaccaagattattaatatacgataaccataaaagacactatggaacaccagatagatttagcggaagtaaaagcggaacatcagcaacactagcaataacaggattacaaacaggagatgaagcagcatattactgtggaacatgggatggatcactatcaacaggaggagtaataggaacagggacaaaagtaacagtatta

SEQ ID NO: 48448 - RNA, 333 nt, synthetic construct
  misc_feature 1..333: note = derived and/or modified sequence opt6 from anti-HIV_048-214886_VR-Chain
  source 1..333: mol_type = other RNA
caaagcgcattaacacaaccaagaagcgtaagcggaagcccaggacaaagcgtaacaataagctgtacaggaacatcaagcgatgtaggatacaattacgtaagctggtaccaacaccatccaggaacagcaccaaaactattaatatataaaaataacaatagaccaagcggaataccagacagattctcaggatcaaaatcaggaacaagcgcaacattaggaataacaggactacaaacaggagacgaagcagattactattgcggaacatgggacacatcattaagcgcaggaggagtatttggaacaggaacaaaagtaacagtacta

SEQ ID NO: 48449 - RNA, 333 nt, synthetic construct
  misc_feature 1..333: note = derived and/or modified sequence opt6 from anti-HIV_048-214709_VR-Chain
  source 1..333: mol_type = other RNA
caatcagtactaacacaaccaccatcagtatcagcagcaccaggacaaaaagtaacaatatcatgttcaggatcatcatcaaacataggaaacaactacgtatcatggtaccaacaactaccaggaacagcaccaaaactattaatatacgaaaacgacagaagaccatcaggaataccagacagattctcaggatcaaaatcaggaacatcagcaacactaggaataacaggactacaaacaggagacgaagcagactactactgcggaacatgggacacaagcctatcagcaggaggagtattcggaacaggaacaaaagtaacagtacta

SEQ ID NO: 48450 - RNA, 333 nt, synthetic construct
  misc_feature 1..333: note = derived and/or modified sequence opt6 from anti-HIV_048-214001_VR-Chain
  source 1..333: mol_type = other RNA
caatcagtactaacacaaccaccatcagtatcaggagcaccaggacaaacagtaacaatatcatgctcaggatcaaactcaaacataggaaaccacgacgtacactggtaccaacacgtaccaggaacagcaccaaaactactaatatacgacaacaacaaaagaccatcaggaataccagacagattctcaggatcaaaatcaggaacatcagcaacactaggaataacaggactacaaacaggagacgaagcagaatactactgcgcaacatgggacgcatcactatcaggaggaggagtattcagaacaggaacaaaagtaacagtacta

SEQ ID NO: 48451 - RNA, 333 nt, synthetic construct
  misc_feature 1..333: note = derived and/or modified sequence opt6 from anti-HIV_048-213230_VR-Chain
  source 1..333: mol_type = other RNA
caatcagtactaacacaaccaccatcaatgtcagcagcaccaggacaaaaagtaacaatatcatgctcaggatcatcaaacaacataggaaaaaacgtagtatcatggtaccaacaactaccaggaacagcaccaaaagtactaatatacgaaaacaacaaaagactatcaggaataccagacagattctcaggatcaaaaagcggaacatcagcaacactagtaataacaggactacaaacaggagacgaagcagactactactgcggaacatgggactcatcactatcagcaggaggagtattcggaacaggaacaaaagtaacagtacta

SEQ ID NO: 48452 - RNA, 333 nt, synthetic construct
  misc_feature 1..333: note = derived and/or modified sequence opt6 from anti-HIV_048-212574_VR-Chain
  source 1..333: mol_type = other RNA
caatcagtattaacacaaccaccaagcgtaagcgcagcaccaggacaaagagtaacagtaagttgtagcggaagcacaagcaatatagaaagcaattacgtaagctggtaccaacaagtaccaggaacagcaccaaaactattaatatatgaaaataacaaaagaccaagcggaataccagacagattctcaggatcaaaatcaggaacaagtgcaacattagcaataacaggactacaaacaggagacgaagcagcatactattgcggaacatgggacggcagcttaagcacaggaggagtaataggaacaggaacaaaagtaacagtacta

SEQ ID NO: 48453 - RNA, 333 nt, synthetic construct
  misc_feature 1..333: note = derived and/or modified sequence opt6 from anti-HIV_048-212207_VR-Chain
  source 1..333: mol_type = other RNA
caatcagtactaacacaaccaccatcactatcagcagcaccaggacaaaaagtaacaatatcatgctccggaggatcatcaaacataggaaacaactacgtatcatggtaccaacacctaccaggaacagcaccaaaactactaatatacgacaactacaaaagaccatcaggaataccagacagattctcaggatcaaaatcaggaacatcagcaacactagacataacaggactacaaacaggagacgaagcagactactactgcggaacatgggacacaagcctatcagcaggaggagtattcggaacaggaacaaaagtaacagtacta

SEQ ID NO: 48454 - RNA, 333 nt, synthetic construct
  misc_feature 1..333: note = derived and/or modified sequence opt6 from anti-HIV_048-209146_VR-Chain
  source 1..333: mol_type = other RNA
caatcagtattaacacaaccaccatcagtatcaggagcaccaggacaaaaaataacagtatcatgtacaggaacaacatcaaatataggaccacatgacgtacactggtaccaactagtaccaggaagaccaccaaaactattaatattccacaataacataagaccatcaggaataccagacagattctcaggatcaaaatcaggaatgtcagcaacattaggaataacaggactacaaacaggagacgaagcagactactactgcggaacatgggactcatcattatcagcaggaggagtatttggaacaggaacaaaagtaacagtacta

SEQ ID NO: 48455 - RNA, 333 nt, synthetic construct
  misc_feature 1..333: note = derived and/or modified sequence opt6 from anti-HIV_048-208206_VR-Chain
  source 1..333: mol_type = other RNA
caatcagtactaacacaacccccatcagtatcagcagcaccaggacaaaaagtaacaataagctgctcaggatcatcatcaaacataggatcaaactacgtatcatggtaccaacaattcccaggaacagcaccaagactactaatatacgaaaacgacaaaagaccatcagcaataccagacagattctccggatcaaaatcaggaacatcagcaacactaggaataacaggactacacacaggagacgaagcagactactactgcggaacatgggacggatcactatcaacaggaggagtaataggaacaggaacaaaagtaacagtacta

SEQ ID NO: 48456 - RNA, 333 nt, synthetic construct
  misc_feature 1..333: note = derived and/or modified sequence opt6 from anti-HIV_048-208194_VR-Chain
  source 1..333: mol_type = other RNA
caatcagcattaacacaaccaccatcagcatcaggatcaccaggacaatcagtaacaatatcatgtacaggaacatcatcagacataggatacaaatacgtatcatggtaccaactactaccaggaacaccaccaaaactattaatattcaaaaataacgaaagaccatcaggaataccagacagattctcaggatcaaaatcaggaacaagcgcaacattaggaataacaggactacaaacaggagacgaagcagactactattgcggagcatgggacacatcattatcagcaggaggagtattcggaacaggaacaaaagtaacagtacta

SEQ ID NO: 48457 - RNA, 333 nt, synthetic construct
  misc_feature 1..333: note = derived and/or modified sequence opt6 from anti-HIV_048-207744_VR-Chain
  source 1..333: mol_type = other RNA
caatcagcactaacacaaccagcatcagtatcagcatcattcggacaatcaataacaatatcatgcacaggagcagcatcaacaataggaaacaacctagtatcatggtacagactactaccaggaacagcaccaaaactactaatatacaaaaacgacaacagaccatcaggaataccagacagattctcaggatcaaaatcaggaacatcagcaacactaggaatatcaggactacaaacaggagacgaagcagactactactgcggaacatgggacacatcactatcaggaggaggagtattcggaacaggaacaaaagtaacagtacta

SEQ ID NO: 48458 - RNA, 333 nt, synthetic construct
  misc_feature 1..333: note = derived and/or modified sequence opt6 from anti-HIV_048-206501_VR-Chain
  source 1..333: mol_type = other RNA
caatcagtattaacacaaccaccatcagtaagtggagcaccaggacaaagagtaacaatatcatgttcaggatcatcatcaaatataggaaacaacgcagtaaactggtaccaacaactaccaggaaaagcaccaaaactattaatatacgaaaataacaaaagaccatcaggaataccagacagattctcaggatcaaaatcaggaacatcagcaacactaggaataacaggactacaaacaggagacgaagcagactactactgcggaacatgggactcatcactatcagcaggaggagtattcggaacaggaacaaaagtaacagtatta

SEQ ID NO: 48459 - RNA, 333 nt, synthetic construct
  misc_feature 1..333: note = derived and/or modified sequence opt6 from anti-HIV_048-204221_VR-Chain
  source 1..333: mol_type = other RNA
caatcagtactaacacaaccaccatcagcatcaggaacaccaggacaaagagtaacaatatcatgcttcggatcatcatcaaacatagcatcatcagcagtaaactggtaccaacaactacccggaacagcaccaaaactactaatatacaaaaacgacaaaagaccatcaggaataccagacagattctcaggatcaaaatcaggaacatcagcaacactaggaataacaggactacaaacaggagacgaagcagactactactgcggaacatgggacacatcactatcagcaggaggagtattcggaacaggaacaaaagtaacagtacta

SEQ ID NO: 48460 - RNA, 333 nt, synthetic construct
  misc_feature 1..333: note = derived and/or modified sequence opt6 from anti-HIV_048-204015_VR-Chain
  source 1..333: mol_type = other RNA
caatcagtattaacacaaccaccaagcgcaagcggaacaccaggacaaagagtaacaataagctgtagcggatcatcaagcaatataggaagcaaatacgtatactggtaccaacaattaccaggaacagcaccaaaactattaatatataaaaatgacaatagaccaagcggaataccagacagattctcaggatcaaaatcaggaacaagcgcaacattaggaataagcggactacaaacaggagacgaagcagattactattgcggaacatgggacaccagcttaagcggaggaggagtatttggaacaggaacaaaagtaacagtacta

SEQ ID NO: 48461 - RNA, 333 nt, synthetic construct
  misc_feature 1..333: note = derived and/or modified sequence opt6 from anti-HIV_048-201240_VR-Chain
  source 1..333: mol_type = other RNA
caatcagtactaacacaaccaccatcagtatcagcagcaccaggacaaaaagtaacaatatcatgctcaggatcatcatcaaacataggaaacaactacgtagcatggtaccaacaactaccaggaacagcaccaaaactactaataaaagaaaactcacaacgaccatcaggaataccagacagattctcaggatcaaaatcaggaacatcagcaacactagcaataacaggactacaaacaggagacgaagcagactactactgcggaacatgggacacatcactatcaacaggaggagtattcggaacaggaacaaaagtaacagtacta

SEQ ID NO: 48462 - RNA, 333 nt, synthetic construct
  misc_feature 1..333: note = derived and/or modified sequence opt6 from anti-HIV_048-200455_VR-Chain
  source 1..333: mol_type = other RNA
caatcagcattaacacaaccagcatcagtatcaggatcaccaggacaatcaataacaatatcatgtacaggaacatcatcagatgtaggatacaattacgtatcatggtaccaagtactaccaggaacagcaccaaaactactaatatacaaaaacacagaaagaccatcaggaataccagacagattctcaggatcaaaatcaggaacatcagcaacactagacataacaggactacaaacaggagacgaagcagactactattgcggaacatgggacacatcactatcagcaggaggagtattcggaacaggaacaaaagtaacagtacta

SEQ ID NO: 48463 - RNA, 333 nt, synthetic construct
  misc_feature 1..333: note = derived and/or modified sequence opt6 from anti-HIV_048-200319_VR-Chain
  source 1..333: mol_type = other RNA
caaagcgtagtaacacaaccaccaagcgcaagcggaacaccaggacaaagagtaacaataagctgttcaggaagttcatcaaatataggaagcaaatacgtatactggtaccatcaacatccaggaacagcaccaaaactattaatatatgacaataacaatagaccaagcggaataccagacagattctcaggatcaaaatcaggaacaagcgcaacattaggaataacaggactacaaacaggagacgaagcagattactattgcggaacatgggacacatcattaagcagaggaggagtatttggaacaggaacaaaagtaacagtacta

SEQ ID NO: 48464 - RNA, 333 nt, synthetic construct
  misc_feature 1..333: note = derived and/or modified sequence opt6 from anti-HIV_048-197896_VR-Chain
  source 1..333: mol_type = other RNA
caatcagtactaacacaaccaccatcagtatcagcagcaccaggacaaaaagtaacaatatcatgctcaggagcatcatacaacataggaaaaaactcagtatcatggtaccaacaactaccaggaacaccaccaaaactattaatattcaaaaacaacgaaagaccatcaggaataccagacagattctcaggatcaaaatcaggaacatcagcaacactaggaataacaggactacaaacaggagacgaagcagactactactgcgcaacatgggacacatcactatcagcaggaggagtattcggaacaggaacaaaagtaacagtacta

SEQ ID NO: 48465 - RNA, 333 nt, synthetic construct
  misc_feature 1..333: note = derived and/or modified sequence opt6 from anti-HIV_048-193813_VR-Chain
  source 1..333: mol_type = other RNA
caatcagtactaacacaatcaccatcagtatcagcagcaccaggacaaaaagtaacaatatcatgctcaggatcaaactcaaacgtaggaaactactacgtatcatggtaccaacacctaccaggaacagcaccaaaagtactaatatacgaaggaaacaaaagaccatcaggagtaccagacagattctcaggatcaaaatcaggaacatcagcatcactagcaataacaggactacaaacaggagacgaagcagactactactgcggaacatgggacacatcattatcagcaggaggagtattcggatcaggaacaaaagtaacagtacta

SEQ ID NO: 48466 - RNA, 333 nt, synthetic construct
  misc_feature 1..333: note = derived and/or modified sequence opt6 from anti-HIV_048-192098_VR-Chain
  source 1..333: mol_type = other RNA
caatcagtactaacacaaccaccatcagcatcaggaaccccaggacaaagagtaacaatatcatgctcaggatcaacatcaaacataggaagcaactacgtatactggtaccaacaactaccaggaacaacaccaaaactactaatatacgaaaacaacaaaagaccatcaggaataacagacagattcttcggatcaaaatcaggaccaagcgcaacactagacataacaggactacaaacaggagacgaagcagactactactgcggaacatgggacgcatcactatcagcaggaggagtattcggaacaggaacaaaagtaacagtacta

SEQ ID NO: 48467 - RNA, 333 nt, synthetic construct
  misc_feature 1..333: note = derived and/or modified sequence opt6 from anti-HIV_048-191786_VR-Chain
  source 1..333: mol_type = other RNA
caatcagtattaacacaaccaccaagcgtaagtgcagcaccaggacaaaacgtaaacataagctgtagtggaagctcaagcaatatagaaaacaatttcgtaagctggtaccaaaaactaccaggaacagcaccaaaactattaatatatgacaataacaaaagaccaagcggaataagagacagattctcaggatcaaaatcaggaacaagcgcaacattaggaataacaggactacaaacaggagacgaagcagattactattgcggaacatgggacacaagtttaagcgcaggaggagtatttggatcaggaacaaaagtaacagtacta

SEQ ID NO: 48468 - RNA, 333 nt, synthetic construct
  misc_feature 1..333: note = derived and/or modified sequence opt6 from anti-HIV_048-188746_VR-Chain
  source 1..333: mol_type = other RNA
caatcagtattaacacaaccaccatcagcatcaggaacaccaggacaaaaagtaacaatatcatgttcaggatcaaattcaaatataggatcaaatttcgtatcatggtaccaactattaccaggaacaacaccaaaactattaatataccgaaacaaccaaagaccatcaggagtaccagacagattctcaggatcaaaatcaggaacatcagcaacattaggaataacaggactacaaacaggagacgaagcagactactactgcggaacatgggactcatcactatcagcaggaggagtatttggaacaggaacaaaagtaacagtacta

SEQ ID NO: 48469 - RNA, 333 nt, synthetic construct
  misc_feature 1..333: note = derived and/or modified sequence opt6 from anti-HIV_048-185937_VR-Chain
  source 1..333: mol_type = other RNA
caatcagtactaacacaaccaccatcagtatcagcagcaccaggacaaaaagtaacaatatcatgctcaggaagctcatcaaacataggaaacaactacgtatcatggtaccaacaactaccaggaacagcaccaaaactactaatatacgaaaacaacaaaagaccatcaggaataccatacccaatatcaggatcaaaatcaggaacatcagcaacactaggaataacaggactacaaacaggagacgaagcagactactactgcggaacatgggactcatcactatcagcaggaggagtattcggaacaggaacaaaagtaacagtacta

SEQ ID NO: 48470 - RNA, 333 nt, synthetic construct
  misc_feature 1..333: note = derived and/or modified sequence opt6 from anti-HIV_048-184849_VR-Chain
  source 1..333: mol_type = other RNA
caatcagtattaacacaagcaccaagcgcaagcggaacaccaggacaaacagtaacaataagctgtagcggaagctcaagcaatataggaaccaaatacgtatactggtaccaacaattaccaggaacagcaccaaaactattaatatataaaaataacgaaagaccaagcggaataccagacagattctcaggatcaaaatcaggaacaagcgcaacattaggaataacaggactacaaacaggagacgaagcagattactattgcggaacatgggacacaagtttaagcccaggaggagtatttggaacaggaacaaaagtaacagtacta

SEQ ID NO: 48471 - RNA, 333 nt, synthetic construct
  misc_feature 1..333: note = derived and/or modified sequence opt6 from anti-HIV_048-183089_VR-Chain
  source 1..333: mol_type = other RNA
caatcagtactaacacaaccaccatcagcatcaggaacaccaggacaaagagtaacaatatcatgctcaggatcatcatcaaacataggatcctcatacgtatactggtaccaactactaccaggaacaccaccaaaactactaatattcaaaaacaacgaaagaccatcaggaataccagacagattctcaggatcaaaatcaggaacatcagcaacactaggaataacaggactacaaacaggagacgaagcagactactactgcggaacatgggacacatcactatcagcaggaggagtattcggaacaggaacaaaagtaacagtacta

SEQ ID NO: 48472 - RNA, 333 nt, synthetic construct
  misc_feature 1..333: note = derived and/or modified sequence opt6 from anti-HIV_048-181509_VR-Chain
  source 1..333: mol_type = other RNA
caatcagtactaacacaaccaccatcagtatcaggagcaccaggacaaagagtaacaatatcatgtacaggatcatcatcaaatataggaggatatgacgtacactggtaccatcaattaccaggagcagcaccaaaactattaatatacaaaaatgacaatagaccatcaggaataccagacagattctcaggatcaaaatcaggaacatcagcaacattaggaatatcaggactacaaacaggagacgaagcagactactactgcggaacatgggacacatcactatcaggaggaggagtatttggaacaggaacaaaagtaacagtacta

SEQ ID NO: 48473 - RNA, 333 nt, synthetic construct
  misc_feature 1..333: note = derived and/or modified sequence opt6 from anti-HIV_048-180990_VR-Chain
  source 1..333: mol_type = other RNA
caatcagtattaacacaaccaccatcagtaagcgcagcaccaggacaaagagtaacaataagctgtagcggaagcacaagcaatataggaaacaattacgtaagctggtaccaacactttccaggaaaagtaccaaaagtagtaatatcagaaacaacaaaaagaccaagcggaataccagacagattctcaggatcaaaatcaggaacaagcgcaacattaggaataacaggactacaaacaggggacgaagcagattactattgcggaacatgggacagctcattaagcgcaggcggagtatttggaacaggaacaaaagtaacagtacta

SEQ ID NO: 48474 - RNA, 333 nt, synthetic construct
  misc_feature 1..333: note = derived and/or modified sequence opt6 from anti-HIV_048-177532_VR-Chain
  source 1..333: mol_type = other RNA
caatcagcactaacacaaccaccatcagcatcaggatcactaggacaatcagtaacaatatcatgcacaggaacatcatcagacgtaggaaacaacttcgtatcatggtaccaaaaaaaaccaggaaaagcaccaaaactaatagtatacgaagtaaacaaaagaccatcaggaataccagacagattcagcggatcaaaatcaggaacatcagcaacactaggaataacaggactacaaacaggagacgaagcagactactactgcggaacatgggacacatcactatcaacaggaggagtattcggaacaggaacaaaagtaacagtacta

SEQ ID NO: 48475 - RNA, 324 nt, synthetic construct
  misc_feature 1..324: note = derived and/or modified sequence opt6 from anti-HIV_048-177426_VR-Chain
  source 1..324: mol_type = other RNA
ttaacacaaccacattcagtaagtgaatcaccaggaaaaacagtaacaatatcatgtacaggaacatcatcagatgtaggatacaattacgtatcatggtaccaacaccatccaggaaaagcaccaaaactattaatatatgaagtaacaaaaagaccatcaggaataccagacagattcagtggatcaaaatcaggaacatcagcaacattaggaataacaggactacaaacaggagacgaagcagattactattgcggaacatgggactcatcactatcagcaggaggagtatttggaacaggaacaaaagtaacagtacta

SEQ ID NO: 48476 - RNA, 333 nt, synthetic construct
  misc_feature 1..333: note = derived and/or modified sequence opt6 from anti-HIV_048-177389_VR-Chain
  source 1..333: mol_type = other RNA
caatcagtattaacacaaccaccaagcatgagcgcagcaccaggagaaagagtaacaataagctgtagcggaagctcaagcaatataggaaaccatcacgtaagctggtaccaacaaagaccaggaacagcaccaaaactattaatatatgaaaataacgaaagaccaagcggaataccagacagattctcaggatcaaaatcaggaacaagcgcaacattaggaataacaggactacaaacaggagacgaagcagattactattgcggaacatgggacaccagcttaagcgcaggaggagtatttggatcaggaacaaaagtaacagtacta

SEQ ID NO: 48477 - RNA, 333 nt, synthetic construct
  misc_feature 1..333: note = derived and/or modified sequence opt6 from anti-HIV_048-174266_VR-Chain
  source 1..333: mol_type = other RNA
caatcagtattaacacaaccaccatcagtatcaggagcaccaggacaaagagtaacaatatcatgctcaggatcatcatcaaatataggatcacattacgtatcatggtaccaacaagtaccaggaacagcaccaagattagtaatatatgacacaataaaaagacattcaggaataccagacagattctcaggatcaaaatcaggaacatcagcaacactaggaataacaggactacaaacaggagacgaagcagattactattgcggaacatgggacacatcattatcagcaggaggagtatttggaacaggaacaaaagtaacagtacta

SEQ ID NO: 48478 - RNA, 333 nt, synthetic construct
  misc_feature 1..333: note = derived and/or modified sequence opt6 from anti-HIV_048-172847_VR-Chain
  source 1..333: mol_type = other RNA
caaagcgtattaacacaaccaccaagtgtaagcgcagcaccaggacaaagagtaacagtaagctgtagcggaagcacaagcaatatagaaagcaattacgtaagctggtaccaacaagtaccaggaacagcaccaaaattattaatatatgaaaataacaaaagaccaagcggaataccagacagattctcaggatcaaaatcaggaacaagcgcaacattaggaataacaggactacaaacaggagacgaagcagattactattgcggaacatgggacacatcattaagcgcaggaggagtatttggaacaggaacaaaagtaacagtacta

SEQ ID NO: 48479 - RNA, 333 nt, synthetic construct
  misc_feature 1..333: note = derived and/or modified sequence opt6 from anti-HIV_048-172845_VR-Chain
  source 1..333: mol_type = other RNA
caaagcgcattaacacaaccaccaagcgcaagcggaagcccaggacaaagcgtaacaatatcatgtacaggaacatcaagcgatgtaggatacaattacgtaagctggtaccaacaattaccaggaacagcaccaaaactattaatatatagaaataaccaaagaccaagcggagtaccagacagattctcaggatcaaaatcaggaacatcagcaacattaggaataacaggactacaaacaggagacgaagcagattactattgcgcaacatgggacacatcattaagcgcaggaggagtatttggaacaggaacaaaagtaacagtacta

SEQ ID NO: 48480 - RNA, 333 nt, synthetic construct
  misc_feature 1..333: note = derived and/or modified sequence opt6 from anti-HIV_048-172363_VR-Chain
  source 1..333: mol_type = other RNA
caatcagtactaacacaaccaccatcagtatcagcagcaccaggacaaaaagtaacaatatcatgctcaggatcaggatcaaacataggaaacacatacgtatcatggtaccaacaactaccaggaacagcaccaaaactactaatattcgaagacaacaaaagaccatcaggaataccagacagattctcaggatcaaaatcaggaacatcagcaacactagcaataacaggattacaaacaggagacgaagcagactactactgcggaacatgggactcatcactatcaggaggaggagtaataggaacaggaacaaaactaacagtacta

SEQ ID NO: 48481 - RNA, 333 nt, synthetic construct
  misc_feature 1..333: note = derived and/or modified sequence opt6 from anti-HIV_048-171609_VR-Chain
  source 1..333: mol_type = other RNA
caatcagtactaacacaaccaccatcagtatcagcagcaccaggacaagaagtaacaatatcatgctcagcatcatcatcatcaataggaaacgacttcgtatcatggtaccaacaactaccaggaacagcaccaaaattactaatatacggaaattcaaacagaccatcaggaataccagacagattctcaggatcaaaatcaggaacatcagcaacactaggaataacaggattacaaacaggagacgaagcagactactactgcggaacatgggacacatcactatcaacaggaggagtattcggaacaggaacaaaagtaacagtacta

SEQ ID NO: 48482 - RNA, 333 nt, synthetic construct
  misc_feature 1..333: note = derived and/or modified sequence opt6 from anti-HIV_048-170705_VR-Chain
  source 1..333: mol_type = other RNA
caatcagtactaacacaaccaccatcagtatcagcagcaccaggacaaatggtaacaatatcatgctcaggatcaacatcaaacataggaataaactacgtatcatggtaccaacacgtaccaggaacagcaccaaaactactaatatacgaaaacgtagaaagaagatcaggaataccagacagattctcagcatcaaaatcagcaacatcagcaacactaggaataacaggactacaaacaggagacgaagcagactactactgcggaacatgggacacatcactatcagcaggaggagtcttcggatcaggaacaaaagtaacagtacta

SEQ ID NO: 48483 - RNA, 333 nt, synthetic construct
  misc_feature 1..333: note = derived and/or modified sequence opt6 from anti-HIV_048-168381_VR-Chain
  source 1..333: mol_type = other RNA
caatcagcactaacacaaccagcaagcgtaagcggaagcccaggacaaagcataacaataagctgtacaggaacatcaagcaatataggaagcaattacgtaagctggtaccaacaattaccaggaacagcaccaaaattattaatatatgaaaataaccaaagaccaagcggaataccagacagattctcaggatcaaaatcaggaacaagcgcaacattaggaataacaggactacaaacaggagacgaagcagattactattgcggaacatgggacacaagtttaagcgcaggaggagtatttggatcaggaacaaaagtaacagtatta

SEQ ID NO: 48484 - RNA, 333 nt, synthetic construct
  misc_feature 1..333: note = derived and/or modified sequence opt6 from anti-HIV_048-166619_VR-Chain
  source 1..333: mol_type = other RNA
caatcagtattaacacaaccaccaagcgtaagcggagcaccaggacaaagagtaacaataagctgtacaggaagctcaagcaatataggaggctatcacacacactggtaccaacaattaccaggaacagcaccaaaactattaatatatgaaaatagtaaaagaccaagcggaataccagacagattctcaggatcaaaatcaggaacaagcgcaacattaggaataacaggactacaaacaggagacgaagcagattactattgcggaacatgggacacatcattaagcgcaggaggagtatttggaagcggaacaaaagtaacagtacta

SEQ ID NO: 48485 - RNA, 333 nt, synthetic construct
  misc_feature 1..333: note = derived and/or modified sequence opt6 from anti-HIV_048-162036_VR-Chain
  source 1..333: mol_type = other RNA
caaagcgtactagcacaaccaccatcagtatcaggagcaccaggacaaacagtaacaatatcatgcacaggatcaagttcaaacataggaggatacgatgtacactggtatcaacaactaccaggaacagcaccaaaattactaatatacaaagacgataaaagaccatcaggaataccagacagattcagcggaagcaaaagcggaacatcagcaacattaggaataacaggattacaaacaggagatgaagcagactattactgcggaacatgggacacatcactaaatagaggaggagtattcggaacaggaacaaaagtaacagtatta

SEQ ID NO: 48486 - RNA, 333 nt, synthetic construct
  misc_feature 1..333: note = derived and/or modified sequence opt6 from anti-HIV_048-160042_VR-Chain
  source 1..333: mol_type = other RNA
caatcagtactaacacaaccaccatcagtatcagcagcaccaggacaaaaagtaacaatatcatgctcaggatcatcatcaaacataggaataaactacatatcatggtaccaacaactaccaggaacagcaccaaaaatactaatatacgacaacgacaaaagaccattaggaataccagacagattctcaggatcaaaatcaggaacatcagcaacactaggaataacaggactacaaacaggagacgaagcagactactactgcggaacatgggacgcaagcctatcagcaggaggagtattcggaacaggaacaaaagtaacagtacta

SEQ ID NO: 48487 - RNA, 333 nt, synthetic construct
  misc_feature 1..333: note = derived and/or modified sequence opt6 from anti-HIV_048-159676_VR-Chain
  source 1..333: mol_type = other RNA
caatcagtattaacacaaccaccaagcgtaagcgcaagcccaggacaaaaagtaacaataagctgtagcggaagttcaagcgatataggaagcaattacgtaagctggtacgtacaattaccaggaacagcaccaaaactactaatatataaaaataacgaaagaccaagcggaataccagacagattctcaggatcaaaatcaggaacaagcgcaacattaggaataacaggactacaaacaggagacgaagcagattactattgcggaacatgggacacaagtttaagcgcaggaggagtatttggaacaggaacaaaagtaacagtacta

SEQ ID NO: 48488 - RNA, 333 nt, synthetic construct
  misc_feature 1..333: note = derived and/or modified sequence opt6 from anti-HIV_048-159500_VR-Chain
  source 1..333: mol_type = other RNA
caatcagtactaacacaaccaccatcagtatcagcagcaccaggacaaaacgtaacaatatcatgttcaggatcatggtcaaatataggagcaaattacgtatcatggtaccaacaattaccaggaacagcaccaaaactactaatatacgaaaataacaaaagaccatcaggaataccagacagattctcaggatcaaaatcaggaacaagcgcaacactaggattcacaggactacaaacaggagacgaagcagactactactgcggaacatgggacacatcactatcagcaggaggagtattcggaacaggaacaaaagtaacagtacta

SEQ ID NO: 48489 - RNA, 333 nt, synthetic construct
  misc_feature 1..333: note = derived and/or modified sequence opt6 from anti-HIV_048-159421_VR-Chain
  source 1..333: mol_type = other RNA
caatcactattaacacaagcaccatcagtatcagcagcaccaggacaaacagtaacaatatcatgttcaggatcaaatgcagatataggaaaaaatttcgtatcatggtaccaacaatcaccaggagcagcaccaaaactattaatatatgaaaatgacagaagaccatcaggaataccagacagattctcaggaagtaaatcaggaacaagcgcaacattaggaataacaggactacaaacaggagacgaagcagaatactattgcgcaacatgggacgcatcattatcaggaggaggagtatttggaacaggaactaaagtaacagtacta

SEQ ID NO: 48490 - RNA, 333 nt, synthetic construct
  misc_feature 1..333: note = derived and/or modified sequence opt6 from anti-HIV_048-159333_VR-Chain
  source 1..333: mol_type = other RNA
caatcagtattaacacaaccaccaagcgcaagcggaacaccaggacaaagagtaacaataagctgtagcggaagtaatagcaatataggaagcgatagcgtatactggtaccaacaattaccaggaagatcaccaaaactattaatatatagaaataacgaaagaccaagcggaataccagacagattctcaggatcaaaatcaggaacaagcgcaacattaggaataacaggactacaaacaggagacgaagcagattactattgcggaacatgggacacaagtttaagcgcaggaggagtatttggaacaggaacaaaagtaacagtacta

SEQ ID NO: 48491 - RNA, 333 nt, synthetic construct
  misc_feature 1..333: note = derived and/or modified sequence opt6 from anti-HIV_048-158932_VR-Chain
  source 1..333: mol_type = other RNA
caaagcgtattaacacaaccagcaagtgtaagcggaagcccaggacaaagcataacaataagttgtagcggaagctcaagcaatataggagacatattcgtaagttggtaccaacaagtaccaggagcagcaccaaaactattaatatatgacaatgacaaaagaccaagcggaataccagacagattctcaggatcaaaatcaggaacaagcgcaacattagacataacaggactacaaacaggagacgaagcagattactattgcggaacatgggacacatcattaagcgcaggaggagtatttggaacaggaacaaaagtaacagtacta

SEQ ID NO: 48492 - RNA, 333 nt, synthetic construct
  misc_feature 1..333: note = derived and/or modified sequence opt6 from anti-HIV_048-155811_VR-Chain
  source 1..333: mol_type = other RNA
caatcagcattaacacaaccagcatcagtatcaggatcaccaggacaatcaataacaatatcatgtacaggaacatcatcagacgtaggatacgactacgtatcatggtaccaactattaccaggaacaccaccaaaactactaatattcaaaaataacgaaagaccatcaggaataccagacagattctcaggatcaaaatcaggaacatcagcaacactaggaataacaggactacaaacaggagacgaagcagactactactgcgcaacatgggacacatcattatcagcaggaggagtatttggaacaggaacaaaagtaacagtacta

SEQ ID NO: 48493 - RNA, 333 nt, synthetic construct
  misc_feature 1..333: note = derived and/or modified sequence opt6 from anti-HIV_048-155464_VR-Chain
  source 1..333: mol_type = other RNA
caatcagcattaacacaaccagcaagtgtaagcggaagcccaggacaaagcataacaataagctgtacaggagcaacaggagatagcggacacacatacgtaagctggtaccaacaattaccaggaacagcaccaaaactattaatatatagcaataacgaaagaccaagcggagtaccagacagattctcaggatcaaaatcaggaacaagcgcaacactaggaataacaggactacaaacaggagacgaagcagattactattgcggaacatgggacacatcattaagcgcaggaggagtatttggaagcggaacaaaagtaacagtacta

SEQ ID NO: 48494 - RNA, 333 nt, synthetic construct
  misc_feature 1..333: note = derived and/or modified sequence opt6 from anti-HIV_048-155392_VR-Chain
  source 1..333: mol_type = other RNA
caatcagtactaacacaaccaccatcagtatcagcagcaccaggacaaatggtaacaatatcatgctcaggatcatcatcaaacataggagacaactacgtatcatggtaccaacaactaccaggaagaggaccaaaactattagtatacgacacatacaaaagatacctagaaacaccagacagattctcaggatcaaaatcaggaacatcagcaacactaggaataacaggactacaaacaggagacgaagcagactactactgcggaacatgggacacatcactatcagcaggaggagtattcggaacaggaacaaaagtaacagtacta

SEQ ID NO: 48495 - RNA, 333 nt, synthetic construct
  misc_feature 1..333: note = derived and/or modified sequence opt6 from anti-HIV_048-155389_VR-Chain
  source 1..333: mol_type = other RNA
caatcagtactaacacaaccaccatcagtatcagcagcaccaggacaaaaagtaacaatatcatgctcaggaatatcatcaaacataggaaacaacccagtatcatggtaccaacaattcccaggaacagcaccaaaactactaatatacaaaaacgacaaaagaccatcaggaataccagacagattctcaggatcaaaatcaggaacatcagcaacactaggaataacaggactacaaacaggagacgaagcagactactactgcggaacatgggacacatcactaagtacaggaggagtattcggaacaggaacaaaagtaacagtacta

SEQ ID NO: 48496 - RNA, 333 nt, synthetic construct
  misc_feature 1..333: note = derived and/or modified sequence opt6 from anti-HIV_048-154449_VR-Chain
  source 1..333: mol_type = other RNA
caatcagtattaaaacaaccaccatcagtatcaggagcaccaggactaagagtaacaatatcatgtacaggaggatcatcaaatataggaggatttgacgtacactggtaccaacactttccaggaacagcaccaaaactattaatatatgacaatgaccaaagaccatcaggaataccagacagattctcaggatcaaaatcaggaacatcagcaacactaggaataacaggactacaaacaggagacgaagcagattactattgcggaacatgggactcatcattatcagcaggaggagtatttggaacaggaacaaaagtaacagtacta

SEQ ID NO: 48497 - RNA, 333 nt, synthetic construct
  misc_feature 1..333: note = derived and/or modified sequence opt6 from anti-HIV_048-153379_VR-Chain
  source 1..333: mol_type = other RNA
caatcagtattaacacaaccaccatcagtatcagcaacaccaggacaaaaagtaacaatatcatgctcaggatcaagatcaaacataggatcacactacgtatcatggtaccaacaattcccagaatcagcaccaaaactactaatatacaaaaacgacaacagaccatcaggaataccagacagattctcaggatcaaaatcaggaacatcagcaacattaggaatatcaggactacaaacaggagacgaagcagactactactgcggaacatgggacacatcactatcaggaggaggagtattcggaacaggaacaaaagtaacagtacta

SEQ ID NO: 48498 - RNA, 333 nt, synthetic construct
  misc_feature 1..333: note = derived and/or modified sequence opt6 from anti-HIV_048-153171_VR-Chain
  source 1..333: mol_type = other RNA
caatcagtactaacacaaccaccaagcgtatcagcagcaccaggacaaaaagtaacaatatcatgctcaggatcaacatcaaacatagaagacatatacgtatcatggtaccaacacctaccaggaacagcaccaaaactactaatatacgacaacaacaaaagaccatcaggaataccagacagattctcaggatcaaaatcaggaacatcagcaacactagcaataacaggactacaaacaggagacgaagcagactactactgcggaacctgggacacatcactatcagcaggaggagtattcggaacaggaacaaaagtaacagtacta

SEQ ID NO: 48499 - RNA, 333 nt, synthetic construct
  misc_feature 1..333: note = derived and/or modified sequence opt6 from anti-HIV_048-152324_VR-Chain
  source 1..333: mol_type = other RNA
caatcaatggtaacacaatcaccatcagtatcagcagcaccaggacaaaaagtaacaataagctgtagcggaacatcatcaaatataggacaaaattacgtatcatggtaccaacaattaccaggaacagcaccaaaactattaatatatgaaaatagcaaaagaccaagcggaataccagacagattctcaggatcaaaatcaggaacatcagcaacattaggaataacaggactacaaacaggagacgaagcagattactattgcggaacatgggacacaagcctatcagcaggaggagtatttggatcaggaacaaaagtaacagtacta

SEQ ID NO: 48500 - RNA, 333 nt, synthetic construct
  misc_feature 1..333: note = derived and/or modified sequence opt6 from anti-HIV_048-146102_VR-Chain
  source 1..333: mol_type = other RNA
caatcagtactaacacaaccaccatcagtatcagcagcaccaggacaaaaagtaacaataagctgctcaggatcatcatcaacaataggaaacaactacatatcatggtaccaactactaccaggaacaccaccaaaactactaatatacaaaaacaacgaaagaccatcaggaataccagacagattctcaggatcaaaatcaggaacatcagcaacactaggaataacaggactacaaacaggagacgaagcagactactactgcggaacatgggacacatcactatcagcaggaggagtattcggaacaggaacaaaagtaacagtacta

SEQ ID NO: 48501 - RNA, 333 nt, synthetic construct
  misc_feature 1..333: note = derived and/or modified sequence opt6 from anti-HIV_048-145984_VR-Chain
  source 1..333: mol_type = other RNA
caatcagtattaacacaaccattatcagtttcaggagcaccaggacaaagagtaacaatatcatgtacaggatcatcatcaaacataggatcaaatttcgtatcatggtaccaagtattaccaggaacaacaccaaaactattaatatttaaaaataacgaaagaccaagcggaataccagacagattctcaggatcaaaatcaggaacatcagcaacattaggaataacaggactacaaacaggagacgaagcagattactattgcggagcatgggacacatcattaagcgcaggaggagtatttggaacaggaacaaaagtaacagtacta

SEQ ID NO: 48502 - RNA, 333 nt, synthetic construct
  misc_feature 1..333: note = derived and/or modified sequence opt6 from anti-HIV_048-145371_VR-Chain
  source 1..333: mol_type = other RNA
caatcagtactaacacaaccaccatcagtatcagcagcatcaggacaaaaagtatcaataccatgctcaggaggaacatcaaacataggagacaactacgtatcatggttccaacaattcccaggatcagcaccaaaaatactaatatacgactcagacaaaagaccatcaagaatatcagacagattctcagcatcaaaatcaggaacatcagcaacactagacataacaagactacaaacaggagacgaagcagactactactgcggaacatgggacacatcactatcagcaggaggagtattcggaacaggaacaaaagtaacagtacta

SEQ ID NO: 48503 - RNA, 333 nt, synthetic construct
  misc_feature 1..333: note = derived and/or modified sequence opt6 from anti-HIV_048-144907_VR-Chain
  source 1..333: mol_type = other RNA
caatcagcattaacacaaccagcatcagtaagcggatcaccaggacaatcaataacaatatcatgtacaggaacaagaagagatgtaggattcaattacgtatcatggtaccaacaacatccaggaacagcaccaaaactattaatatatgaaaataacaaaagaccatcaggaataccagacagattctcaggatcaaaatcaggaacatcagcaacattaggaataacaggactacaaacaggagacgaagcagactactattgcggaacctgggactcatcattatcagcaggaggagtatttggaacaggaacaaaagtaacagtacta

SEQ ID NO: 48504 - RNA, 333 nt, synthetic construct
  misc_feature 1..333: note = derived and/or modified sequence opt6 from anti-HIV_048-142298_VR-Chain
  source 1..333: mol_type = other RNA
caatcagtactaacacaaccaccatcagcatcaggaacaccaggacaaagagtaacaatatcatgctcaggatcatcatcaacaataggaaacaactacatatcatggtaccaactactaccaggaacaccaccaaaactactaatattcaaaaacaacgaaagaccatcaggaataccagacagattctcagcatcaaaatcaggaacatcagcaacactaggaataacaggactacaaacaggagacgaagcagactactactgcggaacatgggacacatcactatcagcaggaggagtattcggaacaggaacaaaagtaacagtacta

SEQ ID NO: 48505 - RNA, 333 nt, synthetic construct
  misc_feature 1..333: note = derived and/or modified sequence opt6 from anti-HIV_048-142277_VR-Chain
  source 1..333: mol_type = other RNA
caatcagtactaacacaaccaccatcagtatcaggagcaccaggacaaagaataacaatatcatgcacaggatcatcatcaaacataggagcatacgacgtacaatggtaccaacacctaccaggaacagcaccaaaactactaatatacaaaaacacagaaagaccatcaggaataccagacagattcagcggatcaaaatcaggaacatcagcaacactagacataacaggactacaaacaggagacgaagcagactactactgcggaacatgggacacatcactatcagcaggaggagtattcggaacaggaacaaaagtaacagtacta

SEQ ID NO: 48506 - RNA, 333 nt, synthetic construct
  misc_feature 1..333: note = derived and/or modified sequence opt6 from anti-HIV_048-141934_VR-Chain
  source 1..333: mol_type = other RNA
caatcagtattaacacaaccaccaagcgtaagcggagcaccaggacaaagagtaacaataagctgtacaggaaactcaagcaatataggagcatatgacgtacactggtaccaacaattaccaggaacagcaccaaaactaatgatatatgaagtaagcaaaagaccaagcggaataccagacagattctcaggatcaaaatcaggaacaagcgcaacattaggaataacaggattacaaacaggagacgaagcagattactattgcggaacatgggacacatcattaagcgcaggaggagtatttggaagcggaacaaaagtaacagtacta

SEQ ID NO: 48507 - RNA, 333 nt, synthetic construct
  misc_feature 1..333: note = derived and/or modified sequence opt6 from anti-HIV_048-141207_VR-Chain
  source 1..333: mol_type = other RNA
caatcagtattaacacaaccaccatcagtatcagcagcaccaggacaaaaagtaacaatagcatgctcaggatcatcatcaaacataggaaacaactacgtatcatggtaccaacaactaccaggaacagcaccaaaactactaatatacgcaaacaacagaagaccatcaggaataccagacagattctcagcatcaaaatcaggaacatcagcaacactaggaataacaggactacaaacaggagacgaagcagactactactgcggaacatgggacacatcattatcagcaggaggagtattcggaacaggaacaaaagtaacagtacta

SEQ ID NO: 48508 - RNA, 333 nt, synthetic construct
  misc_feature 1..333: note = derived and/or modified sequence opt6 from anti-HIV_048-140796_VR-Chain
  source 1..333: mol_type = other RNA
caatcagtactaacacaaccaccatcagtaagcgcaacaccaggacaaaaagtaacaatatcatgctcaggaacaagatcaaacataggaaacaactacgtatcatggtacagacaattcccaggaacagcaccaaaactactaatatacgaagacaacaaaagaccatcaggaataccagcaagattctcaggatcaaaatcaggaacatcagcaacactaggaataacaggactacaaacaggagacgaagcagactactactgcggaacatgggacacatcactatcagcaggaggagtattcggaacaggaacaaaagtaacagtacta

SEQ ID NO: 48509 - RNA, 333 nt, synthetic construct
  misc_feature 1..333: note = derived and/or modified sequence opt6 from anti-HIV_048-139893_VR-Chain
  source 1..333: mol_type = other RNA
caatcagtattaacacaaccaccaagcgtaagcgcaacaccaggacaaaaagtaacatttagctgtagcggaagctcaagcacaataggaaaaaattacgtaagctggtaccaagtattaccaggaacagcaccaaaactattaatatataaaaataacaaaagaccaagcggaataccagacagattctcaggatcaaaatcaggaacaagcgcaacattaggaataacaggactacaaacaggagacgaagcagattactattgcggaacatgggactcaagcttaagcgcaggaggagtatttggaacaggaacaaaagtaacagtacta

SEQ ID NO: 48510 - RNA, 333 nt, synthetic construct
  misc_feature 1..333: note = derived and/or modified sequence opt6 from anti-HIV_048-138820_VR-Chain
  source 1..333: mol_type = other RNA
caatcagtactaacacaaccaccatcagtatcaggagcaccaggacaaaaagtaacaatatcatgctcaggatcaggatcaaacataggaaacacatacgtatcatggtaccaacacctaccaggaacagcaccaaaattattaatatacgaaaacaacaaaagaccatcaggaataccagacagattctcaggatcaaaatcagcaacatcagcaacactaggaataacaggactacaaacaggagacgaagcagactactactgcggaacatgggacacatcattatcagcaggaggagtattcggaacaggaacaaaagtaacagtacta

SEQ ID NO: 48511 - RNA, 333 nt, synthetic construct
  misc_feature 1..333: note = derived and/or modified sequence opt6 from anti-HIV_048-135858_VR-Chain
  source 1..333: mol_type = other RNA
caaagcgtattaacacaaccaccaagcgcaagtggaacaccaggacaaagagtaacaataagctgtagtggaagctcgagcaatataggaagctcatacgtatactggtaccaacaatttccaggaagatcaccaagactattaatatatagaaataacgaaagaccaagtggaataccagacagattctcaggatcaaaatcgggaacaagcgcaacattaggaataacaggactacaaacaggagacgaagcagattactattgcggaacatgggacacatcattaagcgcaggaggagtatttggaacaggaacaaaagtaacagtacta

SEQ ID NO: 48512 - RNA, 333 nt, synthetic construct
  misc_feature 1..333: note = derived and/or modified sequence opt6 from anti-HIV_048-134968_VR-Chain
  source 1..333: mol_type = other RNA
caatcagtactaacacaaccaccatcagtatcagcagcaccaggacaaaaagtaacaatattctgctcaggatcatcatcaaacataggaaaaaactacgtatcatggtaccaacaactaccaggaacagcaccaaaactactaatatacgaaaactcaaaaagaccatcaggaataccagacagattctcaggatcaaaatcaggaacatcagccacactaggaataacaggactacaaacaggagacgaagcagactactactgcggaacatgggacacatcactatcagcaggaggagtattcggatcaggaacaaaagtaacagtacta

SEQ ID NO: 48513 - RNA, 333 nt, synthetic construct
  misc_feature 1..333: note = derived and/or modified sequence opt6 from anti-HIV_048-134312_VR-Chain
  source 1..333: mol_type = other RNA
caatcagtattaacacaaccaccatcagcatcaggaacaccaggacaaagagtaacaatatcatgctcaggatcatcatcaaatataggaaacaactacgtatcatggtacagactattaccaggaacagcaccaaaactactaatatacaaaaacgacaacagaccatcaggaataccagacagattctcaggatcaaaaagcggaacatcagcaacactaggaatatcaggactacaaacaggagacgaagcagactactactgcggaacatgggacacatcactatcaggaggaggagtattcggaacaggaacaaaagtaacagtacta

SEQ ID NO: 48514 - RNA, 330 nt, synthetic construct
  misc_feature 1..330: note = derived and/or modified sequence opt6 from anti-HIV_048-132253_VR-Chain
  source 1..330: mol_type = other RNA
tcagcattaacacaaccagcatcagtatcaggatcaccaggacaatcaatagcaatatcatgtacaggaacatcatcagatgtaggatacgatctagtatcatggtaccaacaacatccaggaacagcaccaaaactattaatatatgacaataacaaaagaccatcaggaataccagacagattctcaggatcaaaatcaggaacatcagcaacattaggaataacaggactacaaacaggagacgaagcagattactattgcggaacatgggacacatcattatcagcaggaggagtatttggatcaggaacaaaagtaacagtacta

SEQ ID NO: 48515 - RNA, 333 nt, synthetic construct
  misc_feature 1..333: note = derived and/or modified sequence opt6 from anti-HIV_048-130710_VR-Chain
  source 1..333: mol_type = other RNA
caatcagtcctaacacaaccaccatcagtagcaggagcaccaggacaaagagtaacaatatcatgcacaggaaacacatcaaatataggaggatacgacgtacactggtaccaacaattaccaggaacaccaccaaaactactaatattcaaaaacaacgaaagaccatcaggaataccagacagattctcaggatcaaaatcaggaacatcagcaacattaggaataacaggactacaaacaggagacgaagcagactactactgcggaacatgggacacatcactatcagcaggaggagtcttcggaacaggaacaaaagtaacagtatta

SEQ ID NO: 48516 - RNA, 333 nt, synthetic construct
  misc_feature 1..333: note = derived and/or modified sequence opt6 from anti-HIV_048-128564_VR-Chain
  source 1..333: mol_type = other RNA
caatcagtactaacacaaccaccatcagcatcaggaacaccaggacaaagagtaacaatatcatgctcaggatcatcatcaaacataggatcaaacacagtaaactggtaccaacaactaccaggaacagcaccaaaactactaatatacaaaaacacagaaagaccatcaggaataccagacagattctcaggatcaaaatcaggaacatcagcaacactagacataacaggactacaaacaggagacgaagcagactactactgcggaacatgggacacatcattatcagcaggaggagtattcggaacaggaacaaaagtaacagtacta

SEQ ID NO: 48517 - RNA, 333 nt, synthetic construct
  misc_feature 1..333: note = derived and/or modified sequence opt6 from anti-HIV_048-126702_VR-Chain
  source 1..333: mol_type = other RNA
caatcagtattaacacaaccaccatcagcatcagcagcaccaggacaaagagtaacaatatcatgctcaggatcaaactcaaacataggaaacaactacgtatcatggtaccaacaactaccaggaacagcaccaaaactactaatatacgacaactcaaaaagaccatcaggaataccagacagattctcagcatcaaaatcaggaacatcagcaacactaggaataacaggattacaaacaggagacgaagcagactactactgcggaacatgggacacatcactatcagcaggaggagtattcggaacaggaacaaaagtaacagtacta

SEQ ID NO: 48518 - RNA, 333 nt, synthetic construct
  misc_feature 1..333: note = derived and/or modified sequence opt6 from anti-HIV_048-124521_VR-Chain
  source 1..333: mol_type = other RNA
caaagtgtactaacacaaccaccaagtgtatcaggagcaccaggacaaagagtaacaatatcatgcacaggatcaagttcaacatttggaggatacgacgtatactggtatcaacaaataccaggaacagcaccaaaattattaatatacgaaaacaataaaagaccatcaggaataccagacagattcagcggaagcaaaagcggaacatcagcaacactagcaataacaggattacaaacaggagatgaagcagactattactgcggaacatgggacggatcactatcaacaggaggagtaataggaacaggaacaaaagtaacagtatta

SEQ ID NO: 48519 - RNA, 333 nt, synthetic construct
  misc_feature 1..333: note = derived and/or modified sequence opt6 from anti-HIV_048-122740_VR-Chain
  source 1..333: mol_type = other RNA
caatcagtactaacacaaccaccatcaatgtcagcagcaccaggacaatcagtaacaatatcatgcagcggatcaacattcaacatagaaaaacaccaagtaacatggctaagacacctaccaggaacagcaccaacatcagtaataataatgaactcacaaagaccatcaggaacaccagacagattctcaggatcaaaatcaggaacatcagcaacactagcaataacaggactacaaacaggagacgaagcagactactactgcggaacatgggacggatcactatcaacaggaggagtaataggaacaggaacaaaagtaacagtacta

SEQ ID NO: 48520 - RNA, 327 nt, synthetic construct
  misc_feature 1..327: note = derived and/or modified sequence opt6 from anti-HIV_048-119536_VR-Chain
  source 1..327: mol_type = other RNA
gaattaacacaaagcccaagcgtaagcgcagcaccaggagaaaaagtaacaataagctgtagcggaacaaatagcaatataggatactattacgtaagctggtaccaacaatttccaggaacagcaccaaaagtagtaatatatgaaaatacaaaaagaccaagcggaataccagacagattctcaggatcaaaatcaggaacaagcgcaacattaggaataacaggactacaaacaggagacgaagcagattactattgcggaacatgggacacatcattaagcgcaggaggagtatttggaagcggaacaaaagtaacagtacta

SEQ ID NO: 48521 - RNA, 333 nt, synthetic construct
  misc_feature 1..333: note = derived and/or modified sequence opt6 from anti-HIV_048-116929_VR-Chain
  source 1..333: mol_type = other RNA
caatcagtattaacacaaccaccatcagtatcaggagcaccaggacaaagagtaacaatatcatgtacaggatcatcatcaaatataggagactatgacgtacactggtaccaacaactaccaggaacagcaccaaaactattaatatatagaaataaccaaagaccatcaggagtaccagacagattctcaggatcaaaatcaggaacatcagcaacattaggaataacaggactacaaacaggagacgaagcagattactattgcggaacatgggacgcatcattatcagcaggaggagtatttggaacaggaacaaaagtaacagtacta

SEQ ID NO: 48522 - RNA, 333 nt, synthetic construct
  misc_feature 1..333: note = derived and/or modified sequence opt6 from anti-HIV_048-116577_VR-Chain
  source 1..333: mol_type = other RNA
caatcagtactaacacaaccaccatcagcatcaggaacaccaggacaaagagtaacaatatcatgttcaggaagctcatcaaatataggatcaaattacgtatcatggtaccaagtattaccaggaacagcaccaaaactactaatatacaaaaataacaaaagaccatcaggaataccagacagattctcaggatcaaaatcaggaacatcagcaacactaggaataacaggactacaaacaggagacgaagcagactactactgcgcaacatgggacacatcactatcagcaggaggagtattcggaacaggaacaaaagtaacagtacta

SEQ ID NO: 48523 - RNA, 333 nt, synthetic construct
  misc_feature 1..333: note = derived and/or modified sequence opt6 from anti-HIV_048-116046_VR-Chain
  source 1..333: mol_type = other RNA
caaagcgtactaacacaaccaccatcagtatcaggagcaccaggacaaagagtaacaatatcatgcacaggatcaagctcaaacataggaggatacgatgtacattggtatcaacaattcccaggaacagcaccaaaattattaatatacgataacgataaaagaccatcaggaataccagatagatttagcggaagcaaaagcggaacatcagcaacactaggaataacaggattacaaacaggagatgaagcaaactattactgtggagcatgggatacatcactatcagcaggaggagtattcggaacaggaacaaaagtaacagtatta

SEQ ID NO: 48524 - RNA, 333 nt, synthetic construct
  misc_feature 1..333: note = derived and/or modified sequence opt6 from anti-HIV_048-115875_VR-Chain
  source 1..333: mol_type = other RNA
caatcagtattaacacaaccaccaagcgtaagcgcagcaccaggacaaagagtaacagtaagctgtagcggaagctcaagcaatataggaaacaatttcgtaagctggtaccaacacttaccaggaacagcaccaaaactattaatatatgacaatagcaatagaccaagcggaataccagacagattctcaggatcaaaatcaggaacaagcgcaacattaggaataacaggactacatacaggagacgaagcagattactattgcggaacatgggacacatcattaagcgcaggaggagtatttggaagcggaacaaaagtaacagtacta

SEQ ID NO: 48525 - RNA, 333 nt, synthetic construct
  misc_feature 1..333: note = derived and/or modified sequence opt6 from anti-HIV_048-115599_VR-Chain
  source 1..333: mol_type = other RNA
caatcagtattaacacaaccaccaagcgtaagcgcagcaccaggacaaatggtaacaataagctgtagcggaagctcaagcaatataggaagccatagtgtaagctggtaccaacactttccaggaacagcaccaaaattagtaatagaagaaaatgaccaaagaccaagtggaataccagacagattctcaggatcaaaatcaggaacaagcgcaacattaggaataacaggactacaaacaggagacgaaggagattactattgcggaacatgggacacaagcctaagcggaggaggagtatttggaacaggaacaaaagtaacagtacta

SEQ ID NO: 48526 - RNA, 333 nt, synthetic construct
  misc_feature 1..333: note = derived and/or modified sequence opt6 from anti-HIV_048-113988_VR-Chain
  source 1..333: mol_type = other RNA
caatcagtactaacacaaccaccatcagtatcagcagcaccaggacaaatggtaacaatatcatgttcaggaagctcacacaatataggagaaaattacgtatcatggtaccaacacttaccaggaacagcaccaaaactattaatattcaaaaataacgaaagaccatcaggaataccagacagattcagcggatcaaaatcaggaacatcagcaacattaggaataacaggactacaaacaggagacgaagcagactactattgcggaacatgggacacaagtctatcagcaggaggagtattcggaacaggaacaaaagtaacagtacta

SEQ ID NO: 48527 - RNA, 333 nt, synthetic construct
  misc_feature 1..333: note = derived and/or modified sequence opt6 from anti-HIV_048-112989_VR-Chain
  source 1..333: mol_type = other RNA
caatcagtattaacacaaccaccatcagcatcaggaacaccaggacaaagagtaacactatcatgctcaggaggatcatcaaacataggaaacgacaacgtatactggtaccaacaaagaccaggaacaacaccaaaactattaatatacaacgacaacagaagaccatcaggaacaccagacagattctcaggatcaaaatcaggaacatcagcaacactagcaataacaggactacaaacaggagacgaagcagactactactgcggaacatgggacggatcactatcaacaggaggagtaataggaacaggaacaaaagtaacagtacta

SEQ ID NO: 48528 - RNA, 333 nt, synthetic construct
  misc_feature 1..333: note = derived and/or modified sequence opt6 from anti-HIV_048-112435_VR-Chain
  source 1..333: mol_type = other RNA
caatcagtcttaacacaaccaccaagcgtaagcgcagcaccaggacaaaaagtaagcataagctgtagcggaagctcaagcaatataggaaaaaattacgtaagctggtaccaacaactaccaggaacagcaccaaaactattaatatttaaaaataacgaaagaccaagcggaataccagacagattctcaggatcaaaatcaggaacaagcgcaacattaggaataacaggactacaaacaggagacgaagcagattactattgcgcaacatgggacacaagcttaagcgcaggaggagtatttggaacaggaacaaaagtaacagtacta

SEQ ID NO: 48529 - RNA, 333 nt, synthetic construct
  misc_feature 1..333: note = derived and/or modified sequence opt6 from anti-HIV_048-111339_VR-Chain
  source 1..333: mol_type = other RNA
caatcagtattaacacaaccaccatcagtatcagcagcaccaggacaaaaagtaacaatatcatgtacaggatcatcatcaaatataggaggatatgcagtacactggtaccaacaagtaccagcaacagcaccaaaactattaatatatgaaaataacgaaagaccaagcggaataccagacagattctcaggatcaaaatcaggaacatcagcaacattaggaataacaggactacaaacaggagacgaagcagattactattgcggaacatgggacacatcattatcagcaggaggagtatttggaacaggaacaaaagtaacagtatta

SEQ ID NO: 48530 - RNA, 333 nt, synthetic construct
  misc_feature 1..333: note = derived and/or modified sequence opt6 from anti-HIV_048-111055_VR-Chain
  source 1..333: mol_type = other RNA
caatcagcattaacacaaccagcaagcgtaagcggaagcccaggacaaagcataacaataagctgtacaggaacaagaagcgatgtaggatacaattacgtaagttggtaccaacaacatccaggaaaagcaccaaaactattaatatatgaaaatacaaaaagaccaagcggaataccagacagattctcaggatcaaaatcaggaacaagcgcaacattaggaataacaggattacaaacaggagacgaagcagattactattgcggaacatgggacacaagtttaagcgcaggaggagtatttggatcaggaacaaaagtaacagtacta

SEQ ID NO: 48531 - RNA, 333 nt, synthetic construct
  misc_feature 1..333: note = derived and/or modified sequence opt6 from anti-HIV_048-111027_VR-Chain
  source 1..333: mol_type = other RNA
caatcagtactaacacaaccaccatcagtatcagcagcaccaggacaaaaagtaacaatatcatgctcaggatcaaactcaaacctaggaaacaactacgtatcatggtaccaacacctaccaggaacagcaccaagactactaatatacgaagacaaaaaaagaccatcaggaataccagacagattctcaggatcaaaatcaggagcatcagcaacactagacataacaggactacaaacaggagacgaagcagactactactgcggaatatgggacacatcactatcagcaggaggagtattcggaacaggaacaaaagtaacagtacta

SEQ ID NO: 48532 - RNA, 333 nt, synthetic construct
  misc_feature 1..333: note = derived and/or modified sequence opt6 from anti-HIV_048-109721_VR-Chain
  source 1..333: mol_type = other RNA
caatcagtattaacacaaccaccatcagtatcagcagcaccaggacaaaaagtaacaatatcatgctcaggaagctcatcagacataggatcaaacttcgtatcatggtaccaacacttaccaggaacagcaccaagactactaatatacgaaaacaacagaagaccatcaggaataccagacagattctcaggatcaaaatcaggaacatcagcaacactagcaataacaggactacaaacaggagacgaagcagactactactgcggaacatgggacacatcactaaacagaggaggagtattcggaacaggaaccaaagtaacagtacta

SEQ ID NO: 48533 - RNA, 333 nt, synthetic construct
  misc_feature 1..333: note = derived and/or modified sequence opt6 from anti-HIV_048-109666_VR-Chain
  source 1..333: mol_type = other RNA
caatcagtattaacacaaccaccaagtatgtcagcagcaccaggagaaagagtaacaataagctgtagcggaagctcaagcaatataggaaaccatcacgtaagctggtaccaacaaagaccaggaacagcaccaaaattattaatatatgaaaataacgaaagaccaagcggaataccagacagattctcaggatcaaaatcaggatcaagcgcaacattagcaataacaggactacaaacaggagacgaagcagattactattgcggaacatgggacggaagattaaacataggaggagtaataggaacaggaacaaaagtaacagtacta

SEQ ID NO: 48534 - RNA, 333 nt, synthetic construct
  misc_feature 1..333: note = derived and/or modified sequence opt6 from anti-HIV_048-109196_VR-Chain
  source 1..333: mol_type = other RNA
caatcagtactaacacaaccaccatcagtatcagcagcaccaggacaaaaagtaacaatatcatgctcaggatcatcatcaaacataggaaacaactacgtatcatggtaccaacaattaccaggaacagcaccaaaactactaatatacgaaacaaacaaaagaccatcaggaataccagacagattctcaggatcaaaatcaggaacatcagcaacactagcaataacaggactacaaacaggagacgaagcagactactactgcggaacatgggacacatcactatcaggaggaggagtattcggaacaggaacaaaagtaacagtatta

SEQ ID NO: 48535 - RNA, 333 nt, synthetic construct
  misc_feature 1..333: note = derived and/or modified sequence opt6 from anti-HIV_048-109051_VR-Chain
  source 1..333: mol_type = other RNA
caatcagtactaacacaaccaccatcagtatcagcagcaccaggacaaaaagtaacaatatcatgctcaggaaacaactcaaacatggtaaacaactacatatcatggtaccaactactaccaggaacaccaccaaaactactaatattcaaaaacaacgaaagaccatcaggaataccagacagattctcaggatcaaaatcaggaacatcagcaacattaggaataacaggactacaaacaggagacgaagcagactactactgcggaacatgggacacatcactatcagcaggaggagtattcggaacaggaacaaaagtaacagtatta

SEQ ID NO: 48536 - RNA, 333 nt, synthetic construct
  misc_feature 1..333: note = derived and/or modified sequence opt6 from anti-HIV_048-108570_VR-Chain
  source 1..333: mol_type = other RNA
caatcagcactaacacaaccaccatcagtatcagcagcaccaggacaaaaagtaacaatatcatgctcaggaaaatcatcaaacataggaacaaacttcgtatcatggtaccaacaattcccagaagcagcaccaaaactactaatatacgacaacaacaaaagaccatcaggaataccagacagattctcaggatcaaaatcaggaacatcagcaacattaggaataacaggactacaaacaggagacgaagcagactactactgcggaacatgggacggatcactatcaacaggaggagtaataggaacaggaacaaaagtaacagtacta

SEQ ID NO: 48537 - RNA, 327 nt, synthetic construct
  misc_feature 1..327: note = derived and/or modified sequence opt6 from anti-HIV_048-108033_VR-Chain
  source 1..327: mol_type = other RNA
gaattaacacaaagcccaagcgtaagcgcagcaccaggacaaagagtaacaataagctgtagcggaaacagcagcaatataggaaacaattacgtaagctggtaccaactattaccaggaacagcaccaaaactactaatatataaaaatgacaaaagaccaagcggaataccagacagattctcaggctcaaaatcgggaacaagcgcaacattaggaataacaggactacaaacaggagacgaagcagattactattgcggaacatgggacacatcattaagcacaggaggagtatttggaacaggaacaaaagtaacagtacta

SEQ ID NO: 48538 - RNA, 333 nt, synthetic construct
  misc_feature 1..333: note = derived and/or modified sequence opt6 from anti-HIV_048-107279_VR-Chain
  source 1..333: mol_type = other RNA
caatcagtactaacacaaccaccatcagtatcagcagcaccaggacaaaaagtaataatatcatgctcaggatcatcatcaaacataggaaaaaactacgtatcatggtaccaacacctacccggaacagcaccaaaattactaatatacgaaaacaacaaaagaccatcaggaataccagacagattctcaggatcaaaatcaggaacatcagcaacactaggaataacaggactacaaacaggagacgaagcagactactactgcggaacatgggacgcatcactatcagcaggaggagtactaggaacaggaacaaaagtaacagtacta

SEQ ID NO: 48539 - RNA, 333 nt, synthetic construct
  misc_feature 1..333: note = derived and/or modified sequence opt6 from anti-HIV_048-106271_VR-Chain
  source 1..333: mol_type = other RNA
caatcagtactaacacaaccaccatcagtatccgcagcaccaggacaaaaagtaaccatatcatgctcaggaagcagatcaaacataggatcaaactacatatcatggtaccaacaactaccaggaacagcaccaaaactactaatatacaaaaacgacaaaagaccatcaggaataccagacagattctcaggatcaaaatcaggaacatcagcaatactaggaataacaggactacaaacaggagacgaagcagactactactgcggagcatgggacacatcactatcagcaggaggagtattcggaacaggaacaaaagtaacagtacta

SEQ ID NO: 48540 - RNA, 333 nt, synthetic construct
  misc_feature 1..333: note = derived and/or modified sequence opt6 from anti-HIV_048-106054_VR-Chain
  source 1..333: mol_type = other RNA
caatcagtactaacacaaccaccatcagtatcagcagcaccaggacaacaagtaacaatatcatgctcaggaagcacatcaaacataggaaacaactacgtatcatggtaccaacaagtaccaggaacagcaccaaaactactaatatacgacaacaacaacagaccatcaggaataccagacagattctcaggatcaaaatcaggaacatcagcaacactaggaatatcaggattacaaacaggagacgaagcagactactactgcggaacatgggacacatcactatcaggaggaggagtattcggaacaggaacaaaagtaacagtacta

SEQ ID NO: 48541 - RNA, 333 nt, synthetic construct
  misc_feature 1..333: note = derived and/or modified sequence opt6 from anti-HIV_048-104848_VR-Chain
  source 1..333: mol_type = other RNA
caatcagcattaacacaaccagcatcagtatcaggatcaccaggacaatcaataacaatatcatgtacaggaacatcatcagacgtaggatacaattacgtatcatggtaccaacaattaccaggaacagcaccaaaactattaatattcgacaatgacgacagaccatcagaaataccagacagattctcaggatcaaaatcaggaacatcagcaacactaggaataacaggactacaaccaggagacgaagcagattactattgcggaacatgggactcatcattatcagcaggaggagtatttggaacaggaacaaaagtaacagtacta

SEQ ID NO: 48542 - RNA, 333 nt, synthetic construct
  misc_feature 1..333: note = derived and/or modified sequence opt6 from anti-HIV_048-104638_VR-Chain
  source 1..333: mol_type = other RNA
caatcagtattaacacaaccaccaagcgcaagcggaacaccaggacatagagtaacaataagctgtagtggaaactcaagcaatataggaggaaatcacgtatactggtaccaacaagtaccaggaacaacaccaaaactattaatatatagaaataacgaaagaccaagcggaataccagacagattctcaggatcaaaatcaggaacaagcgcaacattaggaataacaggactacaaacaggagacgaagcagattactattgcggaacatgggacacaagtttaagcgcaggaggagtatttggaacaggaacaaaagtaacagtatta

SEQ ID NO: 48543 - RNA, 333 nt, synthetic construct
  misc_feature 1..333: note = derived and/or modified sequence opt6 from anti-HIV_048-104567_VR-Chain
  source 1..333: mol_type = other RNA
caatcagtattaacacaaccaccaagcgcaagcggaacaccaggacaaagagtaacaataagctgtagcggaagcaatagtaatataggaacaaatttcgtaaactggtaccaacacgtaccaggaagagcaccaaaactattaatctataaaaatacagaaagaccaagcggaataccagacagattctcaggatcaaaatcaggaacaagcgcaacattagacataacaggactacaaacaggagacgaagcagattactattgcggaacatgggacacaagcttaagcgcaggaggagtatttggaacaggaacaaaagtaacagtacta

SEQ ID NO: 48544 - RNA, 333 nt, synthetic construct
  misc_feature 1..333: note = derived and/or modified sequence opt6 from anti-HIV_048-102804_VR-Chain
  source 1..333: mol_type = other RNA
caatcagtactaacacaaccaccatccgtatcaacagcaccaggacaaaaagtaacaatatcatgctcaggatcatcatcaaacataggatactcatacgtatcatggttccaacacctaccaggaacagcaccaaaactactaatatacggaaactcaaacagaccatcaggagtaccagacagattctcaggatcaaaatcaggaacatcagcatcactagcaataacaggactacaaacaggagacgaagcagactactactgcggaacatgggactcatcactatcagcaggaggagtattcggaacaggaacaaaagtaacagtacta

SEQ ID NO: 48545 - RNA, 333 nt, synthetic construct
  misc_feature 1..333: note = derived and/or modified sequence opt6 from anti-HIV_048-101676_VR-Chain
  source 1..333: mol_type = other RNA
caatcagtactaacacaaccaccatcagtatcaggagcaccaggacaatcagtaacaatatcatgcacaggaacatcatcaaacataggagacttcgacgtacactggtaccaacaactaccaggaacagcaccaaaactattactatacgaaaacaacaaaagaccaagcggaataccagacagattctcaggatcaaaatcaggaacatcagcaacactagcaataacaggactacaaacaggagacgaagcagactactactgcggaacatgggacggatcactatcaacaggaggagtaataggaacaggaacaaaagtaacagtacta

SEQ ID NO: 48546 - RNA, 333 nt, synthetic construct
  misc_feature 1..333: note = derived and/or modified sequence opt6 from anti-HIV_048-097603_VR-Chain
  source 1..333: mol_type = other RNA
caatcagtactaacacaaccaccatcagtatcagcagcaccaggacaaaaagtaacaatatcatgctcaggatcatcatcaaacataggaaacaactacgtatcatggtaccaacaactaccaggaacagcaccaaaactactaatatacgacacagtaaaaagaccatcaggaataccagacagattctcaggatcaaaatcaggaacatcagcaacactaggaataacaggactacaaacaggagacgaagcagactactactgcggaacatgggactcatcactatcaggaggaggagtattcggaacaggaacaaaagtaacagtacta

SEQ ID NO: 48547 - RNA, 333 nt, synthetic construct
  misc_feature 1..333: note = derived and/or modified sequence opt6 from anti-HIV_048-097107_VR-Chain
  source 1..333: mol_type = other RNA
caatcagtattaacacaaccaccatcagtatcagcagcaccaggacaaaaagtaacaatatcatgctcaggatcatcatcaaacatagaaaacaactacgtatcatggtacagacaagtaccaggaacagcaccaaaactactaatatacaaaaacgacaacagaccatcaggaataccagacagattctcaggatcaaaatcaggaacatcagcaacactaggaataacaggactacaaacaggagacgaagcagactactactgcggaatatgggacacatcattatcagcaggaggagtattcggaacaggaacaaaagtaacagtacta

SEQ ID NO: 48548 - RNA, 333 nt, synthetic construct
  misc_feature 1..333: note = derived and/or modified sequence opt6 from anti-HIV_048-096871_VR-Chain
  source 1..333: mol_type = other RNA
caaccagtactaacacaaccaccatcagcatcaggaacaccaggacaaagagtaacaatatcatgctcaggatcatcatcaaacataggatcaaactacgtatactggtaccaacaattaccaggaacaacaccaaaattactaatatacagaaacaaccaaagaccatcaggaataccagacagattctcaggatcaaaaagcggaacatcagcaacattaggcataacaggactacaaacaggagacgaagcagactactactgcggaacatgggacacaagcctatcaacaggaggagtattcggaacaggaacaaaagtaacagtacta

SEQ ID NO: 48549 - RNA, 333 nt, synthetic construct
  misc_feature 1..333: note = derived and/or modified sequence opt6 from anti-HIV_048-096668_VR-Chain
  source 1..333: mol_type = other RNA
caatcagtactaacacaaccaccatcagtatcagcagcaccaggacaaaaagtaacaatatcatgctcaggaagcggatcaaacataggaaacaattacgtatcatggtaccaacaactaccaggaacagcaccaaaactattaatatacaaaaacacagaaagaccatcaggaataccagacagattctcaggatcaaaatcaggaacatcagcaacattagacataacaggactacaaacaggagacgaagcagactactactgcggaacatgggacacatcactatcagcaggaggagtattcggaacaggaacaaaagtaacagtacta

SEQ ID NO: 48550 - RNA, 333 nt, synthetic construct
  misc_feature 1..333: note = derived and/or modified sequence opt6 from anti-HIV_048-095236_VR-Chain
  source 1..333: mol_type = other RNA
caatcagtattaacacaaccaccaagcgtaagcgcaccaccaggacaaaaagtaacaataagctgtagcggaacaacaagtaatataggaagcaattacgtagcatggtaccaacaattaccaggaacagcaccaaaattagtaatatatgaaaatagcaaaagaccaagcggaataccagacagattctcaggatcaaaatcaggaacaagcgcaacattaggaataacaggactacaaacaggagacgaagcagattactattgcggaacatgggacacaagcctaagtgcaggaggagtatttggatcaggaacaaaagtaacagtacta

SEQ ID NO: 48551 - RNA, 333 nt, synthetic construct
  misc_feature 1..333: note = derived and/or modified sequence opt6 from anti-HIV_048-094155_VR-Chain
  source 1..333: mol_type = other RNA
caatcagtactaacacaaccaccatcagtatcagcagcaccaggacaaaaagtaacagtatcatgctcaggatcatcatcagacataggagaaaactacgtatcatggtaccaacaattcccagaaacagcaccaaaactactaatatacgacaacaacaaaagaccatcaggaataccagacagattctcaggatcaaaatcaggaacatcagcaacactagcaataacaggactacaaacaggagacgaagcagactactactgcggaacatgggactcatcactatcagcaggaggagtattcggaacaggaacaaaagtaacagtacta

SEQ ID NO: 48552 - RNA, 333 nt, synthetic construct
  misc_feature 1..333: note = derived and/or modified sequence opt6 from anti-HIV_048-093219_VR-Chain
  source 1..333: mol_type = other RNA
caaccactattaacacaaccaccagcagtatcagcaacaccaggacaaagagtaacaataagctgtacaggaagctcaagcaatataggaagaacattcgtaaactggtaccaacaattaccaggaacagcaccaaaactattaatatatgaaaatagcaaaagaccaagcggaataccagacagattctcaggatcaaaatcaggaacaagcgcaacattaggaataacaggactacaaacaggagacgaagcagattactattgcggaacatgggacacaagcctaagcgcaggaggagtatttggatcaggaacaaaagtaacagtacta

SEQ ID NO: 48553 - RNA, 333 nt, synthetic construct
  misc_feature 1..333: note = derived and/or modified sequence opt6 from anti-HIV_048-092976_VR-Chain
  source 1..333: mol_type = other RNA
caatcagtactaacacaaccaccatcagtatcagcagcatcaggacaaaaagtaacaatatcatgctcaggatcatcatcaaacataggaaacaactacgtaagctggtaccaacacctaccaggaacagcaccaaaactactaatatacaaaaacgacaaaagaccatcaggaataccagacagattctcaggatcaaaatcaggaacatcagcaacactaggaataacaggactacaaacaggagacgaagcagactactactgcggaacatgggacacatcattatcagcaggaggagtattcggaacaggaacaaaagtaacagtacta

SEQ ID NO: 48554 - RNA, 333 nt, synthetic construct
  misc_feature 1..333: note = derived and/or modified sequence opt6 from anti-HIV_048-090866_VR-Chain
  source 1..333: mol_type = other RNA
caatcagtactaacacaaccaccatcagtatcagcagcaccaggacaaaaagtaacaatatcatgctcaggatcaagatcaaacataggatccaactacatatcatggtaccaacaactaccaggaacagcaccaaaactactaatatacgacaacaacaaaagaccatcaggaataccagacagattctcaggatcaaaatcaggaacatcagcaacactaggaataacaggactacaaacaggagacgaagcatactactactgcggaacatgggacacatcactatcagcaggaggagtattcggatcaggaacaaaagtaacagtacta

SEQ ID NO: 48555 - RNA, 333 nt, synthetic construct
  misc_feature 1..333: note = derived and/or modified sequence opt6 from anti-HIV_048-090650_VR-Chain
  source 1..333: mol_type = other RNA
caaagcgcattaacacaaccagcaagcgtaagcggaagtttaggacaaagcataacaataagctgtagcggaagctcaagcacaataggaaacaattacgtaagctggtaccaagtattaccaggagcagcaccaaaactattaatatgtaaaaataacgaaagaccaagcggaataccagacagattctcaggatcaaaatcaggaacaagcgcaacattaggaataacaggactacaaacaggagacgaagcagattactattgcggaacatgggacacatcattaagcgcaggaggagtatttggaacaggaacaaaagtaacagtacta

SEQ ID NO: 48556 - RNA, 333 nt, synthetic construct
  misc_feature 1..333: note = derived and/or modified sequence opt6 from anti-HIV_048-089009_VR-Chain
  source 1..333: mol_type = other RNA
caaagcgtattaacacaaccaccaagcgtaagcgcagcaccaggacaaaaagtaacaataagctgtagcggaggatcaagcaatataggaaacaattacgtaagctggtaccaacaattaccagaaacagcaccaaaactaataatatatgacaataacaaaagaccaagcggaatacatgacagattctcaggatcaaaatcaggaacaagcgcaacattagacataacagcactacaaacaggagacgaagcagattactattgcggaacatgggacacatcattaagcgcaggaggagtatttggaacaggaacaaaagtaacagtatta

SEQ ID NO: 48557 - RNA, 333 nt, synthetic construct
  misc_feature 1..333: note = derived and/or modified sequence opt6 from anti-HIV_048-088654_VR-Chain
  source 1..333: mol_type = other RNA
caatcagcactaacacaaccaagatcagtatcagcagcaccaggacaaaaagtaagcatatcatgctcaggaagatcaacaaatctaggatacaactacgtatcatggtaccaacacctaccaggagcagcaccaaaagtactaatatacgaaaacaacaaaagaccatcaggaataccagacagattctcaggatcaaaatcaggaacaagcgcaacactaggaataacaggactacaaacaggagacgaagcagactactactgcggaacatgggacacatcactatcagcaggaggagtattcggatcaggaacaaaagtaaccgtacta

SEQ ID NO: 48558 - RNA, 333 nt, synthetic construct
  misc_feature 1..333: note = derived and/or modified sequence opt6 from anti-HIV_048-086513_VR-Chain
  source 1..333: mol_type = other RNA
caatcagcattaacacaaccaccatcagtatcagcagcaccaggacaaaaagtaacaatatcatgctcaggatcaacatcaaacataggaaacaactacgtatcatggtaccaacaattaccaggaacagcaccaaaactactaatatacaaaaacgacaacagaccatcaggaataccagacagattctcatcatcaaaatcaggaacatcagcaacattaggaataacaggactacaaacaggagacgaagcagactactactgcggaatatgggacacatcactatcagcaggaggagtattcggaacaggaacaaaagtaacagtacta

SEQ ID NO: 48559 - RNA, 324 nt, synthetic construct
  misc_feature 1..324: note = derived and/or modified sequence opt6 from anti-HIV_048-086024_VR-Chain
  source 1..324: mol_type = other RNA
ttagcacaaccaccatcagtatcaggaacaccaggacaaagagtaacaatatcatgttcaggatcatcatcaaatataggatcaaatgcagtaaactggtaccaacaatttccaggaacagcaccaaaactactaatatatgacacagacaaaagaccaagcggaataccagacagattctcaggatcaaaatcaggaacatcagcaatactaggaataacaggactacaaacaggagacgaagcagactactactgcggagcatgggacacatcactatcagcaggaggagtattcggaacaggaacaaaagtaacagtacta

SEQ ID NO: 48560 - RNA, 333 nt, synthetic construct
  misc_feature 1..333: note = derived and/or modified sequence opt6 from anti-HIV_048-085857_VR-Chain
  source 1..333: mol_type = other RNA
caaagcgcattaacacaaccaagaagcgtaagcggaagtttaggacaaagcgtaacaataagctgtacaggaacaacaagcgatgtaggattcgattacgtaagctggtaccaagtattaccaggaacagcaccaaaattattaatatataaaaatgacaaaagaccaagcggaataccagacagattctcaggatcaaaatcaggaacaagcgcaacattaggaataacaggactacaaacaggagacgaagcagattactattgcggaacatgggacacaagtttaagcacaggaggagtatttggaacaggaacaaaagtaacagtacta

SEQ ID NO: 48561 - RNA, 333 nt, synthetic construct
  misc_feature 1..333: note = derived and/or modified sequence opt6 from anti-HIV_048-084277_VR-Chain
  source 1..333: mol_type = other RNA
caatcagtattaagacaaccaccatcattatcaggagcaccaggacaaagagtaacattatcatgtacaggatcatcatcaaatataggaggatatgacgtacactggtaccaacacgtaccaggaacagcaccaaaactattaatatatgaaaatacaaaaagaccaagcggaataccagacagattctcaggatcaaaatcaggaacatcagcaacattaggaataacaggactacaaacaggagacgaagcagattactattgcggaacatgggacacatcattatcagcaggaggagtatttggatcaggaacaaaagtaacagtacta

SEQ ID NO: 48562 - RNA, 333 nt, synthetic construct
  misc_feature 1..333: note = derived and/or modified sequence opt6 from anti-HIV_048-084245_VR-Chain
  source 1..333: mol_type = other RNA
caatcaacactaacacaaccaccatcagtatcagcagcaccaggacaaaaagtaacaatatcatgctcaggatcaaactcaaacataggaaaacactacgtatcatggtaccaacaattcccaggagcagtaccaaaactactaatatacgaaaacaaaaaaagaccatcaggaataccagacagattctcaggatcaaaatcagacacatcagcaacactagacataacaggactacaaacaggagacgaagcagactactactgcggaacatgggacacatcactaagcgcaggaggagtattcggatcaggaacaaaagtaacagtacta

SEQ ID NO: 48563 - RNA, 333 nt, synthetic construct
  misc_feature 1..333: note = derived and/or modified sequence opt6 from anti-HIV_048-082487_VR-Chain
  source 1..333: mol_type = other RNA
caatcactattaacacaaccaccaagcgtaagcgcagcaccaggacaaaaagtaacaataagttgtagcggaagctcaagcacaataggaaacaattacgtaagttggtaccaagtattaccaggagcagcaccaaaactattaatatgtaaaaataacgaaagaccaagcggaataccagacagattctcaggatcaaaatcaggaacaagcgcaacactaggaataacaggactacaaacaggagacgaagcagattactattgcggaacatgggacaccagcttaagcgcaggaggagtatttggatcaggaacaaaagtaacagtacta

SEQ ID NO: 48564 - RNA, 333 nt, synthetic construct
  misc_feature 1..333: note = derived and/or modified sequence opt6 from anti-HIV_048-081787_VR-Chain
  source 1..333: mol_type = other RNA
caatcagtattaacacaaccaccatcagtatcaggagcaccaggacaaagagtaacaatatcatgtacaggatcatcatcaaatataggatcatacgacgtacactggtatcaacaactaccaggaacagcaccaaaactattaatatacgaaaactcaaaaagaccatcaggaataccagacagattctcaggatcaaaatcaggaacatcagcaacattaggaataacaggactacaaacaggagacgaagcagactactattgcggaacatgggacacatcattatcaggaggaggagtattcggaacaggaactaaagtaacagtacta

SEQ ID NO: 48565 - RNA, 333 nt, synthetic construct
  misc_feature 1..333: note = derived and/or modified sequence opt6 from anti-HIV_048-081062_VR-Chain
  source 1..333: mol_type = other RNA
caatcagtattaacacaaccaccaagcgtaagcgcagcaccaggacaaaaagtaacaataagttgtagcggaacatcaagtaatataggagcaaattacgtaagctggtaccaacaagtaccaggaacagcaccaaaactattaatatatgaaaataacaaaagaccaagcggaacaccagacagattctcaggatcaaaatcaggaacaagcgcaacattaggaataacaggactacaaacaggagacgaagcagattactattgcggaacatgggacacatcattaagcgcaggaggagtatttggaagcggaacaaaagtaacagtacta

SEQ ID NO: 48566 - RNA, 333 nt, synthetic construct
  misc_feature 1..333: note = derived and/or modified sequence opt6 from anti-HIV_048-079639_VR-Chain
  source 1..333: mol_type = other RNA
caaagcgtactaacacaaccaccatcagtatcagcagcaccaggacaaaaagtaacaatatcatgctcaggatcatcatcaaacataggaaaaaactacgtatcatggtaccaacacctaccaggaacagcaccaaaactactaatatacgaaaacaacaaaagaccatcaggaataccagacagattctcaggatcaaaatcaggaacagcagcaacactaggaataacaggactacaaacaggagacgaagcaggatactactgcggaacatgggacacatcactatcagcaggaggagtattcggaacaggaacaaaagtaacagtacta

SEQ ID NO: 48567 - RNA, 333 nt, synthetic construct
  misc_feature 1..333: note = derived and/or modified sequence opt6 from anti-HIV_048-079126_VR-Chain
  source 1..333: mol_type = other RNA
caatcagtactaacacaaccaccatcagtatcagcagcaccaggacaaaaagtaacaatatcatgctcaggatcatcatcaaacataggaaacaactacgtatcatggtaccaacacctaccaggaacaccaccaaaactactaatattcaaaaacaacgaaagaccatcaggaataccagacagattctcaggatcaaaatcaggaacatcagcaacactaggaataacaggactacaaacaggagacgaagcagactactactgcggaacatgggacacatcactatcagcaggaggagtattcggaacaggaacaaaagtaacagtacta

SEQ ID NO: 48568 - RNA, 333 nt, synthetic construct
  misc_feature 1..333: note = derived and/or modified sequence opt6 from anti-HIV_048-073118_VR-Chain
  source 1..333: mol_type = other RNA
caaagcgtattaacacaaccaccaagcgtaagcgcagcaccaagacataacgtaacaataagctgtagcggaggatcaagcaatataggaaacaatttcgtaagctggtaccaatacttaccaggaacagcaccaaaactattaatatatgacaataacaaaagaccaagtggaataccagacagattctcaggatcaaaatcaggaacaagcgcaacattaggaataacaggactacaaacaggagacgaagccgattactattgcgcaacatgggacacatcattaagcgcaggaggagtatttggaacaggaacaaaagtaacagtacta

SEQ ID NO: 48569 - RNA, 333 nt, synthetic construct
  misc_feature 1..333: note = derived and/or modified sequence opt6 from anti-HIV_048-070264_VR-Chain
  source 1..333: mol_type = other RNA
caatcagtactaacacaatcaccatcagtatcagcagcaccaggacaaaaagtaacaatatcatgctcaggaacatcatcaaacataggaaacacatacgtaagctggtaccaacaactaccaggaacagcaccaaaactactaatatacaaaaacgacaaaagaccatcaggaataccagacagattctcaggatcaaaatcaggaacatcagcaacactaggaataacaggattacaaacaggagacgaagcagactactactgcggaacatgggactcatcactatcagcaggaggagtattcggaacaggaacaaaagtaacagtatta

SEQ ID NO: 48570 - RNA, 333 nt, synthetic construct
  misc_feature 1..333: note = derived and/or modified sequence opt6 from anti-HIV_048-069426_VR-Chain
  source 1..333: mol_type = other RNA
caatcagtattaacacaaccaccatcagtaagcgcagcaccaggacaaaaagtaacaatatcatgctcaggatcatcatcaacaataggaaacaactacgtatcatggtaccaacaattacccggaacagcaccaaaactactaatatacaaaaacaacaaaagaccatcaggagtaccagacagattctcaggatcaaaatcaggaacatcagcaacaccaggaataacaggactacaaacaggagacgaagcagactactactgcggaacatgggacacatcactatcagcaggaggagtattcggaacaggaacaaaagtaacagtacta

SEQ ID NO: 48571 - RNA, 333 nt, synthetic construct
  misc_feature 1..333: note = derived and/or modified sequence opt6 from anti-HIV_048-068564_VR-Chain
  source 1..333: mol_type = other RNA
caatcagcattaacacaaccaagatcagtatcaggatcaccaggacaatcagtagcaatatcatgtacaggaacatcatcagatgtaggatacaattacgtatcatggtaccaagtattaccaggaacagcaccaaaactattaatatataaaaataacgaaagaccatcaggaataccagacagattctcaggatcaaaatcaggaacatcagcaacattaggaataacaggactacaaacaggagacgaagcagactactattgcggaacatgggacacatcattatcagcaggaggagtattcggaacaggaacaaaagtaacagtacta

SEQ ID NO: 48572 - RNA, 333 nt, synthetic construct
  misc_feature 1..333: note = derived and/or modified sequence opt6 from anti-HIV_048-068345_VR-Chain
  source 1..333: mol_type = other RNA
caatcagtactaacacaaacaccatcagtatcagcagcaccaggacaaagagtaacaatatcatgctcaggatcaacatcaaacataggaaacaactacgtatcatggtaccaacaactaccaggaacagcaccaaaactactaatatacgaaaacaacaaaagaccatcaggaataagagacagattctcagcatcaaaatcaggaacatcagcaacactaggaataacaggactacaaacaggagacgaagcagactactactgcggaacatgggacacatcactatcagcaggaggagtattcggaacaggaacaaaagtaacagtacta

SEQ ID NO: 48573 - RNA, 333 nt, synthetic construct
  misc_feature 1..333: note = derived and/or modified sequence opt6 from anti-HIV_048-067337_VR-Chain
  source 1..333: mol_type = other RNA
caatcagtactaacacaaccaccatcagtatcagcagcaccaggacaaaaagtaacaatatcatgctcaggagcatcatacaacataggaaaaaacagcgtaagctggtaccaacaactaccaggaacagcaccaaaactattaatatacaaaaacgacaaaagaccatcaggaataccagacagattctcaggatcaaaatcaggagcatcagcaacactagacataacaggactacaaacaggagacgaagcagactactactgcggaatatgggacacatcactatcagcaggaggagtattcggaacaggaacaaaagtaacagtacta

SEQ ID NO: 48574 - RNA, 333 nt, synthetic construct
  misc_feature 1..333: note = derived and/or modified sequence opt6 from anti-HIV_048-067180_VR-Chain
  source 1..333: mol_type = other RNA
caatcagtactaacacaaccaccatcagtatcagcagcaccaggacaaaaagtaacaatatcatgctcaggatcatcaccaaacataggaaacaactacgtatcatggtaccaaagactaccaggaacagcaccaaaactactaatatacgaaaacgaccaaagaccatcaggaataccagacagaatatcaggatcaaaatcaggaacatcagcaacactaggaataacaggactacaaacaggagacgaagcagactactactgcggaacatgggacacatcattatcaacaggaggagtattcggaacaggaacaaaagtaacagtacta

SEQ ID NO: 48575 - RNA, 333 nt, synthetic construct
  misc_feature 1..333: note = derived and/or modified sequence opt6 from anti-HIV_048-063017_VR-Chain
  source 1..333: mol_type = other RNA
caaagcgtattaacacaaccaccaagcgtaagcgcagcaccaggacaaaaagtaacaataagctgtagcggaagctcaagcaatataggaaacaattacgtaagctggtaccaacaccatccaggaaaagcaccaaaactaatgatatatgaagtaagcaaaagaccaagcggaataccagacagattctcaggatcaaaatcaggaacaagcgcaacactaggaataacaggactacaaacaggagacgaagcagattactattgcggaacatgggacacatcattaaacagaggaggagtatttggaacaggaacaaaagtaacagtacta

SEQ ID NO: 48576 - RNA, 333 nt, synthetic construct
  misc_feature 1..333: note = derived and/or modified sequence opt6 from anti-HIV_048-061885_VR-Chain
  source 1..333: mol_type = other RNA
caatcagtactaacacaaccaccatcagtatcagcagcaccaggacaaaaagtaacaatatcatgctcaggatcatcatcaaacataggatcacactacatatcatggtaccaacaattcccaggagcagcaccaaaactactaatatacgaaaacgacaaaagaccatcaggaataccagacagattctcagcatcaaaatcaggaacatcagcaacactaggaataacaggactacaaacaggagacgaagcagactactactgcggaacatgggacacatcattatcagccggaggagtattcggaacaggaacaaaagtaacagtacta

SEQ ID NO: 48577 - RNA, 333 nt, synthetic construct
  misc_feature 1..333: note = derived and/or modified sequence opt6 from anti-HIV_048-061671_VR-Chain
  source 1..333: mol_type = other RNA
caatcagtactaacacaaccaccatcagcatcaggaacaccaggacaaagagtaacaatatcatgctcaggaagcagatcaaacataggatcaaactacgtatactggtaccaacaatttccaggaacagcaccaaaacttttaatatacgaaaacaacaaaagaccatcaggaataccagacagattctcaggatcaaaatcaggaacatcagcaacactaggaataacaggactacaaacaggagacgaagcagactactactgcgcaacatgggacacatcactatcagcaggaggagtattcggaacaggaacaaaagtaacagtacta

SEQ ID NO: 48578 - RNA, 333 nt, synthetic construct
  misc_feature 1..333: note = derived and/or modified sequence opt6 from anti-HIV_048-060700_VR-Chain
  source 1..333: mol_type = other RNA
caatcagtactaacacaactaccatcactatcagcagcaccaggacaaaaagtaacaatatcatgctcaggatcatcatcaaacataggaaacaactacgtatcatggtaccaacaactaccaggaacagcaccaaaactactaatatacgaaaacaacaaaagaccatcaggaataccagacagattctcaggatcaaaatcaggaacatcagcaacactaggaataacaggactacaaacaggagacgaagcagaatactactgcgcaacatgggacgcatcactatcaggaggaggagtattcggaacaggaacaaaagtaacagtacta

SEQ ID NO: 48579 - RNA, 333 nt, synthetic construct
  misc_feature 1..333: note = derived and/or modified sequence opt6 from anti-HIV_048-060592_VR-Chain
  source 1..333: mol_type = other RNA
caatcagtactaacacaaccaccatcagtatcagcagcaccaggacaaaaagtaacaatatcatgctcaggatcatcatcaaacataggaaaaaactacgtatcatggtaccaacaattcccaggaacagcaccaaaactactaatatacgaaaacaacaaaagaccatcaggaataccagacagattctcagcatcaaaaagcgcaacatcagcaacactagtaataacaggactacaaacaggagacgaagcagtatactactgcggaacatgggacacatcactatcagcaggaggagtattcggaagcggaacaaaagtaacagtacta

SEQ ID NO: 48580 - RNA, 333 nt, synthetic construct
  misc_feature 1..333: note = derived and/or modified sequence opt6 from anti-HIV_048-060300_VR-Chain
  source 1..333: mol_type = other RNA
caaccagtactaacacaaccaccatcagcatcaggaacaccaggacaaagagtaacaatatcatgttcaggatcatcatcaaatataggaaccaatacagtaaactggtaccaacaatttccaggaacagcaccaaaactattaatatacaaaaataacgaaagaccatcaggaataccagacagattctcaggatcaaaatcaggaacatcagcaacattaggaataacaggactacaaacaggagacgaagcagactactactgcggaacatgggacacatcactatcaggaggaggagtattcggaacaggaacaaaagtaacagtacta

SEQ ID NO: 48581 - RNA, 333 nt, synthetic construct
  misc_feature 1..333: note = derived and/or modified sequence opt6 from anti-HIV_048-059141_VR-Chain
  source 1..333: mol_type = other RNA
caaccagtactaacacaaccaccatcagcatcaggaacaccaggacaaagagtatcaatatcatgcagcggaaacttctcaaacataggatcaaaatacgtatactggtaccaacaaataccaggaacagcaccaaacgtaataatatacagaacaaacctacgaccatcaggaataccagacagattctcagcatcaaaatcaggaacatcagcaacactaggaataacaggattacaaacaggagacgaagcagactactactgcggaacatgggacacatcactatcagcaggaggagtattcggaacaggaacaaaagtaacagtacta

SEQ ID NO: 48582 - RNA, 333 nt, synthetic construct
  misc_feature 1..333: note = derived and/or modified sequence opt6 from anti-HIV_048-057777_VR-Chain
  source 1..333: mol_type = other RNA
caatcagtactaacacaaccaccatcactatcagcagcaccaggacaaagagtaacaatatcatgctcaggatcatcatcaaacataggaaacaactacgtatcatggtaccaacaattcccaggaacagcaccaacattactaatatacgaaaacgacaaaagaccatcaggaataccagacagattctcagcatcaaaatcaggaacatcagcaacactaggaataacaggactacaagcaggagacgaagcagactactactgcggaacatgggacacatcactatcagcaggaggagtattcggaacaggaacaaaagtaacagtacta

SEQ ID NO: 48583 - RNA, 333 nt, synthetic construct
  misc_feature 1..333: note = derived and/or modified sequence opt6 from anti-HIV_048-056928_VR-Chain
  source 1..333: mol_type = other RNA
caatcagtactcacacaaccaccatcagtatcagcagcaccaggacaaaaagtaacaatatcatgcagcggatcaagttcaacaataggaaacaactacgtatcatggtaccaactactaccaggaacagcaccaaaactactaatatacgacaacgacaacagaccatcagacataccagacagattctcaggatcaaaatcaggaacatcagcaacactaggaataacaggactacaaacaggagacgaagcagactactactgcggagcatgggacacatcactatcagcaggaggagtattcggaacaggaacaaaagtaacagtacta

SEQ ID NO: 48584 - RNA, 333 nt, synthetic construct
  misc_feature 1..333: note = derived and/or modified sequence opt6 from anti-HIV_048-056131_VR-Chain
  source 1..333: mol_type = other RNA
caattcgtactaacacaaccagcatcagtatcaggatcaccaggacaatcaataacaatatcatgctcaggaacatcatcagacgtaggatacaactacgtatcatggtaccaacaactaccaggaacagcaccaaaactactaatatacgaaaacacaaaaagaccatcaggaataccagacagattctcaggaagcaaatcaggaacatcagcaacactaggaataacaggactacaaacaggagacgaagcagactactactgcggaacatgggacacatcactatcagcaggaggagtattcggatcaggaacaaaagtaacagtacta

SEQ ID NO: 48585 - RNA, 333 nt, synthetic construct
  misc_feature 1..333: note = derived and/or modified sequence opt6 from anti-HIV_048-055864_VR-Chain
  source 1..333: mol_type = other RNA
caatcagtattaacacaaccaccatcagtatcagtagcaccaggacaaaaagtaacaatatactgttcaggatcatcatcaaatataggaaaaaactcagtatcatggtacgtacaagtaccaggaacagcaccaaaattcctaatatacgaaaataaccaaagaccaagtggaatatcagacagattctcaggatcaaaatcaggaacatcagcaacactaggaatatcaggactacaaacaggagacgaagcagactactactgcggaacatgggacacatcactatcaggaggaggagtattcggaacaggaacaaaagtaacagtacta

SEQ ID NO: 48586 - RNA, 333 nt, synthetic construct
  misc_feature 1..333: note = derived and/or modified sequence opt6 from anti-HIV_048-055094_VR-Chain
  source 1..333: mol_type = other RNA
caatcagtattaacacaaccaccatcagtaagcggagcaccaggacaaagagtaacaatatcatgttcagcatcatcatcatcaataggaaacgacttcgtatcatggtaccaacaattaccaggaacagcaccaaaactactaatatcagaaaataacaaaagaccatcaggaataccagacagattctcaggatcaaaatcaggaacatcagcaacattaggcataacaggactacaaacaggagacgaagcagactactattgcggaacatgggactcatcattatcagcaggaggagtatttggaacaggaacaaaagtaacagtacta

SEQ ID NO: 48587 - RNA, 333 nt, synthetic construct
  misc_feature 1..333: note = derived and/or modified sequence opt6 from anti-HIV_048-054343_VR-Chain
  source 1..333: mol_type = other RNA
caatcagtattaacacaaccaccaagcgtaagcggagcaccaggacaaagagtaacaataagctgtacaggaagctcaagtaatataggaggatatgacgtaaactggtaccaacaattaccaggaacagcaccaaaactattaatatttaaaaataacgaaagaccaagcggaataccagacagattctcaggatcaaaatcaggaacaagcgcaacattaggaataacaggactacaaacaggagacgaagcagattactattgcggaacatgggacacaagcctaagcgcaggaggagtatttggaacaggaacaaaagtaacagtacta

SEQ ID NO: 48588 - RNA, 333 nt, synthetic construct
  misc_feature 1..333: note = derived and/or modified sequence opt6 from anti-HIV_048-054193_VR-Chain
  source 1..333: mol_type = other RNA
caaagcgtattaacacaaccaccaagcgtaagcgcagcaccaggacaaaaagtaacaataagctgtagtggaggatcaagcaatataggaaacaattacgtgagctggtaccatcaagtaccaggaacagcaccaaaactattaatatttgaaaataacaaaagaccaagcggaataccagacagattctcaggatcaaaatcaggaacaagcgcaacattaggaataacaggactacaaacaggagacgaagcagattactattgcggaacatgggacacatcattaagcggaggaggagtatttggaacaggaacaaaagtaacagtacta

SEQ ID NO: 48589 - RNA, 333 nt, synthetic construct
  misc_feature 1..333: note = derived and/or modified sequence opt6 from anti-HIV_048-052521_VR-Chain
  source 1..333: mol_type = other RNA
caatcagtattaacacaaccaccatcagtatcagcagcaccaggacaaaaagtaacaatatcatgctcaggatcatcatcaaacataggaagacactcagtatcatggtaccaacaactaccaggaacagcaccaaaactactaatatacgacacagacaaaagaccatcaggaataccagacagattctcaggatcaaaatcaggaacatcagcaacactaggaataacaggactacaaacaggagacgaagcagactactactgcggaacatgggacacatcattatcaggaggaggagtattcggaacaggaacaaaagtaacagtacta

SEQ ID NO: 48590 - RNA, 333 nt, synthetic construct
  misc_feature 1..333: note = derived and/or modified sequence opt6 from anti-HIV_048-049037_VR-Chain
  source 1..333: mol_type = other RNA
caatcagtactaacacaaccaccatcagtatcagcagcaccaggacaaaaagtaacaatatcatgctcaggatcatcattcaacataggaaacaactacgtatcatggtaccaacacctaccaggaacagcaccaaaactactaatatacgcagcagtaacaagaccatcaggaataccagacagattctcaggatcaaaatcaggaacatcagcaacattagacataacaggactacaaacaggagacgaagcagactactactgcggaacatgggacacatcactatcagcaggaggagtattcggaacaggaacaaaagtaacagtacta

SEQ ID NO: 48591 - RNA, 333 nt, synthetic construct
  misc_feature 1..333: note = derived and/or modified sequence opt6 from anti-HIV_048-048720_VR-Chain
  source 1..333: mol_type = other RNA
caatcagtactaacacaaccaccagcagtatcagcagcaccaggacaaagagtagcaatatcatgctcaggaacatcatcaaacataggatcaaacttagtatcctggtaccaacaattaccaggaaaagcaccaagattactaatatacgacaactacaaaagaccatcaggaataccagacagattctcaggatcaaaaagcggaacatcagcaacactaggaataacaggactacaaacaggagacgaagcagactactactgcggaacatgggacacatcactatcaacaggaggagtattcggaacaggaacaaaagtaacagtacta

SEQ ID NO: 48592 - RNA, 333 nt, synthetic construct
  misc_feature 1..333: note = derived and/or modified sequence opt6 from anti-HIV_048-048542_VR-Chain
  source 1..333: mol_type = other RNA
caatcagtactaacacaaccaccatcagtatcagcagcaccaggacaaaaagtaacaatatcatgctcaggatcatcatcaaacataggaaacaacttcgtatcatggtaccaacaactaccaggaacagcaccaaaactactaatatacaacaacgacagaagaccatcaggagtaccagacagattctcagcatcaaaattcggaacagcagcaacactaggaataacaggactacaaacaggagacgaagcagactactactgcggaacctgggactcatcactatcagcaggaggagtattcggaacaggaacaaaagtaacagtacta

SEQ ID NO: 48593 - RNA, 333 nt, synthetic construct
  misc_feature 1..333: note = derived and/or modified sequence opt6 from anti-HIV_048-047777_VR-Chain
  source 1..333: mol_type = other RNA
caatcagtactaacacaaccaccatcagcatcaggaacaccaggacaaagagtaacaatatcatgctcaggatcatcagcaaacataggaacaaactacgtattctggtaccaacacctaccaggaacagcaccaaaactattaatatacgaaaacaacaaaagaccatcaggaataccagacagattctcaggatcaaaatcaggaacatcagcaacactaggaataacaggactacaaacaggagacgaagcagactactactgcggaacatgggactcatcactatcagcaggaggagtattcggaacaggaacaaaagtaacagtacta

SEQ ID NO: 48594 - RNA, 333 nt, synthetic construct
  misc_feature 1..333: note = derived and/or modified sequence opt6 from anti-HIV_048-046841_VR-Chain
  source 1..333: mol_type = other RNA
caatcagtattaacacaaccaccaagcgtaagcgcagcattaggacaaaaagtaacaataacatgtagcggagacaatggaaatataggataccattacgtaagctggtaccaacaagtaggaagagcagcaccaaaactattaatatatgcaaataacaaaagaccaagcggaataccagacagattctcaggatcaaaatcaggaacaagcgcaacattaggaataacaggactacaaacaggagacgaagcagattactattgcggaacatgggacacaagcttaagcgcaggaggagtatttggatcaggaacaaaagtaacagtacta

SEQ ID NO: 48595 - RNA, 333 nt, synthetic construct
  misc_feature 1..333: note = derived and/or modified sequence opt6 from anti-HIV_048-046202_VR-Chain
  source 1..333: mol_type = other RNA
caatcagtactaacacaaccaccatcagtatcagcagcaccaggacaaaaagtaacaatatcatgctcaggatcatcatcaaacataggaaacaactacgtatcatggtaccaacacctaccaggaacagcaccaaaattactaatatacgacacatacaaaagacactcaggagtaccagacagattctcaaactcaaaatcaggaacatcagcaacactagcaataacaggactacaaacaggagacgaaggagactactactgcggagcatgggacacatcactatcagcaggaggagtattcggaacaggaacaaaagtaacagtacta

SEQ ID NO: 48596 - RNA, 333 nt, synthetic construct
  misc_feature 1..333: note = derived and/or modified sequence opt6 from anti-HIV_048-046059_VR-Chain
  source 1..333: mol_type = other RNA
caatcagtactaacacaaccaccatcagtatcagcagcaccaggacaaaatgtaacaatatcatgctcaggaacatcatcaaacatagaaaacaactacgtatcatggtaccaaacactaccaggaacagcaccaaaactattaatatacgacaacaacaaaagaccatcaggaataccagacagattctcaggatcaaaatcaggaacatcagcaacactaggaataacaggactacaaacaggagacgaagcagactactactgcggaacatgggactcatcactatcagcaggaggagtattcggaacaggaacaaaagtaacagtacta

SEQ ID NO: 48597 - RNA, 333 nt, synthetic construct
  misc_feature 1..333: note = derived and/or modified sequence opt6 from anti-HIV_048-043568_VR-Chain
  source 1..333: mol_type = other RNA
caatcagtactaacacaaccaccatcagtatcagcagcaccaggacaaaaagtaacaatatcatgttcaggatcagactcaaatataggatcaaattacgtatcatggtaccaacaactaccaggagcagcaccaaaactactaatatacaaaaataacaacagaccatcaggaataccagacagattctcaggatcaaaatcaggaacatcagcaacactaggaataagcggactacaaacaggagacgaagcagactactactgcggaacatgggacacatcactatcaggaggaggagtattcggaacaggaacaaaagtaacagtacta

SEQ ID NO: 48598 - RNA, 333 nt, synthetic construct
  misc_feature 1..333: note = derived and/or modified sequence opt6 from anti-HIV_048-042713_VR-Chain
  source 1..333: mol_type = other RNA
caaagcgtattaacacaaccaccaagcgtaagcgcagcaccaggacaaaaagtaacaataagctgtagcggaagctcaagcaatataggaagacattacgtaagttggtaccaacaattaccaggaacagcaccaaaactattaatatatgacaataactcaagaccaagcggaataccagacagattctcaggatcaaaatcaggaacaagcgcaacattaggaataacaggactacaaacaggagacgaagcagattactattgcggaacatgggacacatcattaaacagaggaggagtatttggaacaggaacaaaagtaacagtacta

SEQ ID NO: 48599 - RNA, 333 nt, synthetic construct
  misc_feature 1..333: note = derived and/or modified sequence opt6 from anti-HIV_048-042440_VR-Chain
  source 1..333: mol_type = other RNA
caatcagtactaacacaaccaccatcagcatcaggaacaccaggacaaagagtaacaatatcatgctcaggatcatcatcaaatataggaacaaacacagtaaactggtaccaacaactaccaggaacagcaccaaaactattaatatacgaaaactcaaaaagaccatcaggaataccagacagattctcaggatcaaaatcaggaacatcagcaacattaggaataacaggactacaaacaggagacgaagcagactactactgcggaacatgggacacatcactatcagcaggaggagtattcggatcaggaacaaaagtaacagtacta

SEQ ID NO: 48600 - RNA, 333 nt, synthetic construct
  misc_feature 1..333: note = derived and/or modified sequence opt6 from anti-HIV_048-040511_VR-Chain
  source 1..333: mol_type = other RNA
caatcagtattaacacaaccaccatcagtatcagcagcaccaggacaaaaagtaacaatatcatgctcaggatcatcatcaaacataggaaacaactacgtatcatggtaccaacacttaccaggaacagcaccaaaactactaatatacgaaaacaacaaaagatcatcaggaataccagaaagattcagcggatcacaatcaggaacatcagcaacattaggaataacaggactacaaacaggagacgaagcagactactactgcggaacatgggacacatcactaagcacaggaggagtattcggaacaggaacaaaagtaacagtacta

SEQ ID NO: 48601 - RNA, 333 nt, synthetic construct
  misc_feature 1..333: note = derived and/or modified sequence opt6 from anti-HIV_048-039195_VR-Chain
  source 1..333: mol_type = other RNA
caatcagtactaacacaaccaccatcagtatcagcagcaccaggacaaagagtaacaatatcatgctcaggatcaacaagcaacataggaaaccactacgtatcatggtaccaacaactaccaggaacagcaccaaaactactaatatacgacaacggaaacagaccatcaggaataccagacagattctcaggatcaaaatcaggaacatcagcaacactagacataacaggactacaaacaggagacgaagcagactactactgcggaacatgggacacatcactaaacagaggaggagtattcggaacaggaacaaaagtaacagtacta

SEQ ID NO: 48602 - RNA, 333 nt, synthetic construct
  misc_feature 1..333: note = derived and/or modified sequence opt6 from anti-HIV_048-036935_VR-Chain
  source 1..333: mol_type = other RNA
caatcagtattaacacaaccaccaagcatgagcgcagcaccaggagaaagagtaacaataagctgtacaggaagctcaagtaatataggaggatatgacgtacactggtaccaacaattaccaggaatagcaccaaaaatattaatatatagaaatagcataagaccaagcggaataccagacagattctcaggatcaaaatcaggaacaagtgcaacattaggaataacaggactacaaacaggagacgaagcagattactattgcggaacatgggacacaagcctaagcacaggaggagtatttggaacaggaacaaaagtaacagtacta

SEQ ID NO: 48603 - RNA, 333 nt, synthetic construct
  misc_feature 1..333: note = derived and/or modified sequence opt6 from anti-HIV_048-034478_VR-Chain
  source 1..333: mol_type = other RNA
caatcagtattaacacaaccaccaagcgtaagcgcagcaccaggacaaaaagtaacaataagctgtacaggaagcggaagcaatataggaaacaatgacgtaagctggtaccaacaattaccaggaacagcaccaagactattaatatatggagataacaaaagaccaagcggaataccagacagattcagtggatcaaaatcaggaacaagcgcaacattaggaataacaggactacaaacaggagacgaagcagattactattgcggaacatgggacacaagtttaagcgcaggaggagtatttggaacaggaacaaaagtaacagtacta

SEQ ID NO: 48604 - RNA, 333 nt, synthetic construct
  misc_feature 1..333: note = derived and/or modified sequence opt6 from anti-HIV_048-031641_VR-Chain
  source 1..333: mol_type = other RNA
caatcagtattaacacaaccaccaagtgtaagcgcagcaccaggacaaaaagtaacaataagctgtagcggaaacaatagcaatataggaaacaattacgtaagctggtaccaacaattaccaggaacagcaccaaaactattaatatatgaaaatagcaaaagaccaagcggaataccagacagattctcaggatcaaaatcaggaacaagcgcaacattaggaataacaggactacaaacaggagacgaagcagattactattgcggaacatgggacacatcattaagcgcaggaggagtatttggaagcggaacaaaagtaacagtacta

SEQ ID NO: 48605 - RNA, 333 nt, synthetic construct
  misc_feature 1..333: note = derived and/or modified sequence opt6 from anti-HIV_048-029760_VR-Chain
  source 1..333: mol_type = other RNA
caatcagcattaacacaaccagcaagcgtaagcggaagctcaggacaaagcataacaataagctgtacaggaacaaatagcgatgtaggatacgattacgtatgctggtaccaacaattaccaggaacagcaccaaaactattaatatatgaaaataacaaaagaccaagcggaataccagacagattctcaggatcaaaatcaggaacaagcgcaacattaggaataacaggactacaaacaggagacgaagcagattactattgcggaacatgggacacaagtttaagcgcaggaggagtatttggaacaggaacaaaagtaacagtacta

SEQ ID NO: 48606 - RNA, 333 nt, synthetic construct
  misc_feature 1..333: note = derived and/or modified sequence opt6 from anti-HIV_048-027970_VR-Chain
  source 1..333: mol_type = other RNA
caaagcgtattaacacaaccaccaagcgtaagcgcaccaccaggacaaaaagtaacaataagctgtagcggaacaacaagcaatataggaagcaattacgtagcatggtaccaacaatttccaggaacagcaccaaaactattaatatatgaaaataacaaaagaccaagcggaataccagacagattctcaggatcaaaatcaggaacaagcgcaacattaggaataacaggactacaaacaggagacgaagcagattactattgcgcaacatgggacacatcattaagcgcaggaggagtatttggaacaggaacaaaagtaacagtacta

SEQ ID NO: 48607 - RNA, 333 nt, synthetic construct
  misc_feature 1..333: note = derived and/or modified sequence opt6 from anti-HIV_048-027337_VR-Chain
  source 1..333: mol_type = other RNA
caatcagtactaacacaaccaccaagcgtatcagcagcaccaggacaaaaagtaacaatatcatgctcaggatcatactcaaacataggaaacaactacctatcatggtaccaacaactaccaggaacagcaccaaaactactaatatacaaaaacaacaaaagaccatcaggagtaccagacagattctcaggaagcaaatcaggagcatcagcaacactagacataacaggactacaaacaggagacgaagcagactactactgcggaatatgggacacatcactatcagcaggaggagtattcggaacaggaacaaaagtaacagtacta

SEQ ID NO: 48608 - RNA, 333 nt, synthetic construct
  misc_feature 1..333: note = derived and/or modified sequence opt6 from anti-HIV_048-027217_VR-Chain
  source 1..333: mol_type = other RNA
caatcagtactaacacaaccaccatcagtatcagcagcaccaggacaaaaagtaacaatatcatgctcaggaagctcatcaataataggaaacaactacgtatcatggtaccaacaactaccaggaacagcaccaaaattactaatatacgaaaacaacaaaagaccatcaggaataccagacagattctcaggatcaaaatcaggaacatcagcaacactagcaatagcaggattacaaacaggagacgaagcagactactactgcgcaacatgggacacatcactatcagcaggaggagtattcggaacaggaacaaaagtaacagtacta

SEQ ID NO: 48609 - RNA, 333 nt, synthetic construct
  misc_feature 1..333: note = derived and/or modified sequence opt6 from anti-HIV_048-026760_VR-Chain
  source 1..333: mol_type = other RNA
caatcagtactaacacaaccaccatcagtatcagcagccccaggacaaaaagtaacaatatcatgctcaggatcatcatcaaacataggaaacaactacgtatcatggtaccaacacctaccaggaacagcaccaaaactactaatatacgacacagtaaaaagacactcaggagtaccagacagattctcaggatcaaaatcaggaacatcagcaacactaggaatatcaggactacaaacaggagacgaagcagactactactgcggaacatgggacacatcactatcagcaggaggagtattcggatcaggaacaaaagtaacagtatta

SEQ ID NO: 48610 - RNA, 333 nt, synthetic construct
  misc_feature 1..333: note = derived and/or modified sequence opt6 from anti-HIV_048-024800_VR-Chain
  source 1..333: mol_type = other RNA
caaagcgtattaacacaaccaccaagtgtaagcgcagcaccaggacaaaaagtaacaataagctgtagcggaagctatagcaatataggaaacaattacgtaagctggtaccaagtattaccaggaacagcaccaaaactattaatatataaaaataacgaaagaccaagcggaataccagacagattctcaggatcaaaatcaggaacaagcgcaacattaggaataacaggactacaaacaggagacgaagcagattactattgcggaacatgggacacatcattaagcgcaggaggagtatttggaacaggaacaaaagtaacagtacta

SEQ ID NO: 48611 - RNA, 333 nt, synthetic construct
  misc_feature 1..333: note = derived and/or modified sequence opt6 from anti-HIV_048-024313_VR-Chain
  source 1..333: mol_type = other RNA
caatcagtactaacacaaccaccatcagtatcagcagcaccaggacaaaaagtaacaatatcatgcagcggatcatcatcaacaataggaaactcacacgtatcatggtaccaaatactaccaggaacagcaccaaaactattaatatacaaagacgacaaaagaccatcaggaataccagacagattctcaggatcaaaatcaggaacatcagcaacactaggaataaccggactacaaacaggagacgaagcagactactactgcggaacatgggacacatcattaaacagaggaggagtattcggaacaggaacaaaagtaacagtacta

SEQ ID NO: 48612 - RNA, 333 nt, synthetic construct
  misc_feature 1..333: note = derived and/or modified sequence opt6 from anti-HIV_048-021748_VR-Chain
  source 1..333: mol_type = other RNA
caatcagtattaacacaaccaccaagcgtaagcgcagcaccaggacaaagagtaacaataagctgtagcggaagcacaagcaatataggaaacaattacgtaagctggtaccaacaattaccaggaacagcaccaaaactattaatatatgaaaataacaaaagaccaagcggaataccagacagattctcaggatcaaaatcaggaacaagcgcaacattaggaataagcggactacaaacaggagacgaagcagattactattgcggaacatgggacagctcattaagcggaggaggagtatttggaacaggaacaaaagtaacagtacta

SEQ ID NO: 48613 - RNA, 333 nt, synthetic construct
  misc_feature 1..333: note = derived and/or modified sequence opt6 from anti-HIV_048-020991_VR-Chain
  source 1..333: mol_type = other RNA
caatcagtactaacacaaccaccatcagcatcaggaacaccaggacaaaaagtaacaatatcatgctcaggatcatcatcaacaataggaaacaactacgtatcatggtaccaagtattaccaggaacagcaccaaaactactaatatacaaaaacgacaaaagaccatcaggaataccagacagattctcaggatcaaaatcaggaacatcagcaacactaggaataacaggactacaaacaggagacgaagcagactactactgcggaacatgggacacatcactatcaacaggaggagtattcggaacaggaacaaaagtaacagtacta

SEQ ID NO: 48614 - RNA, 333 nt, synthetic construct
  misc_feature 1..333: note = derived and/or modified sequence opt6 from anti-HIV_048-020340_VR-Chain
  source 1..333: mol_type = other RNA
caaagcgtattaacacaaccaccaagcgtaagcgcagcaccaggacaaagagtaacaataagctgtagcggaagctcaagcaatgtaggaaacaattatgtaagctggtaccaacaattaccaggaacagcaccaaaactattaatatatgaaaataacaaaagaccaagcggaataccagacagattctcaggatcaaaatcaggaacaagtgcaacactaggaataacaggactacaaacaggagacgaagcagattactattgcggaacatgggacgcatcattaagcgcaggaggagtatttggaacaggaacaaaagtaacagtacta

SEQ ID NO: 48615 - RNA, 333 nt, synthetic construct
  misc_feature 1..333: note = derived and/or modified sequence opt6 from anti-HIV_048-019993_VR-Chain
  source 1..333: mol_type = other RNA
caaagtgtattaacacaaccaccatcagtatcaggagcaccaggacaaagagtaacaatatcatgtacaggatcatcatcatcaataggaggatttgacgtacactggtaccaaagattaccaggaacagcaccaagactactaatatatgaaaataacaaacgaccatcaggaataccagacagattctcaggaagtaaatcaggaacatcagcaacattaggaataacaggactacaaacaggagacgaagcagattactattgcggaacatgggactcatcattatcagcaggaggagtatttggaacaggaacaaaagtaacagtacta

SEQ ID NO: 48616 - RNA, 333 nt, synthetic construct
  misc_feature 1..333: note = derived and/or modified sequence opt6 from anti-HIV_048-019947_VR-Chain
  source 1..333: mol_type = other RNA
caatcagtactaacacaaccaccatcagtatcagcagcaccaggacaaagagtaacaatatcctgctcaggatcatcatcaaacataggatcaaaatacgtatcatggtaccaacaactaccaggaacagcaccaaaactactaatatacgaaaactcaaaaagaccatcaggaataccagacagattctcaggatcaaaatcaggaacatcagcaacactaggaataacaggactacaaacaggagacgaagcagactactactgcggaacatgggacacatcactatcaacaggaggagtattcggaacaggaacaaaagtaacagtacta

SEQ ID NO: 48617 - RNA, 333 nt, synthetic construct
  misc_feature 1..333: note = derived and/or modified sequence opt6 from anti-HIV_048-017871_VR-Chain
  source 1..333: mol_type = other RNA
caaagcgtattaacacaaccaccaagcgtaagcgcagcaccaggacaaaaagtaacaataagctgtagcggaagctcaagcaatataggaaacagatacgtaagctggtaccaacaattaccaggaacagcaccaaaactattaatatataaaaataacaaaagaccaagcggaataccagacagattctcaggatcaaaatcaggaacaagcgcaacattaggaataacaggactacaaacaggagacgaagcagattactattgcggaacatgggacggatcattaagcacaggaggagtaataggaacaggaacaaaagtaacagtacta

SEQ ID NO: 48618 - RNA, 333 nt, synthetic construct
  misc_feature 1..333: note = derived and/or modified sequence opt6 from anti-HIV_048-015931_VR-Chain
  source 1..333: mol_type = other RNA
caaagcgtactaacacaaccaccaagcgtaagcgcagcaccaggacaaaaagtaacaatatcatgctcaggaggatcatcaaacataggatcaacatacgtatcatggtaccaacaagtaccaggaacagcaccaaaactactaatatacgaaaacaacaaaagaccatcaggaataccagacagattctcaggaagcaaatcaggaacatcagcaacactagacataacaggactacaaacaggagacgaagcagactactactgcggaacatgggacacatcactatcaggaggaggagtattcggaacaggaacaaaagtaacagtacta

SEQ ID NO: 48619 - RNA, 333 nt, synthetic construct
  misc_feature 1..333: note = derived and/or modified sequence opt6 from anti-HIV_048-015920_VR-Chain
  source 1..333: mol_type = other RNA
caaagcctattaacacaaccaccaagtgtaagtgcagcaccaggacaaaaagtaacaataagctgtagcggaagctcaagcacaataggaaacaattacgtaagctggtaccaagtattaccaggaacagcaccaaaactattaatatataaaaataacgaaagaccaagcggaataccagacagattctcaggatcaaaatcaggaacaagcgcaacattaggaataacaggactacaaacaggagacgaagcagaatactattgcgcaacatgggacgcatcattaagcggaggaggagtatttggaacaggaacaaaagtaacagtacta

SEQ ID NO: 48620 - RNA, 333 nt, synthetic construct
  misc_feature 1..333: note = derived and/or modified sequence opt6 from anti-HIV_048-013898_VR-Chain
  source 1..333: mol_type = other RNA
caatcagtactaacacaaccaccatcagtatcagcagcaccaggacaaaaagtaacaatatcatgttcaggatcatcaagtaatataggaaaacactcagtatcatggtaccaacaattaccaggaacagcaccagaactattaatatacgacaataacaatagaccatcaggaataccagacagattctcaggatcaaaatcaggaacatcagcaacactaggaataacaggactacaaacaggagacgaagcagactactactgcggaacatgggacacatcactatcagcaggaggagtattcggaacaggaacaaaagtaacagtacta

SEQ ID NO: 48621 - RNA, 333 nt, synthetic construct
  misc_feature 1..333: note = derived and/or modified sequence opt6 from anti-HIV_048-013429_VR-Chain
  source 1..333: mol_type = other RNA
caatcagtattaacacaaccaccaagcgtaagcgcagcaccaggacaaaaagtaacaataagctgtagcggaagctcaagtaatataggaaacaattacgtaagctggtaccaacaattaccaggaacagcaccaacactattgatatatgaaaatgacaaaagaccaagtggaataccagacagattctcaggatcaaaatcaggaacaagcgcaacattaggaataacaggactacaaacaggagacgaagcagattactattgcggaacatgggactcaagcctaagcgcaggaggagtatttggaacaggaacaaaagtaacagtacta

SEQ ID NO: 48622 - RNA, 333 nt, synthetic construct
  misc_feature 1..333: note = derived and/or modified sequence opt6 from anti-HIV_048-012358_VR-Chain
  source 1..333: mol_type = other RNA
caaagcgtattaacacaaccaccaagcgtaagcgcagcaccaggacaaaaagtaacaataagctgtagcggaagcaattcagcaataggaaacaattacgtaagctggtaccaagtattaccaggaacagcaccaaaactattaatatataaaaataacgaaagaccaagcggaataccagacagattctcaggatcaaaatcaggaacaagtgcaacattagacataacaggactacaaacaggagacgaagcagattactattgcggaacatgggacacatcattaagcgcaggaggagtatttggaacaggaacaaaagtaacagtacta

SEQ ID NO: 48623 - RNA, 333 nt, synthetic construct
  misc_feature 1..333: note = derived and/or modified sequence opt6 from anti-HIV_048-011158_VR-Chain
  source 1..333: mol_type = other RNA
caatcagtactaacacaaccaccatcagtatcagcagcaccaggacaaaaagtaacaatatcatgctcaggaatatcatcaaacataggaaacaacgacgtatcatggtaccaacaactaccaggaacagcaccaaaactactaatatacgacaacgacaaaagaccatcaggaataccagacagattctcaggatcaaaatcaggaacatcagcaacattaggaataacaggactacaaacaggagacgaagcagactactactgcggaacatgggactcatcactatcagcaggaggagtattcggaacaggaacaaaagtaacagtacta

SEQ ID NO: 48624 - RNA, 333 nt, synthetic construct
  misc_feature 1..333: note = derived and/or modified sequence opt6 from anti-HIV_048-010720_VR-Chain
  source 1..333: mol_type = other RNA
caatcagtattaacacaaccaccatcagtatcagcagcaccaggacaaaaagtaacaataagctgttcaggaagttcaagcaatataggatcacattacgtatcatggtaccaacaagtaccaggaacagcaccaagattagtaatatatgaaaattcaaaaagaccatcaggaataccagacagattctcaggatcaaaatcaggaacatcagcaacactaggaataacaggactacaaacaggagacgaagcagattactattgcggaacatgggacacatcactatcagcaggaggagtatttggatcaggaacaaaagtaacagtacta

SEQ ID NO: 48625 - RNA, 333 nt, synthetic construct
  misc_feature 1..333: note = derived and/or modified sequence opt6 from anti-HIV_048-009445_VR-Chain
  source 1..333: mol_type = other RNA
caatcagtactaacacaaccaccatcagtatcagcagcaccaggacaaaaagtaacaatatcatgctcaggatcatcatcaaacataggaaacaactacgtaagctggtaccaacaactaccaggaacagtaccaaaactactaatatacgacacatacacaagaccatcaggaacaccagacagattctcaggatcaaaatcaggaacatcagcaacactagcaataacaggactacaaacaggagacgaagcagactactactgcggaacatgggacggatcattatcaacaggaggagtaataggaacaggaacaaaagtaacagtacta

SEQ ID NO: 48626 - RNA, 324 nt, synthetic construct
  misc_feature 1..324: note = derived and/or modified sequence opt6 from anti-HIV_048-006126_VR-Chain
  source 1..324: mol_type = other RNA
caaagcgtattaacacaaccaccaagcgtatcaggagcaccaggacaaaaagtaacaatatcatgctcaggaataagctcaaactttggaataagctggtaccaacaagtaccaggaacagcaccaaaactattaatatatgaaaatgacaaaagaccaagcggaataccagacagattctcaggatcaaaatcaggaacaagcgcaacattaggaataacaggactacaaacaggagacgaagcagattactattgcggaacatgggacacatcattaagcgcaggaggagtatttggaacaggaacaaaagtaacagtacta

SEQ ID NO: 48627 - RNA, 333 nt, synthetic construct
  misc_feature 1..333: note = derived and/or modified sequence opt6 from anti-HIV_048-005652_VR-Chain
  source 1..333: mol_type = other RNA
caaagcgtattaacacaaccaccaagcgtaagcgcagcaccaggacaaaaagtaacaataagctgtagcggaagcaatagcgcaataggaaacaattacgtaagctggtaccaagtattaccaggaacagcaccaaaactattaatatatgacacatacaaaagagcaagcggaataccagacagattctcaggatcaaaatcaggaacaagcgcaacattaggaataacaggactacaaacaggagacgaagcagattactattgcggaacatgggacacatcgttaagcggaggaggagtatttggaacaggaacaaaagtaacagtacta

SEQ ID NO: 48628 - RNA, 333 nt, synthetic construct
  misc_feature 1..333: note = derived and/or modified sequence opt6 from anti-HIV_048-005532_VR-Chain
  source 1..333: mol_type = other RNA
caatcagtactaacacaaccaccatcagtatcagcagcaccaggacaaaaagtaacaatatcatgctcaggaacatcatcaaacataggaaacacatacgtatcatggtaccaacaactaccaggaacagcaccaaactacctaatatacaaaatagacaaaagaccatcaggaataccagacagattctcaggatcaaaatcaggaacatcagcaacactaggaataacaggactacaaacaggagacgaagcagactactactgcggaacatgggacacatcactatcagcaggaggagtattcggaacaggaacaaaagtaacagtacta

SEQ ID NO: 48629 - RNA, 333 nt, synthetic construct
  misc_feature 1..333: note = derived and/or modified sequence opt6 from anti-HIV_048-005189_VR-Chain
  source 1..333: mol_type = other RNA
caatcagtattaacacaaccaccaagcgtaagcgcagcaccaggacaaaaagtaacaataagctgtagtggaagcggaagcacaataggaaacaatgacgtaagctggtaccaacaactaccaggagcagcaccaaaactattaatatatgaagataacaaaagaccaagcggaataccagcaagattctcaggatcaaaatcaggaacaagcgcaacattaagaataacaggactacaaacaggagacgaagcagattactattgcggaacatgggacagctcattaagcgcaggaggagtatttggaacaggaacaagagtaagcgtacta

SEQ ID NO: 48630 - RNA, 333 nt, synthetic construct
  misc_feature 1..333: note = derived and/or modified sequence opt6 from anti-HIV_048-005088_VR-Chain
  source 1..333: mol_type = other RNA
caatcagtactaacacaaccaccatcagtatcagcagcaccaggacaaaaagtaacaatatcatgctcaggatcatcatcaaacataggaaaaaactacgtatcatggtaccaacaactaccaggaacagcaccaaaactactaatatacgataacaacaacagaccatcaggaataccagacagattctcaggatcaaaatcaggaacatcagcaacactaggaataacaggactacaaacaggagacgaagcagactactactgcggagcatgggacacatcattatcagcaggaggagtcttcggaacaggaacaaaagtaacagtacta

SEQ ID NO: 48631 - RNA, 333 nt, synthetic construct
  misc_feature 1..333: note = derived and/or modified sequence opt6 from anti-HIV_048-004023_VR-Chain
  source 1..333: mol_type = other RNA
caatcagtactaacacaaccaccatcagtatcagcaacaccaggacaaaaagtaacaatatcatgctcaggaggatcatcaaacataggaaaaaacgacgtatcatggtaccaacaactaccaggaacagcaccaaaactactaatatacgacacaaacaaaagaccatcaggaataccagacagattctcagcagcaagatcaggaacatcagcaacactagacataacaggattacaaacaggagacgaagcagactactactgcggaacatgggacacatcactatcagcaggaggagtattcggaacaggaacaaaagtaacagtacta

SEQ ID NO: 48632 - RNA, 333 nt, synthetic construct
  misc_feature 1..333: note = derived and/or modified sequence opt6 from anti-HIV_048-001580_VR-Chain
  source 1..333: mol_type = other RNA
caatcagtactaacacaaccaccatcagtatcagcagcaccaggacaaaaagtaacaatatcatgctcaggaagctcatcaaacataggaaacaactacgtatcatggtaccaacaactaccaggaacagcaccaaaactactactatacgaaaacaacaaaagaccatcaggaataccagacagattctcaggatcaaaatcaggaacatcagcaacactagcaataacaggactacaaacaggagacgaagcagcatactactgcggaacatgggacggatcactatcaacaggaggagtaataggaacaggaacaaaagtaacagtacta

SEQ ID NO: 48633 - RNA, 333 nt, synthetic construct
  misc_feature 1..333: note = derived and/or modified sequence opt6 from anti-HIV_038-221120_VR-Chain
  source 1..333: mol_type = other RNA
caatcagtattaacacaaccaccaagcgtaagcgcagcaccaggacaaaaagtaacaataagctgtagcggaagcacaagtaatataggaaaaaattacgtaagctggtaccaacaactaccaggaacagcaccaaaactattaatatatgacaataacgaaagaccaagcggaataccagacagattctcaggatcaaaatcaggaacaagcgcaacattaggaataacaggactacaaacaggagacgaagcagattactattgcgcaacatgggactcaagcctaagcggaggaggagtatttggaacaggaacaagagtaacagtacta

SEQ ID NO: 48634 - RNA, 333 nt, synthetic construct
  misc_feature 1..333: note = derived and/or modified sequence opt6 from anti-HIV_038-197677_VR-Chain
  source 1..333: mol_type = other RNA
caatcagtattaacacaaccaccatcagtatcagcagcaccaggacaaaaagtaacagtatcatgctcaggatcaaactcaaacataggaaaccactacgtatcatggtaccaacaactaccaggaacagcaccaaaactactaatatacgacaacaacaaaagaccatcaggaataccagacagattctcaggatcaaaatcaggaacatcagcaacactaggaataacaggactacaaacaggagacgaagcagactactactgcggaacatgggactcatcactatcagcaggaggagtattcggaacaggaacaaaagtaacagtacta

SEQ ID NO: 48635 - RNA, 333 nt, synthetic construct
  misc_feature 1..333: note = derived and/or modified sequence opt6 from anti-HIV_038-196765_VR-Chain
  source 1..333: mol_type = other RNA
caatcagcattaacacaaccagcatcagtatcaggatcaccaggacaatcaataacaatatcatgtacaggaacaagcggagacgtaggatacaacctagtatcatggtaccaacaactaccaggaacagcaccaaaagtactaatatacgaaaataacaaaagaccatcaggaataccagacagattctcaggatcaaaatcaggaacatcagcaacactaggaataacaggactacaaacaggagacgaagcagactactactgcggaacatgggactcatcactatcagcaggaggagtattcggaacaggaacaaaagtaacagtacta

SEQ ID NO: 48636 - RNA, 333 nt, synthetic construct
  misc_feature 1..333: note = derived and/or modified sequence opt6 from anti-HIV_038-186200_VR-Chain
  source 1..333: mol_type = other RNA
caatcagtattaacacaaccaccaagcgcaagcggaacaccaggacaaagaataacaataagctgtagcggaacatcaagcaatataggaagcaatatagtaagctggtaccaacacttaccaggaacaacaccaaaattagtaatatttagaaataaccaaagaccaagcggaataccagacagattctcaggatcaaaatcaggaacaagcgcaacactaggaataacaggactacaaacaggagacgaagcagattactattgcggaacatgggactcaagtttaagcgcaggaggagtatttggaacaggaacaaaagtaacagtacta

SEQ ID NO: 48637 - RNA, 333 nt, synthetic construct
  misc_feature 1..333: note = derived and/or modified sequence opt6 from anti-HIV_038-126170_VR-Chain
  source 1..333: mol_type = other RNA
caatcagtactaacacaaccaccatcagtatcagcaccaccaggacaaaaagtaacaatatcatgctcaggaacaacatcaaacataggatcaaactacgtagcatggtaccaacaactaccaggaacagcaccaaaactattaatatacgacaacgtaaaaagaccaacaaacataccagacagattcagcggatcaaaatcaggaacatcagcaacactaggaataacaggactacaaacaggagacgaagcagactactactgcggaacatgggactcatcactatcagcaggaggagtattcggaacaggaacaaaagtaacagtacta

SEQ ID NO: 48638 - RNA, 333 nt, synthetic construct
  misc_feature 1..333: note = derived and/or modified sequence opt6 from anti-HIV_038-108545_VR-Chain
  source 1..333: mol_type = other RNA
caatcagtattaacacaaccaccaagcgcaagcggaacaccaggacaaagagtaacaataagctgtagcggaagctcaagcaatataggatacaatacagtaagctggtaccaacaattaccaggaacagcaccaaaactattaatatatgaaaataacaaaagaccaagcggaataccagacagattctcaggatcaaaatcaggaacaagcgcaacattaggaataacaggactacaaacaggagacgaagcagattactattgcggaacatgggacagctcattaagcgcaggaggagtatttggaacaggaacaaaagtaacagtacta

SEQ ID NO: 48639 - RNA, 333 nt, synthetic construct
  misc_feature 1..333: note = derived and/or modified sequence opt6 from anti-HIV_038-107263_VR-Chain
  source 1..333: mol_type = other RNA
caatcagtattaacacaaccaccatcagcaagcggaacaccaggacaaagagtaacaataagctgtagtggaagctcaagcaatataggaagcaatacagtaaactggtaccaacaagtaccaggaacagcaccaaatctattaatatatagcaatgaccaaagaccaagcggaataccagacagattctcaggatcaaaatcaggaacaagcgcaacattaggaataacaggactacaaacaggagacgaagcagattactattgcggaacatgggacagctcattaagcgcaggaggagtatttggaacaggaacaaaagtaacagtacta

SEQ ID NO: 48640 - RNA, 333 nt, synthetic construct
  misc_feature 1..333: note = derived and/or modified sequence opt6 from anti-HIV_038-104530_VR-Chain
  source 1..333: mol_type = other RNA
caatcagtactaacacaaccaccatcagtatcagcagcaccaggacaaaaagtaacaatatcatgctcaggatcatcaagcaacatcggatcaaactacgtatcatggtaccaacacctaccaggaaaagcaccaaaactactaatatacgacaacaacaaaagaccatcaggaataccagacagattctcaggatcaaaatcaggaacatcagcaacactaggaataacaggactacaaacaggagacgaagcagactactactgcggaacatgggactcatcactatcagcaggaggagtattcggaacaggaacaaaagtaacagtacta

SEQ ID NO: 48641 - RNA, 333 nt, synthetic construct
  misc_feature 1..333: note = derived and/or modified sequence opt6 from anti-HIV_038-099169_VR-Chain
  source 1..333: mol_type = other RNA
caatcagtattaacacaaccaccaagcgcaagcggaacaccaggacaaagagtaagcataagctgtagcggaataacaagctcactaggaagcaatcacatgagctggtaccaacaattaccaggaacagcaccaaaactattaatatatgaaaataacaaaagaccaagcggaataccagacagattctcaggatcaaaatcaggaacaagcgcaacattaggaataacaggactacaaacaggagacgaagcagattactattgcggaacatgggacagctcattaagcgcaggaggagtatttggaacaggaacaaaagtaacagtacta

SEQ ID NO: 48642 - RNA, 333 nt, synthetic construct
  misc_feature 1..333: note = derived and/or modified sequence opt6 from anti-HIV_038-075067_VR-Chain
  source 1..333: mol_type = other RNA
caatcagtattaacacaaccaccaagcgtaagcggagcaccaggacaaagagtaacaataagctgtagcggaagctcaagcacaataggaaacaattacgtaagctggtaccaactattaccaggaacagcaccaaaactattaatatataaaaataacaaaagaccaagcggaataccagacagattctcaggatcaaaatcaggaacaagcgcaacattaggaataacaggactacaaacaggagacgaagcagattactattgcggaacatgggacacaagcctatcagcaggaggagtatttggaacaggaacaaaagtaacagtatta

SEQ ID NO: 48643 - RNA, 333 nt, synthetic construct
  misc_feature 1..333: note = derived and/or modified sequence opt6 from anti-HIV_038-072368_VR-Chain
  source 1..333: mol_type = other RNA
caatcagtattaacacaaagcccaagcgcaagcggaacaccaggacaaagagtaacaataagctgtagcggaagttcaagcaatataggaaacaattacgtaagttggtaccaacaattaccaggaacagcaccaaaactactaatatatgaaaataacaaaagaccaagcggaataccagacagattctcaggatcaaaatcaggaacaagtgcaacattaggaataacaggactacaaacaggagacgaagcagattactattgcggaacatgggactcaagcctaagcgcaggaggagtatttggaacaggaacaaaagtaacagtacta

SEQ ID NO: 48644 - RNA, 333 nt, synthetic construct
  misc_feature 1..333: note = derived and/or modified sequence opt6 from anti-HIV_038-068503_VR-Chain
  source 1..333: mol_type = other RNA
caatcagtactaacacaaccaccatcagtatcagcagcaccaggacaaatggtaacaatatcatgctcaggatcaagatcaaacatagaaaaccactacgtatcatggtaccaacacctaccaggagcagcaccaaaactactaatatacgacaacggaaaaagaccatcaggaataccagacagattctcaggaagcaaatcaggaacatcagcaacactaggaataacaggactacaaacaggagacgaagcagactactactgcggaacatgggactcatcactatcagcaggaggagtattcggaacaggaacaaaagtaacagtacta

SEQ ID NO: 48645 - RNA, 333 nt, synthetic construct
  misc_feature 1..333: note = derived and/or modified sequence opt6 from anti-HIV_038-068016_VR-Chain
  source 1..333: mol_type = other RNA
caatcagtattaacacaaccaccaagcgcaagcggaacaccaggacaaagagtaacaataagctgtagcggaagctcaagcaatatagaaagtaatttcgtatactggtaccaacaatttccaggaacaacaccaaaactattaatatatagagatggacaaagaccaagcggaataccagacagattctcaggatcaaaatcaggaacaagcgcaacattaggaataacaggactacaaacaggagacgaagcagattactattgcggaacatgggacagctcattaagcgcaggaggagtatttggaacaggaacaaaagtaacagtacta

SEQ ID NO: 48646 - RNA, 333 nt, synthetic construct
  misc_feature 1..333: note = derived and/or modified sequence opt6 from anti-HIV_038-063958_VR-Chain
  source 1..333: mol_type = other RNA
caatcagtattaacacaaccaccatcagtatcaggagcaccaggacaaagagtaacaatatcatgcacaggatcatcatcaaatataggaaactcaggagtacactggtaccaacaattaccaggaacagcaccaaaactattaatatacgaaaacaacaaaagaccatcaggaataccagacagattctcaggatcaaaatcaggaacatcagcaacattaggaataacaggactacaaacaggagacgaagcagattactactgcggaacctgggactcatcattatcagcaggaggagtatttggaacaggaacaaaagtaacagtacta

SEQ ID NO: 48647 - RNA, 333 nt, synthetic construct
  misc_feature 1..333: note = derived and/or modified sequence opt6 from anti-HIV_038-033733_VR-Chain
  source 1..333: mol_type = other RNA
caatcagtactaacacaaccaccatcagcatcaggaacaccaggacaaagagtaacaatatcatgctcaggatcatcatcaaacataggatcaaaatacgtatactggtaccaacaattaccaggaacagcaccaaaactactaatatacgacaacgacaaaagaccatcaggaataccagacagaatatcagcatcaaaatcaggaacatcagcaacactagacataacaagactacaaacaggagacgaagcagactactactgcggaacatgggactcatcactatcagcaggaggagtattcggaacaggaacaaaagtaacagtacta

SEQ ID NO: 48648 - RNA, 333 nt, synthetic construct
  misc_feature 1..333: note = derived and/or modified sequence opt6 from anti-HIV_038-030557_VR-Chain
  source 1..333: mol_type = other RNA
caatcagtactaacacaaccaccatcagtatcagcagcaccaggacaaaaagtaacaatatcatgctcaggatcatcatcaacaataggaaacaactacgtatcatggtaccaactactaccaggaacagcaccaaaactactaatatacaaaaacaacaaaagaccatcaggaataccagacagattctcaggatcaaaatcaggaacatcagcaacactaggaataacaggattacaaacaggagacggagcagactactactgcggaacatgggacacatcattatcagcaggaggagtattcggaacaggaacaatagtaacagtacta

SEQ ID NO: 48649 - RNA, 333 nt, synthetic construct
  misc_feature 1..333: note = derived and/or modified sequence opt6 from anti-HIV_038-024298_VR-Chain
  source 1..333: mol_type = other RNA
caatcagtactaacacaaccaccatcagtatcagcagcaccaggacaaaaagtaacaatatcatgctcaggatcatcatcaaacataggaaactcacacgtatcatggtaccaacaattcccaggaacaggaccaaaactactaatatacgaaaacgcaaaaagaccatcaggaataccagacagaatatcaggaagcaaatcagacacatcagcaacactaggaataacaggactacaaacaggagacgaagcagactactactgcggaacatgggactcatcactatcagcaggaggagtattcggaacaggaacaaaagtaacagtacta

SEQ ID NO: 48650 - RNA, 333 nt, synthetic construct
  misc_feature 1..333: note = derived and/or modified sequence opt6 from anti-HIV_038-011154_VR-Chain
  source 1..333: mol_type = other RNA
caatcagtattaacacaaccaccatcagtaagcgcagcaccaggacaaagaataacaatatcatgctcaggatcatcatcaaatataggaaacaactacgtatcatggtaccaacaactaccaggaacagcaccaaaactcctaatatacaaaaacaacaaaagaccatcaggaataccagacagattctcaggatcaaaatcaggaacatcagcaacattaggaataacaggactacaaacaggagacgaagcagactactactgcggaacatgggacacatcactatcagcaggaggagtattcggaacaggaacaaaagtaacagtacta

SEQ ID NO: 48651 - RNA, 318 nt, synthetic construct
  misc_feature 1..318: note = derived and/or modified sequence opt6 from anti-HIV-1_LightChain
  source 1..318: mol_type = other RNA
gaaatagtactaacacaatcaccaggaacattaagcttaagcccaggagaaagagcaacattaagctgtagagcaagccaaagcgtaagtaataactttctagcatggtatcaatataaaccaggacaaccaccaagagtactaatatacggaacatcaagaagagcatcaggaataccagatagatttagcggaagcggaagcggaacagatggatcactaacaatatcaagattagaagcagaagatttcgcagtatattactgtcaacaatacgaattctttggacaaggaacaagattagaaatgaaaagaaca

SEQ ID NO: 48652 - RNA, 318 nt, synthetic construct
  misc_feature 1..318: note = derived and/or modified sequence opt6 from anti-HIV-1_LightChain
  source 1..318: mol_type = other RNA
gaagtagtactaacacaatcaccaggaacattaagtttaagcccaggagaaagagcaacattaagctgtagagcaagccaaagtgtaagcagaaactatctagcatggtatcaacaaaaattaggacatggaccaagattactagtatacgcaacatcaagaagagcaacaggaataccagatagatttataggaagccaaagcggaacagaatacaatctaacaataacaagattagacccaggagatttcgcacaatatttctgtcaacaatacgaattctttggaccaggaacaagattagacataaaaagaaca

SEQ ID NO: 48653 - RNA, 309 nt, synthetic construct
  misc_feature 1..309: note = derived and/or modified sequence opt6 from anti-HIV-1_LightChain
  source 1..309: mol_type = other RNA
gaagtagtactaacacaatcaccaggaacactatcactatcaccaggagaaagagcatcattctcatgcaaatcatcacaatacggacacacagcatggtaccaacaaaaactaggacacggaccaagactactaatatacgcaacatcaagaagagcaacaggaataccagaccgattcataggatcacaatcaggaacagaatacaacctaacaataacaagactagacccaggagacttcgcacactacttctgccaacaaaacgaattcttcggaccaggaacaagactagacatgaaaagaaca

SEQ ID NO: 48654 - RNA, 306 nt, synthetic construct
  misc_feature 1..306: note = derived and/or modified sequence opt6 from anti-HIV-1_LightChain
  source 1..306: mol_type = other RNA
gaaatagtactaacacaatcaccaagcagcttatcattaagtccaggagaaagagcatcattaagctgtagaggaagccatggacatgtagcatggtatcaacataaaccaggacaaataccaagattactaatatacgcaacaagcaaaagagcatcaggaataagcgatagatttagcggaagtggaagcggaacagatgcaacactatcaatatcaagattagaaccagaagatttcgcagtatatttctgtcaacaatacgaatttttcggacaaggaacaagattagaaataaaaagaaca

SEQ ID NO: 48655 - RNA, 306 nt, synthetic construct
  misc_feature 1..306: note = derived and/or modified sequence opt6 from anti-HIV-1_LightChain
  source 1..306: mol_type = other RNA
gaaataatgctaacacaatcaccaggaacattatcattaagcccaggagaaagagcaacattaagctgtagaggaagccatggacatgtagcatggtatcaacaaaaaccaggaagaataccaagattactaatatacggaacaagcaaaagagcatcaggaataccagatagatttagcggaagcggaagcggaacagatgcaacactaacaatatcaagattagaatcagaagatttcgcagtatatttctgtcaacaatacgaatttttcggacaaggaacaagattagacataaacagaaca

SEQ ID NO: 48656 - RNA, 309 nt, synthetic construct
  misc_feature 1..309: note = derived and/or modified sequence opt6 from anti-HIV-1_LightChain
  source 1..309: mol_type = other RNA
gaatcagtactaacacaatcaccaggaacactatcactatcaccaggagaaacagcatcactatcatgcacagcagcactatacggacacatgacatggtaccaaaaaaaaccaggacaaccaccaaaactactactatacgcatcatcaaaaagagcatcaggaataccagacagattctcaggatcacaattcggaaaacaatacacactaataataacaaaaatggaaccagaagacttcgcagaatactactgccaacaattcgaagtattcggacaaggaacaagactagacatgagaagaaca

SEQ ID NO: 48657 - RNA, 306 nt, synthetic construct
  misc_feature 1..306: note = derived and/or modified sequence opt6 from anti-HIV-1_LightChain
  source 1..306: mol_type = other RNA
gaagtagtactaacacaatcaccaggaacattaagcttaagcccaggagaaagagcaacattaagctgtagaggaagccatggacatctatcatggtatcaatataaaccaggacaaccaccaagagtactaatatacggaacatcaagaagagcatcaggaataccagatagatttagcggaagcggaagcggaacagatggatcactaacaatatcaagattagaagcagaagatttcgcagtatattactgtcaacaatacgaattctttggacaaggaacaagattagaaatgaaaagaaca

SEQ ID NO: 48658 - RNA, 309 nt, synthetic construct
  misc_feature 1..309: note = derived and/or modified sequence opt6 from anti-HIV-1_LightChain
  source 1..309: mol_type = other RNA
gaagtagtactaacacaatcaccaggaacactatcactatcaccaggagaaagagcatcactatcatgcaaatcatcacaatacggacacacagcatggtaccaacaaaaactaggacaaggaccaagactactaatatacgcaacatcaagaagagcaacaggaataccagacagattctcaggatcacaatcaggaacagaatacaacttaacaataacaagactagacccaggagacttcgcacaatacttctgccaacaatacgaattcttcggaccaggaacaagactagacataaaaagaaca

SEQ ID NO: 48659 - RNA, 306 nt, synthetic construct
  misc_feature 1..306: note = derived and/or modified sequence opt6 from anti-HIV-1_LightChain
  source 1..306: mol_type = other RNA
gaaataatgctaacacaatcaccaggaacattaagtttaagcccaggagaacgagcaacattaagctgtagaggaagccatggacatgtagcatggtatcaacaaaaaccaggaagaataccaagattactaatatacggaacatcaaaaagagcatcaggaataccagatagatttagcggaagtggaagcggaacagatgcaacactaacaataagtagattagaatcagaagatttcgcagtatattactgtcaacaatacgaatttttcggacaaggaacaagactagacataaaaagaaca

SEQ ID NO: 48660 - RNA, 309 nt, synthetic construct
  misc_feature 1..309: note = derived and/or modified sequence opt6 from anti-HIV-1_LightChain
  source 1..309: mol_type = other RNA
gaatcagtactaacacaaagcccaggaacactatcactatcaccaggagaaacagcatcactatcatgcacagcagcatcatacggacacatgacatggtaccaaaaaaaaccaggacaaccaccaaaactactaatattcgcaacatcaaaaagagcatcaggaataccagacagattctcaggatcacaattcggaaaacaatacacactaacaataacaagaatggaaccagaagacttcgccggatactactgccaacaagtagaattcttcggacaaggaacaagactagaaataagaagaaca

SEQ ID NO: 48661 - RNA, 309 nt, synthetic construct
  misc_feature 1..309: note = derived and/or modified sequence opt6 from anti-HIV-1_LightChain
  source 1..309: mol_type = other RNA
gacatacaaatgacacaatcaccatcatcactatcagcatcagtaggagacagagtaacaataacatgccaagcatcacaagacatatcaaactacctaaactggtaccaacaaaaaccaggaaaagcaccaaaactactaatatacgacgcatcaaacctagaaacaggagtaccatcaagattctcaggatcaggattccacacaacattctcactaacaatatcaggactacaaagagacgacttcgcaacatacttctgcgcagtactagaattcttcggaccaggaacaaaagtagacttcaac

SEQ ID NO: 48662 - RNA, 309 nt, synthetic construct
  misc_feature 1..309: note = derived and/or modified sequence opt6 from anti-HIV-1_LightChain
  source 1..309: mol_type = other RNA
gacatacaaatgacacaatcaccatcatcactatcagcatcagtaggagacagagtaacaataacatgccaagcatcacaagacataacaaactacctaaactggtaccaacaaaaaccaggaagagcaccaaaactactagtacacggagcatcaaacctacaaagaggagtaccatcaagattctcaggatcaggattccacacaacattcacactaacaatatcatcactacaaccagacgacgtagcaacatacttctgcgaagtattccaatggttcggaccaggaacaagagtagacttcaac

SEQ ID NO: 48663 - RNA, 309 nt, synthetic construct
  misc_feature 1..309: note = derived and/or modified sequence opt6 from anti-HIV-1_LightChain
  source 1..309: mol_type = other RNA
ggattccaactaacacaatcaccatcatcattatcagcatcagtaggagacagagtatcaataaactgtcaagcaggagaaggaataggatcatcattaaactggtaccaacaaaaaccaggaagagcaccaaaactattagtacacggagcatcaaatctacaaagaggagtaccatcaagattctcaggatcaggatttcacacaacatttacattaacaatatcatcactacaaccagatgacgtagcaacatacttttgcgaagtatttcaatggttcggaccaggaacaagagtagacttcaat

SEQ ID NO: 48664 - RNA, 309 nt, synthetic construct
  misc_feature 1..309: note = derived and/or modified sequence opt6 from anti-HIV-1_LightChain
  source 1..309: mol_type = other RNA
ggaatacaactaacacaatcaccatcatcactatcagtatcagtaggagacagagtaacaataacatgcagagcatcacaaggaataggaaactcactaaactggtaccaacaaaaaccaggaaaagcaccaaacctaatggtattcggaacaacaaaactaaacagaggagtaccatcaagattctcaggatcaggatcaggaacaacagcaacactaacaataaactcactacaaccagaagacatagcaacatacttctgccaagtattcgaattcctaggaccaggaacaaaactagacatgaaa

SEQ ID NO: 48665 - RNA, 309 nt, synthetic construct
  misc_feature 1..309: note = derived and/or modified sequence opt6 from anti-HIV-1_LightChain
  source 1..309: mol_type = other RNA
gacatacaaatgacacaatcaccatcatcattatcagcatcagtaggagacagagtaacaataacatgtcaagcaggacaaggaataggatcatcattaaaatggtaccaacaaaaaccaggaagagcaccaagactattagtacatggagcatcaaatctacatagaggagtaccatcaagattctcaggatcaggatttcacacaacattttcattaacaatatcaggactacaaagagatgactttgcaacatacttttgcgcagtattagaatttttcggaccaggaacaaaagtagatttcaat

SEQ ID NO: 48666 - RNA, 309 nt, synthetic construct
  misc_feature 1..309: note = derived and/or modified sequence opt6 from anti-HIV-1_LightChain
  source 1..309: mol_type = other RNA
ggaatacaactaacacaatcaccatcatcactatcagcatcagtaggagacagagtaacaataacatgtcaagcatcacaaggaataggatcatcactacaatggtaccaacaaaaaccaggaagagcaccaaacctactagtacacggagcatcaaatctacacagaggagtaccatcaagattctcaggatcaggattccacacaacattctcactaacaatatcaggactacaaagagacgacttcgcaacatacttctgcgcagtactagaattcttcggaccaggaacaaaagtagaaataaaa

SEQ ID NO: 48667 - RNA, 309 nt, synthetic construct
  misc_feature 1..309: note = derived and/or modified sequence opt6 from anti-HIV-1_LightChain
  source 1..309: mol_type = other RNA
ggagtacaactaacacaatcaccatcaagcttaagcgcaagcgtaggagatagagtaagcataaactgtcaagcaggacaaggaataggatcaagcttaaactggtaccaacaaaaaagaggaaaagcaccaaaactattagtacatggagcaagcacactacaaagaggagtaccaagcagattctcaggatcaggatttcacacaacatttacattaacaataagctcactacaaccagatgacgtagcaacatacttttgcgaagtatttcaatggttcggaccaggaacaagagtagatttcaat

SEQ ID NO: 48668 - RNA, 306 nt, synthetic construct
  misc_feature 1..306: note = derived and/or modified sequence opt6 from anti-HIV-1_LightChain
  source 1..306: mol_type = other RNA
tatatacaactaacacaatcaccatcaagcttaagcgcaagcataggagatagagtaacaatagcatgtagagcaagccaaggaataggatatgtacattggtatcaacaaaaaagaggaaaaccaccaaaattactaatacacggagcatcaatattagaaagaggagtaccatcaagatttagcggaagcggaagcggaacactattcaatctaacagtatcaggattacaaccagaagatttcgcaacatatatgtgtcaagtattcgaaagctttggaccaggaacaaaagtacaaatgaaa

SEQ ID NO: 48669 - RNA, 309 nt, synthetic construct
  misc_feature 1..309: note = derived and/or modified sequence opt6 from anti-HIV-1_LightChain
  source 1..309: mol_type = other RNA
ggaatacaactaacacaatcaccatcatcactatcagcatcactaggagacagagtaacaataacatgccaagcatcacaaggaataggatcatcactacaatggtaccaacaaaaaccaggaaaagcaccaaaactactagtacacggagcatcaaaactacacagaggagtaccatcaagattctcaggatcaggattccacacaacattctcactaacaatatcatcactacaaccagaagacttcgcaacatacctatgccaagtactagaattcttcggaccaggaacaaaagtagacttcaac

SEQ ID NO: 48670 - RNA, 309 nt, synthetic construct
  misc_feature 1..309: note = derived and/or modified sequence opt6 from anti-HIV-1_LightChain
  source 1..309: mol_type = other RNA
ggaatacaactaacacaatcaccatcatcactatcagcatcagtaggagacacagtaacaataacatgccaagcctcacaaggaataggatcatccctacaatggtaccaacaaaaaagaggaagagcaccaaaactactagtacacggagcatcaaacctacaaggaggagtaccatcaagattctcaggatcaggattccacacaacattcacactagcaataagaggactacaaccagacgacttcgcaacatacttctgccaatcattagaattcttcggaccaggaacaaaagtagacatgaaa

SEQ ID NO: 48671 - RNA, 306 nt, synthetic construct
  misc_feature 1..306: note = derived and/or modified sequence opt6 from anti-HIV-1_LightChain
  source 1..306: mol_type = other RNA
tatatacaactaacacaatcaccatcaagtttaagcgcaagcgtaggagatagagtaacaataacatgtagagcaagccaagacataggatatgtatcatggtatgcacaaaaaagaggaagagcaccaaaattactaatacacggagcatcaggattagaaagaggagtaccatcaagatttagcggaagcggaagcggaacattattcacactaacaatagaaagcttacaaccagaagatttcgcaacatatatgtgtcaagtattcgaaagctttggaccaggaacaaaagtagaaatgaaa

SEQ ID NO: 48672 - RNA, 309 nt, synthetic construct
  misc_feature 1..309: note = derived and/or modified sequence opt6 from anti-HIV-1_LightChain
  source 1..309: mol_type = other RNA
ggaatacaactaacacaatcaccatcaagcttaagcgcaagcgtaggagatagagtaagcataaactgtcaagcaggacaaggaataggatcaagcttaaactggtaccaacaaaaaccaggaagagcaccaaaattattagtacatggagcaagcaatctacaaagaggagtaccaagcagattctcaggatcaggatttcacacaacatttacattaacaataagctcactacaaccagatgacgtagcaacatacttttgcgcagtatttcaatggttcggaccaggaacaagagtagatttcaat

SEQ ID NO: 48673 - RNA, 366 nt, synthetic construct
  misc_feature 1..366: note = derived and/or modified sequence opt6 from anti-HIV-1_HeavyChain
  source 1..366: mol_type = other RNA
tcacaacaattagtacaaagtggaacacaagtaaaaaaaccaggagcaagtgtaagaataagttgtcaagcaagtggatatacatttacagattatgtattacattggtggagacaagcaccaggacaaggattagaatggatgggatggataaaaccagtatatggagcaagaaattatgcaagaagatttcaaggaagaatagattttagtagagatatatatagagaaatagcatatatggatttaagtggattaagaagtgatgatacagcattatatttttgtgcaagagatggaagtggagatgatacaagttggcatttagatccatggggacaaggaacattagtaatagtatcagca

SEQ ID NO: 48674 - RNA, 366 nt, synthetic construct
  misc_feature 1..366: note = derived and/or modified sequence opt6 from anti-HIV-1_HeavyChain
  source 1..366: mol_type = other RNA
agccaacaattagtacaaagtggaacacaagtaaaaaaaccaggagcaagtgtaagaataagttgtcaagcaagtggatatacatttacagattatttattacattggtggagacaagcaccaggacaaagattagaatggatgggatggataaaaccagtatatggagcaagaaattatgcacatagatttcaaggaagaataaattttgatagagatatatatagggaaatagcatttatggatttaagtggactaagaagtgatgatacagcagtatatttttgtgcaagagatggaggaggagatgatagaacatggctattagatacatggggacaaggaacattagtagtagtaagtagt

SEQ ID NO: 48675 - RNA, 366 nt, synthetic construct
  misc_feature 1..366: note = derived and/or modified sequence opt6 from anti-HIV-1_HeavyChain
  source 1..366: mol_type = other RNA
caagtacatttagaacaaccaggaagtgtagtaagatggccaggagcaagtttaacactaagttgtacagcaagcggatatatatttgtaaattatcatatacattggttaagacaagcaccaggacaaagattagaattattaggaacaataaatccagtaggaggagcaacaagttatgcacaaaaatttagaggaagattagtattaacaagagatataggatcaagtacagtaacattattactaaatcatttaagaagagacgatagtgcagtatatttttgtgcaagagaatcaaatgcaagcggaagaggaagatcaatggatcattggggaagaggatcaagagtaatagtaagtcaa

SEQ ID NO: 48676 - RNA, 366 nt, synthetic construct
  misc_feature 1..366: note = derived and/or modified sequence opt6 from anti-HIV-1_HeavyChain
  source 1..366: mol_type = other RNA
caagtacaattagtacaaagtggagcagaagtaaaaaaaccaggagcaagtgtaagagtaagctgtcaagcaagtggatatacatttacaaattatatattacattggtggagacaagcaccaggacaaggattagaatggatgggattaataaaaccagtatatggagcagtaaattatgcaagacaatttcaaggaagaatacaattaacaagagatatatatagagaaatagcatttttagatttatcaggattaagatcagatgatacagcagtatattattgtgcaagagatgaaagtggagatgatttaaaatggcatttacatccatggggacaaggaacacaagtaatagtaagtcca

SEQ ID NO: 48677 - RNA, 366 nt, synthetic construct
  misc_feature 1..366: note = derived and/or modified sequence opt6 from anti-HIV-1_HeavyChain
  source 1..366: mol_type = other RNA
caagtacaattagtacaaagtggagcagaagtaaaaaaaccaggagcaagcgtaagaataagttgtcaagcaagtggatatacatttacagattatgtattacattggtggagacaagcaccaggacaaggattagaatggatgggatggataaaaccagtatatggagcaagaaattatgcaagaagatttcaaggaagaataaattttgatagagatatatatagagaaatagcatatatggatttaagtggattaagaagtgatgatacagcaagatatttttgtgcaagagatggaagtggagatgatacaagttggcatttacatccatggggacaaggaacattagtaatagtaagtgca

SEQ ID NO: 48678 - RNA, 366 nt, synthetic construct
  misc_feature 1..366: note = derived and/or modified sequence opt6 from anti-HIV-1_HeavyChain
  source 1..366: mol_type = other RNA
agtcaacaactagtacaaagtggaacacaagtaaaaaaaccaggagcaagtgtaagagtaagctgtcaagcaagcggatatacatttacaaattatatattacattggtggagacaagcaccaggacaaggattagaatggatgggattaataaaaccagtatatggagctgtaaattatgcaagacaatttcaaggaagaatacaattaacaagagatatatatagagaaatagcatttttagatttaagtggattaagaacagatgatacagcagtatattattgtgcaagagatgaaagtggagatgatttaaaatggcatttacatccatggggacaaggaacacaagtaatagtaagccca

SEQ ID NO: 48679 - RNA, 366 nt, synthetic construct
  misc_feature 1..366: note = derived and/or modified sequence opt6 from anti-HIV-1_HeavyChain
  source 1..366: mol_type = other RNA
caagtacatttagaacaaagtggaagtgtagtaagatggccaggagcaagtttaacactaagttgtacagcaagcggatatatatttgtaaattatcatatacattggttaagacaagcaccaggacaaagattagaattaatgggaacaataaatccagtaggaggagcaacaagttatacacaaagatttagaggaagattagtattaacaagagatataggatcaaatacagtaacattattattaaatcatttaagatcagatgatagtgcagtatatttttgtgcaagagaatcaaatgcaagtggaagaggacgatcaatggatcattggggaagaggatcacatgtaatagtaagtcca

SEQ ID NO: 48680 - RNA, 366 nt, synthetic construct
  misc_feature 1..366: note = derived and/or modified sequence opt6 from anti-HIV-1_HeavyChain
  source 1..366: mol_type = other RNA
tcacaacatctagtacaatcaggaacacaagtaaaaaaaccaggagcatcagtaagagtatcatgccaagcatcaggatatacatttacaaattacatattacattggtggagacaagcaccaggccaaggattagaatggatgggactaataaaaccagtatatggagcagtaaattacgcaagacaattccaaggaagaatacaattaacaagagatatatatagagatatagcattcttagacttatcaggactaagaagcgatgacacagcagtatactattgcgcaagagatgaatcaggagatgacttaaaatggcacttacacccatggggacaaggaacacaagtaatagtatcacca

SEQ ID NO: 48681 - RNA, 366 nt, synthetic construct
  misc_feature 1..366: note = derived and/or modified sequence opt6 from anti-HIV-1_HeavyChain
  source 1..366: mol_type = other RNA
agtcaacaattagtacaaagtggaacacaagtaaaaaaaccaggagcaagtgtaagaataagttgtcaagcaagtggatatacatttacagattatgtattacattggtggagacaagcaccaggacaaggattagaatggatgggatggataaaaccagtatatggagcaagaaattatgcaagaagatttcaaggaagaataaattttgatagagatatatatagagaaatagcatatatggatttaagtggattaagaagtgatgatacagcaagatatttttgtgcaagagatggaagtggagatgatacaagttggcatttacatccatggggacaaggaacattagtaatagtaagtgca

SEQ ID NO: 48682 - RNA, 366 nt, synthetic construct
  misc_feature 1..366: note = derived and/or modified sequence opt6 from anti-HIV-1_HeavyChain
  source 1..366: mol_type = other RNA
caagtacatttagaacaaccaggatcagtagtaagatggccaggagcatcattaacactaagttgcacagcatcaggatatatatttgtaaattaccatatacattggttaagacaagcaccaggacaaagattagaattactaggaacaataaacccagtaggaggagcaacatcatacgcacaaaaattcagaggaagattagtactaacaagagatataggatcatcaacagtaacactactattaaaccatttaagaagagatgactcagcagtatacttttgcgcaagagaatcaaatgcatcaggaagaggaagatcaatggaccattggggaagaggaaaaccagtaatagtatcacca

SEQ ID NO: 48683 - RNA, 321 nt, synthetic construct
  misc_feature 1..321: note = derived and/or modified sequence opt6 from anti-HIV-1_HeavyChain
  source 1..321: mol_type = other RNA
gaaatagtaatgacacaatcaccagcaatattaagcgtaagcccaggagatagagcaacatttagctgtagagcaagccaaagcgtaaaaaataacctagcatggtaccaaaaaagaccaggacaagcaccaagactattaatatttgacgcaagctcaagagcaagcggaataccagcaagattctcaggaggaggatcaggaacagaatttacattaacagtaaactcaatgcaaagcgaagactttgcaacatactattgccaacaatatgaagaatggccaagaacattcggacaaggaacaaaagtagaaataatg

SEQ ID NO: 48684 - RNA, 321 nt, synthetic construct
  misc_feature 1..321: note = derived and/or modified sequence opt6 from anti-HIV-1_HeavyChain
  source 1..321: mol_type = other RNA
caaatagtactaacacaatcaccaccaacactatcactatcaccaggagaaagagcaacactatcatgcagagcatcacaatcagtaaaaaacaacctagcatggtaccaaaaaagaccaggacaagcaccaagattactaatattcgacacatcatcaagagcatcaaacataccagcaagattctcaggaggaggatcaggaacagaattcacactaacagtaaactcaatgcaatcagaagacttcgcaacatactactgccaacaatacgaagaatggccaagaacattcggacaaggaacaaaagtagaaataata

SEQ ID NO: 48685 - RNA, 321 nt, synthetic construct
  misc_feature 1..321: note = derived and/or modified sequence opt6 from anti-HIV-1_HeavyChain
  source 1..321: mol_type = other RNA
gaaatagtaatgacacaatcaccagcagtactatcagtatcaccaggcgacagagcaacactatcatgcagagcatcacaaagcgtaaaaaacaacctagcatggtaccaaaaaagaccaggacaagcaccaagactactaatattcgacacatcatcaagagcatcaaacataccagcaagattctcaggaggaggaagcggaacagaattcacactaacagtaaactcaatgcaatcagaagacttcgcaacatactactgccaacaatacgaagaatggccaagaacattcggacaaggaacaaaagtagaaataaac

SEQ ID NO: 48686 - RNA, 321 nt, synthetic construct
  misc_feature 1..321: note = derived and/or modified sequence opt6 from anti-HIV-1_HeavyChain
  source 1..321: mol_type = other RNA
gaaatagtactaacacaatcaccaccaacattaagcgtaagcccaggagaagcagcaacattaagctgtagagcaagccaaagcgtaaaaaataacttagcatggtaccatctaaaagcaggacaagcaccaagactattaatatttgacgcaagctcaagagcaggagatgcaccagcaagagtatcaggatcaggatatggaacagaatttacattaacagtaaactcagtacaaagcgaagactttggagattactattgccaacaatatgaagaatggccaagaacattcggacaaggaacaaaagtagatctaaga

SEQ ID NO: 48687 - RNA, 321 nt, synthetic construct
  misc_feature 1..321: note = derived and/or modified sequence opt6 from anti-HIV-1_HeavyChain
  source 1..321: mol_type = other RNA
gaaatagtaatgacacaatcaccaccaacattaagcgtaagcccaggagaaacagcaacattaagctgtagagcaagccaaaacgtaaaaaataacttagcatggtaccaactaaaaccaggacaagcaccaagactattaatatttgacgcaagctcaagagcaggaggaataccagacagattctcaggatcaggatatggaacagactttacattaacagtaaactcagtacaaagcgaagactttggagattacttttgccaacaatatgaagaatggccaagaacattcggacaaggaacaaaagtagatctaaga

SEQ ID NO: 48688 - RNA, 321 nt, synthetic construct
  misc_feature 1..321: note = derived and/or modified sequence opt6 from anti-HIV-1_HeavyChain
  source 1..321: mol_type = other RNA
gaaatagtaatgacacaatcaccagcagtactatcagtatcaccaggagacagagcaacactatcatgccgagcatcacaatcagtaaaaaacaacctagcatggtaccaaaaaagaccaggacaagcaccaagactactaatattcgacacatcatcaagagcatcaaacataccagcaagattctcaggaggaggatcaggaacagaattcacactaacagtaaactcaatgcaatcagaagacttcgcaacatactactgccaacaatacgaagaatggccaagaacattcggacaaggaacaaaagtagaaataata

SEQ ID NO: 48689 - RNA, 399 nt, synthetic construct
  misc_feature 1..399: note = derived and/or modified sequence opt6 from anti-HIV-1_HeavyChain
  source 1..399: mol_type = other RNA
gaagtacatttacaagaaagtggaccaggattagtaagaccattagaaacattaagtctaacatgtacagcaagtggagcaagtataagaggaggagaatggggagataatgattatcattggggatgggtaagacatagcccagaaaaaggattagaatggataggaagtatacattggagaggaacaacacattataatgcaccatttagaggaagagcaacattaagtatagatacaagcagaaatcaattttttttaagattaacaagtatgacagcagatgatacagcagtatattattgtgtaaaacataaatatcatgatatagtaatggtagtaccaatagcaggatggtttgatccatggggacaaggactacaagtaacagtaagtgca

SEQ ID NO: 48690 - RNA, 399 nt, synthetic construct
  misc_feature 1..399: note = derived and/or modified sequence opt6 from anti-HIV-1_HeavyChain
  source 1..399: mol_type = other RNA
gaagtacatttacaagaaagtggaccaggattagtaagaccattagaaacattaagtttaacatgtacagcaagtggagcaagtataagaggaggagaatggggagataatgattatcattggggatgggtaagacatagtccagaaaaaggattagaatggataggaagtatacattggagaggaacaacacattataatgcaccatttagaggaagagcaacattaagtatagatacaagtagaaatcaattttttttaagattaacaagtatgacagcagatgatacagcagtatattattgtgttaaacataaatatcatgatatagtaatggtagtaccaatagcaggatggtttaatccatggggacaaggattacaagcaacagtaccaagt

SEQ ID NO: 48691 - RNA, 399 nt, synthetic construct
  misc_feature 1..399: note = derived and/or modified sequence opt6 from anti-HIV-1_HeavyChain
  source 1..399: mol_type = other RNA
caagtacaactaaaagaatcaggaccaggattagtaaaaccatcagaaacattatcactaacatgcacagtatcaggaggaagcatgagaggaacagattggggagaaaatgactttcattatggatggataagacactcaagcgcagaaggactagaatggataggatcaatacattggagaggaacaacacattacaaaatgtcattcagaagtagagcaacaatatcaatagatacatcaaacaatagatttagcctaatgtttagctttgtaacagcagaagacacagcagtatactattgcgcaagacataaatatcatgatatatttagagtagtaccagtagcaggatggttcgatccatggggacaaggactattagtaacagtaagttca

SEQ ID NO: 48692 - RNA, 399 nt, synthetic construct
  misc_feature 1..399: note = derived and/or modified sequence opt6 from anti-HIV-1_HeavyChain
  source 1..399: mol_type = other RNA
gaagtacatttacaagaaagtggaccaggattagtaagaccattagaaacattatcactaacatgtacagcaagtggagcaagtataagaggaggagaatggggagataatgattatcattggggatgggtaagacatagcccagaaaaaggattagaatggataggaagtatacattggagaggaacaacacattataatgcaccatttagaggaagagcaacactaagtatagatacaagtaaaaatcaatttagtttaagattaacaagtatgacagcagatgatacagcagtatattattgtgtaaaacataaatatcatgatatagtaatggtagtaccatttgcaggatggtttgatccatggggacaaggattaagagtgacagtaagtgca

SEQ ID NO: 48693 - RNA, 399 nt, synthetic construct
  misc_feature 1..399: note = derived and/or modified sequence opt6 from anti-HIV-1_HeavyChain
  source 1..399: mol_type = other RNA
gaagtacatttacaagaaagtggaccaggattagtaagaccattagaaacattaagtttaacatgtacagcaagtggagcatcaataagaggaggagaatggggagataatgattatcattggggatgggtaagacatagtccagaaaaaggattagaatggataggaagtatacattggagaggaacaacacattataatgcaccatttagaggaagagcaacactaagtatagatacaagtaaaaatcaattttttttaagattaacatcaatgacagcagatgatacagcagtatattattgtgtaaaacataaatatcatgatatatgtatggtagtaccaatagcaggatggtttgatccatggggacaaggactacaagtaacagtatcacaa

SEQ ID NO: 48694 - RNA, 399 nt, synthetic construct
  misc_feature 1..399: note = derived and/or modified sequence opt6 from anti-HIV-1_HeavyChain
  source 1..399: mol_type = other RNA
caagtacatttacaagaaagtggaccaggattagtaagaccattagaaacattaagtttaacatgtacagcaagtggagcaagtattagaggaggagaatggggagataatgattatcattggggatgggtaagacatagtccagaaaaaggattagaatggataggaagtatacattggagaggaacaacacattataatgcaccatttagaggaagagcaacattaagtatagatacaagtagaaatcaattttttttaagattaacaagcatgacagcagatgatacagcagtatattattgtgtaaaacataaatatcatgatatagtaatggtagtaccaatagcaggatggtttgatccatggggacaaggattacaagtaacagtatcaagt

SEQ ID NO: 48695 - RNA, 399 nt, synthetic construct
  misc_feature 1..399: note = derived and/or modified sequence opt6 from anti-HIV-1_HeavyChain
  source 1..399: mol_type = other RNA
caagtacatttacaagaaagtggaccagggttagtaagaccattagaaacattaagtttaacatgtacagcaagcggagcatcaataagaggaggagaatggggagataatgattatcattggggatgggtaagacatagtccagaaaaaggattagaatggataggaagtatacattggagaggaacaacacattataatgcaccatttagaggaagagcaacattaagtatagatacaagtagaaatcaattttttttaagattaacaagtatgacagcagatgatacagcagtatattattgtgtaaaacataaatatcatgatatagtaatggtagtaccaatagcaggatggtttgatccatggggacaaggattaagagtaacagtaagtcaa

SEQ ID NO: 48696 - RNA, 399 nt, synthetic construct
  misc_feature 1..399: note = derived and/or modified sequence opt6 from anti-HIV-1_HeavyChain
  source 1..399: mol_type = other RNA
caagtacatttacaagaaagtggaccaggactagtaagaccattagaaacattaagtttaacatgtacagcaagtggagcatcaataagaggaggagaatggggagataatgattatcattggggatgggtaagacatagtccaggaaaaggattagaatggataggaagtatacattggagaggaacaacacattataatgcaccatttagaggaagagcaacattaagtatagatacatttagaaatcaattttttttaagattaacaagtatgactgcagatgatacagcagtatattattgtgtaaaacataaatatcatgatatagtaatggtagtaccaatagcaggatggtttgatccatggggacaaggattacaagtaacagtatcacaa

SEQ ID NO: 48697 - RNA, 399 nt, synthetic construct
  misc_feature 1..399: note = derived and/or modified sequence opt6 from anti-HIV-1_HeavyChain
  source 1..399: mol_type = other RNA
gaagtacatttacaagaaagtggaccaggattagtaagaccattagaaacattaagcttaacatgtacagcaagtggagcaagtataagaggaggagaatggggagataatgattatcattggggatgggtaagacatagtccagaaaaaggattagaatggataggaagtatacattggagaggaacaacacattataatgcaccatttagaggaagagcaacattaagtatagatacaagtagaaatcaattttttctaagattaacaagtatgacagcagatgatacagcagtatattattgtgtaaaacataaatatcatgatatagtaatggtagtaccaatagcaggatggtttgatccatggggacaaggattaagaggaacagtaagtgca

SEQ ID NO: 48698 - RNA, 393 nt, synthetic construct
  misc_feature 1..393: note = derived and/or modified sequence opt6 from anti-HIV-1_HeavyChain
  source 1..393: mol_type = other RNA
caagtacaattagttcaaagtggagcagtaataaaaacaccaggaagtagtgtaaaaataagttgtagagcaagtggatataattttagagattatagtatacattgggtaagattaataccagataaaggatttgaatggataggatggataaaaccattatggggagcagtaagttatgcaagacaattacaaggaagagtaagtatgacaagacaattaagtagagatccagatgatccagattggggagtagcatatatggaatttagcggattaacaccagcagatacagcagaatatttttgtgtaagaagaggaagttgtgattattgtggagattttccatggcaatattggggacaaggaacagtagtagtagtaagtagtgca

SEQ ID NO: 48699 - RNA, 393 nt, synthetic construct
  misc_feature 1..393: note = derived and/or modified sequence opt6 from anti-HIV-1_HeavyChain
  source 1..393: mol_type = other RNA
caagtacaattagtacaaagtggagcagtaataaaaacaccaggatcaagtgtaaaactaagttgtagagcaagtggatataattttagagattatagtatacattgggtaagattaataccagataaaggatttgaatggataggatggataaaacctttatggggagcagtaagctatgcaagacaattacaaggaagagtaagtatgacaagacaattaagtcaagatccagatgatccagattggggagtagcatatatggaatttagtggattaacaccagcagatacagcagaatatttttgtgtaagaagaggatcatgtgattattgtggagattttccatggcaatattggggacaaggaacagtagtagtagtaagttcagca

SEQ ID NO: 48700 - RNA, 303 nt, synthetic construct
  misc_feature 1..303: note = derived and/or modified sequence opt6 from anti-HIV-1_LightChain
  source 1..303: mol_type = other RNA
acagcaggactaacacaatcaccaggaacactatcactatcaccaggagaaagagcaatactatcatgcagaacatcacaatacggatcactagcatggtaccaacaaagaccaggacaagcaccaagattagtaatatacgcaggactaacaagagcaacaggaataccagacagattctcaggatcaagatggggagcagaatacaacctaacaatatcaaacctagaatcagaagacttcggagtatactactgccaacaatacgacttcttcggacaaggaacaaaagtacaagtagac

SEQ ID NO: 48701 - RNA, 378 nt, synthetic construct
  misc_feature 1..378: note = derived and/or modified sequence opt6 from anti-HIV-1_HeavyChain
  source 1..378: mol_type = other RNA
caagtacaattagtacaaagtggaagtggagtaaaaaaattaggagcaagtgtaagagtaagttgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagtttaacaagagatagggatttaagtacagcacatatggatataagaggattaacacaagatgatacagcaacatatttttgtgcaagacaaaaatttgcaagaggagatcaaggatggttttttgatttatggggaagaggaacattaatagtagtaagtagtgca

SEQ ID NO: 48702 - RNA, 384 nt, synthetic construct
  misc_feature 1..384: note = derived and/or modified sequence opt6 from anti-HIV-1_HeavyChain
  source 1..384: mol_type = other RNA
caagtacaattagtacaaagtggaagtggagtaaaaaaattaggagcaagtgtaagagtaagctgttggacaagtgaagatatatttgaaagaacagaattaatacattgggtaagacaagcaccaggacaaggattagaatggataggatgggtaaaagcagtaacaggaacagtaaattttggaagtttaaattttagacaaagagtaagtttaacaagagatagagatttatttacagcacatatggatataagaggattaacacaaggagatacagcaacatatttctgtgcaagacaaaaatttgaaaaatatacaggaggacaaggatggtattttgatttatggggaagaggaacattaatagtagtaagtagtgca

SEQ ID NO: 48703 - RNA, 378 nt, synthetic construct
  misc_feature 1..378: note = derived and/or modified sequence opt6 from anti-HIV-1_HeavyChain
  source 1..378: mol_type = other RNA
caagtacaattagtacaaagtggaagtgcaatgaaaaaaccaggagcaagtgtaagagtaagctgttggacaagtgaagatatatttgatacaacagaattaatatattgggtaagacaagcaccaggacaaggattagaatggataggatgggtaaaaatagtaagtggaacagtaaattttgcaagtttagattttagaaatagaataagtttaagcagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagtgca

SEQ ID NO: 48704 - RNA, 387 nt, synthetic construct
  misc_feature 1..387: note = derived and/or modified sequence opt6 from anti-HIV-1_HeavyChain
  source 1..387: mol_type = other RNA
caagtacaattagtacaaagtggagcagaagtaaaaaaaccaggagcaagtgtaagagtaagttgttggacaagtgaagatatatttgatacaacagaattaatatattgggtaagacaagcaccaggacaaggactagaatggataggatgggtaaaaatagtaagtggaacagtaaattttgcaagtttagattttagaaatagaataagtttaagtagagatagagatttaagtacagcacatatggatataagaggattaacacaagatgatacagcaacatatttttgtgcaagacaaaaatttgaatcaagatatacaggaggacaaggatggtattttgatttatggggaagaggaacacatatagtagtaagtagtgca

SEQ ID NO: 48705 - RNA, 387 nt, synthetic construct
  misc_feature 1..387: note = derived and/or modified sequence opt6 from anti-HIV-1_HeavyChain
  source 1..387: mol_type = other RNA
caagtacaattagtacaaagtggaagtgcaatgaaaaaaccaggagcaagtgtaagagtaagttgttggacaagtgaagatatatttgaaagaacagaactaatatattgggtaagacaagcaccaggaagaggattagaatggataggatgggtaaaaacagtaagtggaacagtaaattttggaagtagtgattttagaaatagaataagtttaacaagagatagagatttaagtacagcacatatggatataagaggattaacacaagatgatacagcaacatatttttgtgcaagacaaaaatttgaaagtttatatagtgatgatcaaggaagttattttgatttatggggaagaggaacattaataatagtaagtagtgca

SEQ ID NO: 48706 - RNA, 387 nt, synthetic construct
  misc_feature 1..387: note = derived and/or modified sequence opt6 from anti-HIV-1_HeavyChain
  source 1..387: mol_type = other RNA
caagtacaattagtacaaagtggactagaagtaaaaaaaccaggagcaagtgtaagagtaagttgttggacaagtgaagatatatttgatacaacagaattaatatattgggtaaggcaagcaccaggacaaggattagaatggataggatgggtaaaaatagtaagtggaacagtaaattttgcaagtttagattttagaaatagaataagtttaagtagagatagagatttaagtacagcacatatggatataagaggattaacacaagatgatacagcaacatatttttgtgcaagacaaaaatttgcaagtagatatagtggagatcaaggaagttattttgatttatggggaagaggaacattaataatagtaagtagtgca

SEQ ID NO: 48707 - RNA, 387 nt, synthetic construct
  misc_feature 1..387: note = derived and/or modified sequence opt6 from anti-HIV-1_HeavyChain
  source 1..387: mol_type = other RNA
caagtacaattagtacaaagtgcaagtggagtaagaagaccaggagcaagtgtaagagtaagttgttggacaagtgaagatatatttgaaagaagtgaattaatatattgggtaagacaagcaccaggaagaggattagaatggataggatggataaaattagtaagtggagcagtaaattttggaagtgtagattttagagatagagtaagtttaacaagagatagagatctatttacagcacatatggatataagaggattaacacaagatgatacagcaacatatttttgtgcaagacaaaaatttgcaagccgatatagtggagatcaaggaagttattttgatttatggggaagaggaacattaataatagtaagtagtgca

SEQ ID NO: 48708 - RNA, 375 nt, synthetic construct
  misc_feature 1..375: note = derived and/or modified sequence opt6 from anti-HIV-1_HeavyChain
  source 1..375: mol_type = other RNA
caagtacaattagtacaaagtggaagtggagtaaaaaaaccaggagcaagtgtaagagtaagttgttggacaagtgaaggaatatttgaaaaaagtgaattaatacattgggtaagacaagcaccaggacaaggattagaatggataggatgggtaaaaacagtaacaggagcagtaaattttggacatcaaatatcagatagagtatcattaacaagagatagagatttatttacagcacatatggatataagaggattaacacaaggggatacagcaacatatttttgtgcaagacaaaaatttgaaagaggaggacaaggatggatatttgatttatggggaagaggaacattaatagcagtaagtagtgca

SEQ ID NO: 48709 - RNA, 378 nt, synthetic construct
  misc_feature 1..378: note = derived and/or modified sequence opt6 from anti-HIV-1_HeavyChain
  source 1..378: mol_type = other RNA
caagtacaattagtacaaagtggagcagaagtaaaaaaaccaggagcaagtgtaagagtaagctgttggacaagcgaagatatatttgaaaaatcagaattaatacattgggtaagacaagcaccaggacaaggattagaatggataggatgggtaaaaacagtaacaggagcagtaaattttggaagtagtgattttagacaaagagtaagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagtgca

SEQ ID NO: 48710 - RNA, 378 nt, synthetic construct
  misc_feature 1..378: note = derived and/or modified sequence opt6 from anti-HIV-1_HeavyChain
  source 1..378: mol_type = other RNA
caagtacaattagtacaaagtggagcagaagtaaaaagaccaggagcaagtgtaaaagtaagttgttggacaagtgaagatatatttgaaagaacagaactaatacattgggtaagacaagcaccaggacaaggattagaatggataggatgggtaaaaacagtaagtggagcagtaaattttggaagtccaaattttagacatagagtaagtttaacaagggatagagatttatttacagcacatatggatataagaggattaacacaaggagatacagcaacatatttttgtgcaaggcaaaaatttgaaagaggaggacaaggatggtattttgatttatggggaagaggaacattaatagtagtaagtagtgca

SEQ ID NO: 48711 - RNA, 378 nt, synthetic construct
  misc_feature 1..378: note = derived and/or modified sequence opt6 from anti-HIV-1_HeavyChain
  source 1..378: mol_type = other RNA
caagtacaattagtgcaaagtggaagtggagtaaaaaaaccaggagcaagtgtaagagtaagttgttggacaagtgaagatatatttgaaggaagtgaattaatacattgggtaagacaagcaccaggacaaggattagaatggataggatgggtaaaaacagtaacaggagcagtaaattttggaagtgcatattttagacatagagtaagtttaacaagagatagagatttatttacagcacatatggatataagaggattaacacaaggagatacagcaacatatttttgtgcaagacaaaaatttatgagtggaggacaaggatggtattttgatctatggggaagaggaacagtaatagtagtaagtagtgca

SEQ ID NO: 48712 - RNA, 387 nt, synthetic construct
  misc_feature 1..387: note = derived and/or modified sequence opt6 from anti-HIV-1_HeavyChain
  source 1..387: mol_type = other RNA
caagtacaattagtaccaagtggaagtggagtaaaaaaaccaggagcaagtgtaagagtaagctgttggacaagtgaagatatatttgaaagaacagaattaatacattgggtaagacaagcaccaggacaaggattagaatggataggatgggtaaaaacagtaacaggagcagtaaattttggaagtttagattttagacatagaataagtttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagttcagca

SEQ ID NO: 48713 - RNA, 378 nt, synthetic construct
  misc_feature 1..378: note = derived and/or modified sequence opt6 from anti-HIV-1_HeavyChain
  source 1..378: mol_type = other RNA
caagtacaattagtacaaagtggaagtggagtaaaaaaagtaggagcaagtgtaagagtaagttgttggacaagtgaagatatatttgaaagaacagaactaatacattgggtaagacaagcaccaggacaaggactagaatggataggatgggtaaaagcagtaagtggagcagtaaattatggaagtttagattttagacatagagtatcattaacaagagatagagatctatttacagcacatatggatataagaggattaacacaagatgatacagcaatatatttttgtgcaagacaaaaattttatgcaggaggacaaggatggtattttgatttatggggaagaggaacattaatagtagtaagtagtgca

SEQ ID NO: 48714 - RNA, 387 nt, synthetic construct
  misc_feature 1..387: note = derived and/or modified sequence opt6 from anti-HIV-1_HeavyChain
  source 1..387: mol_type = other RNA
caagtacaattagtacaaagtggagcagaagtaaaaaaaccaggaagtagtgtaagagtaagttgttggacaagcgaagatatatttgaaagaacagaattaatacattgggtaagacaagcaccaggacaaggattagaatggataggatgggtaaaaacagtaacaggagcagtaaattttggaagtccaaattttagacatagggtaagtttaacaagagacagagatttatttacagcacatatggatataagaggattaacacaaggagatacagcaacatatttttgtgcaagacaaaaatttgaaagtagatatagtggagatcaaggaagctattttgatttatggggaagaggaacattaataatagtaagtagtgca

SEQ ID NO: 48715 - RNA, 375 nt, synthetic construct
  misc_feature 1..375: note = derived and/or modified sequence opt6 from anti-HIV-1_HeavyChain
  source 1..375: mol_type = other RNA
caagtacaattagtacaaagtggagcagaagtaaaaaaaccaggagcaagtgtaaaagtaagttgtaaagcaagcggatatacatttacaagttattatatgcattgggtaagacaagcaccaggacaaggactagaatggataggatgggtaaaaccagtaacaggagcagtaaattttggatcaccaaattttagacatagagtatcactaacaagagatagagatttatttacagcacatatggatataagaggactaacacaaggagatacagcaacatatttttgtgcaagacaaaaatattatgcaggaggacaaggatggtattttgatttatggggaagaggaacattaatagtagtaagttcagca

SEQ ID NO: 48716 - RNA, 375 nt, synthetic construct
  misc_feature 1..375: note = derived and/or modified sequence opt6 from anti-HIV-1_HeavyChain
  source 1..375: mol_type = other RNA
caagtacaattagtacaaagtggagcagaagtaaaaaaaccaggagcaagtgtacaagtaagttgtaaagcaagtggatatccatttacaaaatattatatgcattgggtaagacaagcaccaggacaaggattagaatggataggatgggtaaaagcagtaagtggagcagtaaattatggatcattagattttagacatagagtatcattaacaagagatagagatttatcaacagcacatatggatataagaggattaacacaagatgacacagcaacatatttttgtgcaagacaaaaatttgcaagaggagatcaaggatggttttttgatttatggggaagaggaacattaatagtagtaagttcagca

SEQ ID NO: 48717 - RNA, 375 nt, synthetic construct
  misc_feature 1..375: note = derived and/or modified sequence opt6 from anti-HIV-1_HeavyChain
  source 1..375: mol_type = other RNA
caagtacaattagtacaaagtggagcagaagtaaaaaaaccaggagcaagtgtaaaagtaagttgtaaagcaagtggatatacatttacaggatattatatgcattgggtaagacaagcaccaggacaaggactagaatggataggatgggtaaaaacagtaagcggagcagtaaattttggatcattaaattttagacatagagtatcattaacaagagatagagatttatttacagcacatatggatataagaggattaacacaaggagatacagcaacatatttttgtgcaagacaaaaatttgcaagaggagatcaaggatggttttttgatttatggggaagaggaacattaatagtagtaagttcagca

SEQ ID NO: 48718 - RNA, 402 nt, synthetic construct
  misc_feature 1..402: note = derived and/or modified sequence opt6 from anti-HIV-1_HeavyChain
  source 1..402: mol_type = other RNA
caagtacaattagtacaatcaggatcaggagtaaaaaaaccaggagcatcagtaagagtatcatgcagagcatcagaagatctatttggagatgaaataatatatgacgatgaagtaatacattggttaagacaagtaccaggacaaagaccagaatggatgggatggataagaccaaaaacaggagcaagaaatcaagcaagacaattccaaccaagaatatcactaacaagagatagagcactatcaacagcgtacttagacttaaactcattaacaagcgcagactcaggaacatacttttgcgcaagacaaacatttaaaccagacttttactttgcagatcaaggatggtcattcaatctatggggaagaggagcacactttatagtaagctcagca

SEQ ID NO: 48719 - RNA, 381 nt, synthetic construct
  misc_feature 1..381: note = derived and/or modified sequence opt6 from anti-HIV-1_HeavyChain
  source 1..381: mol_type = other RNA
caagtacaattagtacaaagtggaggaggagtaaaaaaaccaggagcaagtgcaagttttagttgtagaacaagtgaagatccatttgataatgaattttttgattcagaatttatgcattgggtaagattaacaccaggacaaagaccagaatggatgggatggatgaatccaagatcaggaggagtaaattatgcaggacaatttagaccaagaatgtcaatgtggagagatagagaattatcaacagcatatatggaattaagagatttaacatttgcagatacaggattatatttttgtgcaagaagaaaagaagatgattatgattggtattatgatttatggggaagaggagcacatataatagtaagtgcagca

SEQ ID NO: 48720 - RNA, 384 nt, synthetic construct
  misc_feature 1..384: note = derived and/or modified sequence opt6 from anti-HIV-1_HeavyChain
  source 1..384: mol_type = other RNA
caagtacaattagtacaagcaggaggaggagtaaaaaaaccaggagcaagtgtaacattaagttgtaaaacagcagatgaagatgtatttgatgcagcatatatgcattgggtaagacaagcaccaggacaaacatttgaatggttaggatggatgaaaccagtaacaggagcagtaaattatgcaagaaaatttcaaggaagagtaagtttttataggacaagagaattaggaatagcatatatggatctaagaaatttaagatttgatgatacagcagtatatttttgtgcaagaaaaacagcaggagatgtaagtggagataaaagaggatttttttttgatttatggggaagaggaagtagagtaatagtaagtagcgca

SEQ ID NO: 48721 - RNA, 384 nt, synthetic construct
  misc_feature 1..384: note = derived and/or modified sequence opt6 from anti-HIV-1_HeavyChain
  source 1..384: mol_type = other RNA
caagtacaattagtacaaagtggagcagaagtaaaaaaaccaggagcaagtgtaacattaagttgtaaaacagcagatgaagatgtatttgatgcagcatatatgcattgggtaagacaagcaccaggacaaacatttgaatggttaggatggatgaaaccagtaacaggagcagtaagttatgcaaggaaatttcaaggaagagtaagtttttatatgacaagagaattaggaatggcatatatggatttaagaaatttaagatttgatgatacagcagtatatttttgtgcaagaaaaacagcaggagatgtaagtggagataatagaggatatttttttgatttatggggaagaggaagtagagtaatagtaagtagtgca

SEQ ID NO: 48722 - RNA, 384 nt, synthetic construct
  misc_feature 1..384: note = derived and/or modified sequence opt6 from anti-HIV-1_HeavyChain
  source 1..384: mol_type = other RNA
caagtacaattagtacaaagcgaagcagaagtaaaaaaaccaggagcaagcatgacagtaagctgtgaaacagcagatgaagatatatttgacgcagcatatatgcattgggtaagacaagcaccaggacaaacatttgaatggctaggatggatgaaaccagtaacaggagcagtaaattacgcaagaaaattccaaggaagaatatcattttatagaacaagagaattagcaatagcatacatggacttaagagatctaagattcgatgacacagcagtatacttttgtgcgagaaaaacagcaggagatgtaagtggagataacagaggatatttttttgacttatggggaagaggaagcagagtaatagtatcaagtgca

SEQ ID NO: 48723 - RNA, 420 nt, synthetic construct
  misc_feature 1..420: note = derived and/or modified sequence opt6 from anti-HIV-1_HeavyChain
  source 1..420: mol_type = other RNA
caatcacacttagaacaaagcggaagtgcaatgaaaaaaccaggagcatcagtaagagtaagctgttggacaagcgaagacatattcgatacaacagaattgctatgggtaagacaagcaccaggacaaggactagaatggataggatgggtaaaaatagtaagcggaacagtaaactttgcatcattagatttcagaaacagaatatcactatcaagagatagagatctatcaacagcacacatggatataagaggactaacacaagatgacacagcaacatactattgcgcaagacaaaaatttgcatcaagatatagtggagaccaaggatcatactttgacttatggggaagaggaacattaataatagtatcaagcgcaagcacaaaaggaccatcagtatttccacatgactta

SEQ ID NO: 48724 - RNA, 417 nt, synthetic construct
  misc_feature 1..417: note = derived and/or modified sequence opt6 from anti-HIV-1_HeavyChain
  source 1..417: mol_type = other RNA
caaagccatttagaacaaagtggaagcgcaatgaaaaaaccaggagcaagtgtaagagtaagttgttggacaagtgaagatatatttgaaagaacagaattaatatattgggtaagacaagcaccaggaagaggattagaatggataggatgggtaaaaacagtaagtggaacagtaaattttggaagtagtgattttagaaatagaataagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagtgcaagtacaaatggaccaataggattaccaccaagaagtgca

SEQ ID NO: 48725 - RNA, 423 nt, synthetic construct
  misc_feature 1..423: note = derived and/or modified sequence opt6 from anti-HIV-1_HeavyChain
  source 1..423: mol_type = other RNA
caagcacatttagaacaatcaggaagtggagtaaaaaaaccaggagcaagtgtaagagtaagttgttggacaagtgaagatatatttgaaaaaagtgaattaatacattgggtaaggcaagcaccaggacaaggattagaatggataggatgggtaaaaacagtaacaggagcagtaaattttggaagtagcgattttagacaaagagtatcattaacaagagatagagatttatttacagcacatatggatataagaggattaacacaaggagatacagcaacatatttttgtgcaagacaaaaatttgaatcattatatagcgatgatcaaggaagttattttgatctatggggaagaggaacactaataatagtaagtagtgcaagtacaaaaggaccaagtagttcaccaacaatatgt

SEQ ID NO: 48726 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaaccaggagcaagtgtaagggtaagttgctggacaagtgaagatatattcgaaagaacagaattaatacattgggtaagacaagcaccaggacaaggattagaatggataggatgggtaaaaacagtaagtggagcagtaaattttggaagtccaaattttagacatagagtaagcttaacaagagatagagatttatttacagcacatatggatataagagggttaacacaaggagatacagcaacatatttttgtgcaagacaaaaatttgaaagaggaggacaaggatggtattttgatttatggggaagaggaacattaatagtagtaagtagtgcaagtacaaaaggaccaagtgtatttccacatgatttaaga

SEQ ID NO: 48727 - RNA, 411 nt, synthetic construct
  misc_feature 1..411: note = derived and/or modified sequence opt6 from anti-HIV-1_HeavyChain
  source 1..411: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaagtggagcagtaaattttggaagtccaaattttagacatagagtaagtttaacaagagatagagatttatttacagcacatatggatataagaggattgacacaaggagatacagcaacatatttttgtgcaagacaaaaatttgaaagaggaggacaaggatggtattttgatttatggggaagaggaacattaatagtagtaagttcaagtttacatcaaggaccaagtggattaccacatgat

SEQ ID NO: 48728 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagcggagtaaaaaaaccaggggcaagtgtaagagtaagttgttggacaagtgaagatatatttgaaaaaagtgaattaatacattgggtaagacaagcaccaggacaaggactagaatggataggatgggtaaaaacagtaacaggagcagtaaattttggaagtagtgatttcagacaaagagtaagtttaacaagagatagagatttatttacagcacatatggatataagaggattaacgcaaggagatacagcaacatatttttgtgcaagacaaaaattttatgcaggaggacaaggatggtattttgatttatggggaagaggaacattaatagtagtaagtagtgcaagtacaaaaggaccaagtgtatttccacatgatttaaga

SEQ ID NO: 48729 - RNA, 426 nt, synthetic construct
  misc_feature 1..426: note = derived and/or modified sequence opt6 from anti-HIV-1_HeavyChain
  source 1..426: mol_type = other RNA
caagcacatttagaacaaagtggaagcggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaagtggagcagtaaattttggaagtccaaattttagacatagagtaagtttaacaagagacagagatttatttacagcacatatggatataagaggattaacacaaggagatacagcaacatattattgtgcaagacaaaaatttgaaagtttatatagtgatgatcaaggatcatattttgatttatggggaagaggaacattaataatagtaagtagtgcatcaacaaaaggaccaagcgtatttccacatgatctaaga

SEQ ID NO: 48730 - RNA, 384 nt, synthetic construct
  misc_feature 1..384: note = derived and/or modified sequence opt6 from anti-HIV-1_HeavyChain
  source 1..384: mol_type = other RNA
caagtacatttagaacaaagtggaagtggagtaaaaaaaccaggagcaagtgtaagagtaagttgttggacaagtgaagatatatttgaaaaaagtgaattaatacattgggtaagacaagcaccaggacaaggattagaatggataggatgggtaaaaacagtaacaggagcagtaaattttggaagtagtgattttagacaaagagtaagtttaacaagagatagagatttatttacagcacatatggatataagaggattaacacaaggagatacagcgacatatttttgtgcaagacaaaaatttgaaagtagatatacaggaggacaaggatggtattttgatttatggggaagaggaacacatatagtagtaagtagt

SEQ ID NO: 48731 - RNA, 423 nt, synthetic construct
  misc_feature 1..423: note = derived and/or modified sequence opt6 from anti-HIV-1_HeavyChain
  source 1..423: mol_type = other RNA
caagtatatatggaacaagcaggagcaggagtaaaaaaaccaggagcaagtgtaacattaagctgtaaaacagcagatgaagatgtatttgatgcagcatatatgcattgggtaagacaagcaccaggacaaacatttgaatggttaggatggatgaaaccagtaacaggagcagtaaattatgcaagaaaatttcaaggaagagtaagcttttatagaacaagagaactaggaatagcatatatggatttaagaaatttaagatttgatgatacagcagtatatttttgtgcaagaaaaacagcaggagatgtaagtggagataaaagaggatttttttttgatttatggggaagaggaagtagagtaatagtaagtagtgcaagtacaaaaggaccaagtgtatttccacatgatttaaga

SEQ ID NO: 48732 - RNA, 414 nt, synthetic construct
  misc_feature 1..414: note = derived and/or modified sequence opt6 from anti-HIV-1_HeavyChain
  source 1..414: mol_type = other RNA
caagcacatttagaacaatcaggatcaggagtaaaaaaaccaggaacatcagtaagagtatcatgttggacatcagaagatatatttgaaagaacagaattaatacattgggtaagacaagcaccaggacaaggattagaatggataggatgggtaaaaacagtaacaggagcagtaaattttggatcaccaaattttagacatagagtatcattaacaagagatagagatttatttacagcacatatggatataagaggactaacacaaggagatacagcaacatatttttgtgcaagacaaaaatttgcaagaggagatcaaggatggttttttgatttatggggaagaggaacattaatagtagtaagttcagcatcaacaaaaggaccaagtgtatttccaacaatatgt

SEQ ID NO: 48733 - RNA, 411 nt, synthetic construct
  misc_feature 1..411: note = derived and/or modified sequence opt6 from anti-HIV-1_HeavyChain
  source 1..411: mol_type = other RNA
caagtacaattagtacaaagtggagcagaagtaaaaaaaccaggagcaagtgtaaaagtaagttgtaaagcaagtggatatacatttacaagttattatatgcattgggtaagacaagcaccaggacaaggattagaatggataggatgggtaaaaccagtgacaggagcagtaaattttggatcaccaaattttagacatagagtatcattaacaagagatagagatttatttacagcacatatggatataagaggattaacacaaggagatacagcaacatatttttgtgcaagacaaaaatattatgcaggagggcaaggatggtattttgatctatggggaagaggaacactaatagtagtaagttcagcatcaacaaaaggaccagtagtatttccaacaatatgt

SEQ ID NO: 48734 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggaggaggagtaaaaaaaccaggagcaagtgtaacattaagttgtaaaacagcagatgaagatgtatttgatgcagcatatatgcattgggtaagacaagcaccagggcaaacatttgaatggttaggatggatgaaaccagtaacaggagcagtaaattatgcaagaaaatttcaaggaagagtaagtttttatagaacaagagaattaggaatagcatatatggatttaagaaatttaagatttgatgatacagcagtatatttttgtgcaagaaaaacagcaggagatgtaagtggagataaaagaggatttttttttgatttatggggaagaggaagtagagtaatagtaagtagt

SEQ ID NO: 48735 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagcgtaagagtaagctgttggacaagtgaagatatatttgaaagaacagaattaatacattgggtaagacaagcaccaggacaaggattagaatggataggatggataaaaacagtaacaggagcagtaaattttggaagtttagattttagacatagaataagtttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagt

SEQ ID NO: 48736 - RNA, 420 nt, synthetic construct
  misc_feature 1..420: note = derived and/or modified sequence opt6 from anti-HIV-1_HeavyChain
  source 1..420: mol_type = other RNA
caaagccatttagaacaatcaggatcagcaatgaaaaaaccaggagcatcagtaagagtatcatgctggacatcagaagatatatttgaaagaacagaattaatatactgggtaagacaagcaccaggaagaggactagaatggataggatgggtaaaaacagtaagcggaacagtaaactttggatcaagtgatttcagaaacagaatatcactaacaagagatagagatctaagtacagcacacatggacataagaggactaacacaagatgacacagcaacatatttttgcgcaagacaaaaatttgaaagaggaggacaaggatggtatttcgatctatggggaagaggaacactaatagtagtaagttcagcatcaacagaaggaccaagcagaagttttccacaaatattaaga

SEQ ID NO: 48737 - RNA, 414 nt, synthetic construct
  misc_feature 1..414: note = derived and/or modified sequence opt6 from anti-HIV-1_HeavyChain
  source 1..414: mol_type = other RNA
caagcacatttagaacaatcaggatcaggagtaaaaaaaccaggagcatcagtaagagtatcatgttggacatcagaagatatatttgaaaaaagtgaattaatacattgggtaagacaagcaccaggacaaggattagaatggataggatgggtaaaaacagtaacaggagcagtaaattttggatcaagtgattttagacaaagagtatcattaacaagagatagagatttatttacagcacatatggatataagaggattaacacaaggagatacagcaacatatttttgtgcaagacaaaaattttatgcaggaggacaaggatggtattttgatttatggggaagaggaacattaatatgtgtaagttcagcatcaccaagagcacatagatcaagcccaagatcagca

SEQ ID NO: 48738 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagtgtaagagtaagttgttggagtagtgaagatatatttgaaagaacagaattaatacattgggtaagacaagcaccaggacaaggattagaatggataggatgggtaaaaacagtgacaggagcagtaaattttggaagtctagattttagacatagaataagtttaacaagagatagagatttatttacagcacatatggatataagaggattaacaagaggagatacagcaacatattattgtgcaagacaaaaatttgaaagtagatatacaggaggacaaggatggtattttgatttatggggaagaggaacacatatagtagtaagtagt

SEQ ID NO: 48739 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagcgggagtggagtaaaaaaaccaggagcaagtgtaagagtaagttgttggagtagtgaagatatatttgaaagaacagaattaatacattgggtaagacaagcaccaggacaaggattagaatggataggatgggtaaaaacagtaacaggagcagtaaattttggaagtttagattttagacatagaataagtttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatataatagtaagtagt

SEQ ID NO: 48740 - RNA, 423 nt, synthetic construct
  misc_feature 1..423: note = derived and/or modified sequence opt6 from anti-HIV-1_HeavyChain
  source 1..423: mol_type = other RNA
caaagccatctagaacaatcaggatcagcaatgaaaaaaccaggagcatcagtaagagtatcatgctggacatcagaagatatatttgacacaacatcaatatttataggatgcgatagaccactagataaagattggtcaggattaggaggaagcaaactatcactagcaccatctatatttgcatcactagatttcagaaacagaatatcactatcaagagatagagatttatcaacagcatacatggacataagaggactaacacaagatgacacagcaacttacttctgcgcaagacaaaaatttgcatcaagatatagcggagaccaaggatcatactttgacttatggggaagaggaacattaatagtagtatcaagcgcaagcacaaaaggaccatcagtatttccacatgactta

SEQ ID NO: 48741 - RNA, 399 nt, synthetic construct
  misc_feature 1..399: note = derived and/or modified sequence opt6 from anti-HIV-1_HeavyChain
  source 1..399: mol_type = other RNA
agagaatatttagaacaaagtgggggaggagtaaaaaaattaggagcaagtgtaagagtaagttgtagagcaagtgaagatttatttggagatgaagtaatatatgatgatgaattaatacattggttaagacaagtaccaggacaaagaccagaatggatgggatggataagaccaaaaacaggagcaagaaatcaagcaagacaatttcaaccaagaataaatttaagtagagatagagcattaaatacagcatatttagatttaagtagtttaacaagtgcagatagtgcaacatatttttgtgcaagacaaacatttaaaccagatttttattttgcagatcaaggatggagttttaatttatggggaagaggagcaagagtaatagtaagtagt

SEQ ID NO: 48742 - RNA, 384 nt, synthetic construct
  misc_feature 1..384: note = derived and/or modified sequence opt6 from anti-HIV-1_HeavyChain
  source 1..384: mol_type = other RNA
caagtacatttagtacaaagtggagcagaagtaaaaaaaccaggaagtagtgtaagagtaagttgttggacaagtgaagatatatttgaaagaacagaattaatacattgggtaagacaagcaccaggacaaggattagaatggataggatgggtaaaaacagtaacaggagcagtaaattttggaagtccaaattttagacatagagtaagtttaacaagagacagagatttatttacagcacatatggatataagaggattaacacaaggagatacagcaacatatttttgtgcaagacaaaaatttgaaagtagatatagtggagatcaaggaagttattttgatctatggggaagaggaacattaataatagtaagcagt

SEQ ID NO: 48743 - RNA, 414 nt, synthetic construct
  misc_feature 1..414: note = derived and/or modified sequence opt6 from anti-HIV-1_HeavyChain
  source 1..414: mol_type = other RNA
caagcacatttagaacaaagcggaagtggagtaaaaaaaccaggagcaagtgtaagagtaagttgttggacaagtgaagatatatttgaaagaacagaactaatacattgggtaagacaagcaccaggacaaggattagaatggataggatgggtaaaaatagtaagtggagcagtaaattttggaagcccaaattttagacaaagagtaagtttaacaagagatagagatttatttacagcacatatggatataagaggattaacacaaggagatacagcaacatatttttgtgcaagacaaaaatttgaaagaggaggacaaggatggatatttgatttatggggaagaggaacattaatagcggtaagtagtgcaagtacaaaaggaccaagtgtatttccaacaatatgt

SEQ ID NO: 48744 - RNA, 441 nt, synthetic construct
  misc_feature 1..441: note = derived and/or modified sequence opt6 from anti-HIV-1_HeavyChain
  source 1..441: mol_type = other RNA
agagaatttctagaacaatcaggaggaggagtaaaaaaactaggagcatcactaagagtatcatgcagagcatcagaagatctatttggagatgaatttatatatgacgatgaagtaatacattggttaagacaagtaccaggacaaagaccagaatggatgggatggataagaccaaaaacaggagcaagaaatcaagcaacacaattccaaccaagaatatcgctaacaagagatagagcactatcaacagcatacttagacttaaactcactaacaagcgcagactcaggaacatacttttgcgcaagacaaacatttaaaccagacttttactttgcagatcaaggatggtcattcaatttatggggaagaggagcacacttcatagtaagttcagcatcaacaaaaggaccaagcgtattcccacacgatagcgca

SEQ ID NO: 48745 - RNA, 399 nt, synthetic construct
  misc_feature 1..399: note = derived and/or modified sequence opt6 from anti-HIV-1_HeavyChain
  source 1..399: mol_type = other RNA
agagaatatctagaacaatcaggaggaggagtaaaaaaactaggagcatcactaagagtatcatgcagagcatcagaagatctatttggagatgaaataatatatgacgatgaagtaatacattggttaagacaagtaccaggacaaagaccagaatggatgggatggataagaccaaaaacaggagcaagaaatcaagcaagacaattccaaccaagaatatcactaacaagagatagagcactaagtacagcatacttagacttaaactcattaacaagtgcagactcaggaacatacttttgcgcaagacaaacatttaaaccagacttttactttgcagatcaaggatggtcattcaatctatggggaagaggagcacactttatagtaagctca

SEQ ID NO: 48746 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagtgtaagagtaagttgttggagtagtgaagatatatttgaaagaacagaattaatacattgggtaagacaagcaccaggacaaggattagaatggataggatgggtaaaaacagtaacaggagcagtaaattttggaagtttagattttagacatagaataagtttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagt

SEQ ID NO: 48747 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggaggaggagtaaaaaaaccaggagcaagtgtaacattaagttgtaaaacagcagatgaagatgtatttgatgcagcatatatgcattgggtaagacaagcaccaggacaaacatttgaatggttaggatggatgaaaccagtaacaggagcagtaagttatgcaagaaaatttcaaggaagagtaagtttttatatgacaagagaattaggaatggcatatatggatttaagaaatttaagatttgatgatacagcagtatatttttgtgcaagaaaaacagcaggagatgtaagtggagataatagaggatatttttttgatttatggggaagaggaagtagagtaatagtaagtagt

SEQ ID NO: 48748 - RNA, 414 nt, synthetic construct
  misc_feature 1..414: note = derived and/or modified sequence opt6 from anti-HIV-1_HeavyChain
  source 1..414: mol_type = other RNA
caagcacatttagaacaatcaggaacaggagtaaaaaaaccaggggcatcagtaagagtatcatgttggacatcagaagatatatttgaaaaaagtgaattaatacattgggtaagacaagcaccaggacaaggattagaatggataggatgggtaaaaatagtaagtggagcagtaaattttggatcaccaaattttagacaaagagtatcattaacaagagatagagatttatttacagcacaaatggatataagaggattaacacaaggagatacagcaacatatttttgtgcaagacaaaaatttgaaagaggaggacaaggatggatatttgatctatggggaagaggaacattaatagcagtaagttcagcatcaacaaaaggaccaagtgtatttccacatgatcta

SEQ ID NO: 48749 - RNA, 399 nt, synthetic construct
  misc_feature 1..399: note = derived and/or modified sequence opt6 from anti-HIV-1_HeavyChain
  source 1..399: mol_type = other RNA
caagcacatttagaacaaagtggaagtggagtaaaaaaattaggggcaagtgtaagagtaagttgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagtttaacaagagatagagatttaagtacagcgcatatggatataagaggattaacacaagatgatacagcaacatatttttgtgcaagacaaaaatttgcaagaggagatcaaggatggttttttgatttatggggaagaggaacattaatagtagtaagtagcgcaagtacaaaaggaccaagtgga

SEQ ID NO: 48750 - RNA, 414 nt, synthetic construct
  misc_feature 1..414: note = derived and/or modified sequence opt6 from anti-HIV-1_HeavyChain
  source 1..414: mol_type = other RNA
caagcacatttagaacaatcaggatcaggagtaaaaaaaccaggagcatcagttagagtatcatgttggacatcagaagatatatttgaaagaacagaattaatacattgggtaagacaagcaccaggacaaggattagaatggataggatgggtaaaaacagtaacaggagcagtaaattttggaagcccaaattttagacatagagtatcattaacacatgatagagatttatttacagcacatatggatataagaggattaacacaaggagatacagcaacatatttttgtgcaagacaaaaattttatgcaggaggacaaggatggtattttgatttatggggaagaggaacattaatatgtgtaagttcagcatcaacaaaaggaccaagtggattaccaccaagaagt

SEQ ID NO: 48751 - RNA, 426 nt, synthetic construct
  misc_feature 1..426: note = derived and/or modified sequence opt6 from anti-HIV-1_HeavyChain
  source 1..426: mol_type = other RNA
caagcacatttagaacaaagcggaagtggagtaaaaaaattaggggcatcagtaagagtaagttgttggacaagtgaagatatatttgaacgaacagaattaatacattgggtaagacaagcaccaggacaaggattagaatggataggatgggtaaaagcagtatcaggagcagtaaattatggaagcttagattttagacatagagtaagtctaacaagagatagagatttaagcacagcacatatggatataagaggattaacacaagatgatacagcaacatatttttgtgcaagacaaaaatttgaaagtttatatagtgatgatcaaggaagttattttgatttatggggaagaggaacattaataatagtaagtagtgcaagtacaaaaggaccaagtgtatttccacatgatttaaga

SEQ ID NO: 48752 - RNA, 414 nt, synthetic construct
  misc_feature 1..414: note = derived and/or modified sequence opt6 from anti-HIV-1_HeavyChain
  source 1..414: mol_type = other RNA
caagcacatttagaacaaagtggaagcggagtaaaaaaaccaggagcaagcgtaagagtaagctgttggacaagtgaagatatatttgaaagaacagaattaatacattgggtaagacaagcaccaggacaaggattagaatggataggatgggtaaaaacagtaagtggagcagtaaattttggaagtccaaattttagacatagagtaagcctaacaagagatagagatttatttacagcacatatggatataagaggattaacacaaggagatacagcaacatattattgtgcaagacaaaaatttgaaagaggaggacaaggatggtattttgatttatggggaagaggaacattaatagtagtaagtagtgcaagcacaaaaggaccaagtgtatttccaacaatatat

SEQ ID NO: 48753 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagtgtaagagtaagttgttggagtagtgaagatatatttgaaagaacagaattaatacattgggtaagacaagcaccaggacaaggattagaatggataggatgggtaaaaacagtaacaggagcagtaaattttggaagtttagattttagacatagaataagtttaacaagagatagagatttatttacagcacatatggatataagaggattaacacaaggagatacagcaacatattattgtgcaagacaaaaatttgaaagtagatatacaggaggacaaggatggtattttgatttatggggaagaggaacacatatagtagtaagtagt

SEQ ID NO: 48754 - RNA, 414 nt, synthetic construct
  misc_feature 1..414: note = derived and/or modified sequence opt6 from anti-HIV-1_HeavyChain
  source 1..414: mol_type = other RNA
caagcacatctagaacaaagtggaagtggagtaaaaaaaccaggagcaagtgtaagagtaagttgttggacaagtgaagatatatttgaaggaagtgaattaatacattgggtaagacaagcaccaggacaaggattagaatggataggatgggtaaaaacagtaacaggagcagtaaattttggaagtgcatattttagacatagagtaagcttaacaagagatagagatttatttacagcacatatggatataagaggattaacacaaggagatacagcaacatattattgtgcaagacaaaaattttataaaggaggacaaggatggtattttgatttatggggaagaggaacattaatagtagtaagtagtgcaagcacaaaaggaccaagtgtatttccaacaatatgt

SEQ ID NO: 48755 - RNA, 399 nt, synthetic construct
  misc_feature 1..399: note = derived and/or modified sequence opt6 from anti-HIV-1_HeavyChain
  source 1..399: mol_type = other RNA
agagaatatctagaacaatcaggaggaggagtaaaaaaaccaggagcatcagtaagagtatcatgcagagcatcagaagatctatttggagatgaaataatatatgacgatgaagtaatacattggttaagacaagtaccaggacaaagaccagaatggatgggatggataagaccaaaaaatggaggaagaaatcaagcaagacaattccaaccaagaatatcactaacaagagatagagcactaaatacagcatacttagacttaaactcattaacaagcgcagactcaggaacatacttttgcgcaagacaaacatttaaaccagacttttactttgcagatcaaggatggtcattcaatctatggggaagaggagcaagagtaatagtaagttca

SEQ ID NO: 48756 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaattaggagcaagcgtaagagtaagttgttggacaagtgaagatatatttgaaagaacagaattaatacattgggtaagacaagcaccaggacaaggattagaatggataggatgggtaaaagcagtaagcggagcagtaaattatggaagtttagattttagacatagagtaagtttaacaagagatagagatttaagtacagcacatatggatataagaggattaacacaagatgatacagcaacatatttttgtgcaagacaaaaatttgcaagaggagatcaaggatggttttttgatttatggggaagaggaacattaatagtagtaagtagc

SEQ ID NO: 48757 - RNA, 420 nt, synthetic construct
  misc_feature 1..420: note = derived and/or modified sequence opt6 from anti-HIV-1_HeavyChain
  source 1..420: mol_type = other RNA
caagtatatatggaacaagcaggaggaggagtaaaaaaaccaggagcaagtgtaacactaagctgtaaaacagcagatgaagatgtatttgatgcagcatatatgcattgggtaagacaagcaccaggacaaacatttgaatggttaggatggatgaaaccagtaacaggagcagtaagttatgcaagaaaatttcaaggaagagtaagtttttatatgacaagagaattaggaatggcatatatggatttaagaaatttaagatttgatgatacagcagtatatttttgtgcaagaaaaacagcaggagatgtaagtggagataatagaggatatttttttgatttatggggaagaggaagtagagtaatagtaagtagtgcaagtacaaaaggaccaagtgtatttccgacaatatgt

SEQ ID NO: 48758 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaaccaggagcaagtgtaagagtaagctgttggacaagtgaagatatatttgaaggaagtgaactaatacattgggtaagacaagcaccaggacaaggactagaatggataggatgggtaaaaacagtaacaggagcagtaaattttggaagcgcatattttagacatagagtaagtttaacaagagatagagatttatttacagcacatatggatataagaggattaacacaaagtgatacagcaacatatttttgtgcaagacaaaaattttatgcaggaggacaaggatggtattttgatttatggggaagaggaacattaatagtagtaagtagtgcaagtacaaaaggaccaagtgtatttccacatgatttaaga

SEQ ID NO: 48759 - RNA, 426 nt, synthetic construct
  misc_feature 1..426: note = derived and/or modified sequence opt6 from anti-HIV-1_HeavyChain
  source 1..426: mol_type = other RNA
caaagccatctagaacaatcaggatcagcaatgaaaaaaccaggagcatcagtaagagtatcatgctggacatcagaagatatatttgaaagaacagaactaatatactgggtaagacaagcaccaggaagaggactagaatggataggatgggtaaaaacagtaagcggaacagtaaactttggctcaagcgatttcagaaacagaatatcactaacaagagatagagatctatcaacagcacacatggacataagaggactaacacaagatgacacagcaacatacttttgcgcaagacaaaaatttgaatcactatatagtgatgaccaaggatcatactttgacttatggggaagaggaacattaataatagtatcaagcgcaagtccaaaaggaccatcaggattaccaccaagatcagca

SEQ ID NO: 48760 - RNA, 411 nt, synthetic construct
  misc_feature 1..411: note = derived and/or modified sequence opt6 from anti-HIV-1_HeavyChain
  source 1..411: mol_type = other RNA
caagtacaattagtacaatcaggagcagaagtaaaaaaaccaggagcatcagtaaaagtatcatgtaaagcatcaggatatacatttacaacatatggaatatcatgggtaagacaagcaccaggacaaggattagaatggataggatgggtaaaaacagtaacaggagcagtaaattttggacatcaaatatcagatagagtatcattaacaagagatagagatttatttacagcacatatggatataagaggattaacacaaggagatacagcaacatatttttgtgcaagacaaaaattctatgcaggaggacaaggatggtattttgatttatggggaagaggaacattaatagtagtaagttcagcatcaacaaaaggaccaagtgtatttccacatgatttaaga

SEQ ID NO: 48761 - RNA, 417 nt, synthetic construct
  misc_feature 1..417: note = derived and/or modified sequence opt6 from anti-HIV-1_HeavyChain
  source 1..417: mol_type = other RNA
caagcacaattagaacaaagtggaagtggagtaaaaaaaccaggagcaagtgtaagagtaagttgttggacaagtgaagatatatttgaaagaacagaattaatacattgggtaagacaagcaccaggacaaggactagaatggataggatgggtaaaaacagtaacaggagcagtaaattttggaagtagtgattttagacaaagagtaagtttaacaagagatagagatttatttacagcgcatatggatataagaggattaacacaaggagatacagcaacatatttttgtgcaagacaaaaattttatgcaggaggacaaggatggtattttgatttatggggaagaggaacattaatagtagtaagtagtgcaagcacaaaaggaccaagtgtatttccacatgatttaaga

SEQ ID NO: 48762 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagctgttggacaagtgaagatatatttgaaagaacagaattaatacattgggtaagacaagcaccaggacaaggattagaatggataggatgggtaaaaacagtaacaggagcagtaaattttggaagtccaaattttagacatagagtaagtttaacaagagatagagatttatttacagcacatatggatataagaggattaacacaaggagatacagcaacatattactgtgcaagacaaaaatttgaaagaggaggacaaggatggtattttgatttatggggaagaggaacattaatagtagtaagtagt

SEQ ID NO: 48763 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagtgtaagagtaagttgttggacaagtgaagatatatttgaaaaaagtgaattaatacattgggtaagacaagcaccaggacaagggttagaatggataggatgggtaaaaacagtaacaggagcagtaaattttggaagtagtgattttagacaaagagtaagtctaacaagagatagagatttatttacagcacatatggatataagaggactaacacaaggagatacagcaacatattattgtgcaagacaaaaatttgaaagtaggtatacaggaggacaaggatggtattttgatttatggggaagaggaacacatatagtagtaagtagt

SEQ ID NO: 48764 - RNA, 414 nt, synthetic construct
  misc_feature 1..414: note = derived and/or modified sequence opt6 from anti-HIV-1_HeavyChain
  source 1..414: mol_type = other RNA
caagcacatttagaacaaagtggaagtggagtaaaaaaaccaggagcaagtgtaagagtaagttgttggacaagcgaagatatatttgaaagaacagaattaatacattgggtaagacaagcaccaggacaaggattagaatggataggatgggtaaaaacagtaacaggagcagtaaattttggaagtccaaactttagacatagagtaagcttaacaagagatagagatttatttacagcacatatggatataagaggattaacacagggagatacagcaacatatttttgtgcaagacaaaaatttgaaagaggaggacaaggatggtattttgatttatggggaagaggaacattaatagtagtaagtagtgcaagtacaaaaggaccaagtgtatttccaacaatatgt

SEQ ID NO: 48765 - RNA, 381 nt, synthetic construct
  misc_feature 1..381: note = derived and/or modified sequence opt6 from anti-HIV-1_HeavyChain
  source 1..381: mol_type = other RNA
caagtacaattagtacaatcaggagcagaagtacaaaaaccaggagcatcagtaacagtatcatgcaaagcatcaggatatacactaatatcatacggaatatcatgggtgagacaagcaccaggacaaggaccagaatggatgggatggataagaccaaaaacaggagcaagaaatcaagcaagacaattccaaccaagaatatcactaacaagagatagagcactatcaacagcatacttagacttaaactcactaacaagcgcagactcaggaacatacttttgcgcaagacaaacatttaaaccagacttttactttgcagatcaaggatggtcattcaatttatggggaagaggagcacactttatagtaagctca

SEQ ID NO: 48766 - RNA, 414 nt, synthetic construct
  misc_feature 1..414: note = derived and/or modified sequence opt6 from anti-HIV-1_HeavyChain
  source 1..414: mol_type = other RNA
caagcacatttagaacaaagtggaagtggagtaaaaaaaccaggagcaagtgtaagagtaagttgttggacaagtgaagatatattaagaaaaaaagaattaatacattgggtaagacaagcaccaggacaaggattagaatggataggatgggtaaaaacagtaacaggaacagtaaattttggaagtagtgattttagacaaagagtatcactaacaagagatagagatttatttacagcacatatggatataagaggattaacacaaggagatacagcaacatatttatgtgcaagacaaaaatttgaaaggggaggacaaggatggatatttgatctatggggaagaggaacattaatagcagtaagtagcgcaagcacaaaaggaccaagtgtatttccacatgattta

SEQ ID NO: 48767 - RNA, 426 nt, synthetic construct
  misc_feature 1..426: note = derived and/or modified sequence opt6 from anti-HIV-1_HeavyChain
  source 1..426: mol_type = other RNA
caagcacatttagaacaaagtggaagtggagtaaaaaaaccaggagcaagtgtaagagtaagttgttggtcaagcgaagatatatttgaaagaacagaattaatacattgggtaagacaagcaccaggacaaggattagaatggataggatgggtaaaaacagtaacaggagcagtaaattttggaagcttagattttagacatagaataagtttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagtgcaagtacaaatggaccaataggattaccacatagaagtgca

SEQ ID NO: 48768 - RNA, 384 nt, synthetic construct
  misc_feature 1..384: note = derived and/or modified sequence opt6 from anti-HIV-1_HeavyChain
  source 1..384: mol_type = other RNA
caagcacatctagaacaaagtggatcaggagtaaaaaaaccaggagcaagtgtaagagtaagttgttggacaagtgaagatatatttggaaaaagtgaattaatacattgggtaagacaagcaccaggacaaggattagaatggataggatgggtaaaaacagtaacaggagcagtaaattttggaagcagcgattttagacaaagagtaagtttaacaagagatagagatttatttacagcacatatggatataagaggattaacacaaggagatacagcaacatatttttgtgcaagacaaaaatttgaaagtttatatagtgatgatcaagggagttattttgatttatggggaagaggaacactaataatagtaagtagt

SEQ ID NO: 48769 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagcggaagtggagtaaaaaaaccaggagcaagtgtaagagtaagttgttggacaagtgaagatatatttgaaagaacagaattaatacattgggtaagacaagcaccaggacaaggactagaatggataggatgggtaaaaatagtaagtggagcagtaaattttggaagtccaaattttagacaaagagtaagtttaacaagagatagagatttatttacagcacatatggatataagaggattaacacaaggagatacagcaacgtatttttgtgcaagacaaaaatttgaaagaggaggacaaggatggtattttgatttatggggaagaggaacattaatagtagtaagtagtgcaagtacaaaaggaccaagtggattaccacatggaagtgca

SEQ ID NO: 48770 - RNA, 423 nt, synthetic construct
  misc_feature 1..423: note = derived and/or modified sequence opt6 from anti-HIV-1_HeavyChain
  source 1..423: mol_type = other RNA
caagtacaatatggaagagaagcaggagcaggaatgaaaaagccaggagcaagtatgacagtaagttgtaaaacagcagatgaagatatatttgatgcagcatatatgcatagagtaagacaagcaccaggacaaacatttgaatggttaggatggatgaaaccagtaacaggagcagtaaattatgcaagacaatttcaaggaagggtaagtttttatagaacaagagaattaggaatagcatatatggatttaagagatttaaaatttgatgatacagcagtatatttttgtgcaagaaaaacaaaaggagatgtaagtggagatgatagaggatttttttttgatttatggggaagaggaacaagagtaatagtaagtagcgcaagcacaaaaggaccaagtgtatttccaacaatatat

SEQ ID NO: 48771 - RNA, 426 nt, synthetic construct
  misc_feature 1..426: note = derived and/or modified sequence opt6 from anti-HIV-1_HeavyChain
  source 1..426: mol_type = other RNA
caagcacatttagaacaaagcggaagcggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagtttagattttagacatagaataagtctaacaagagatagagatttatttacagcacatatggatataagaggattaacacaaggagatacagcaacatatttttgtgcaagacaaaaatttgaaagtagatatacaggaggacaaggatggtattttgatctatggggaagaggaacacatatagtagtaagttcagcaagtacgaaaggaccaagtgtatttccacatgatttaaga

SEQ ID NO: 48772 - RNA, 423 nt, synthetic construct
  misc_feature 1..423: note = derived and/or modified sequence opt6 from anti-HIV-1_HeavyChain
  source 1..423: mol_type = other RNA
caagtacaactagtacaatcagaagcagaattaaaaaaaccaggagcatcagtatcagtatcatgcaaagcatcaggatattcatttacatcatacggaatatcatgggtaagacaagtaccaggacaaggactagaatggatagcatggataagaccaaaaacaggagcaagaaatcaagcaagacaattccaaccaagaatatcactaacaagagatagagcactatccacagcatacttagacttaaactcactaacatcagcagactcaggaacatacttttgcgcaagacaaacatttaaaccagacttttactttgcagatcaaggatggtcattcaatctatggggaagaggagcacattttatagtatcatcagcatcaacaaaaggaccaagcgttttcccacacgatctaaga

SEQ ID NO: 48773 - RNA, 414 nt, synthetic construct
  misc_feature 1..414: note = derived and/or modified sequence opt6 from anti-HIV-1_HeavyChain
  source 1..414: mol_type = other RNA
caagcacatttagaacaaagtggaagtggagtaaaaaaaccaggagcaagtgtaagagtaagctgttggacaagtgaagatatatttgaaagaacagaattaatacattgggtaagacaagcaccaggacaaggactagaatggataggatgggtaaaaacagtaacaggagcagtaaattttggaagtccaaattttagacatagagtaagtttaacaagagatagagatttatttacagcacatatggatataagaggattaacacaaggagatacagcaacatattattgcgcaagacaaaaatttgaaagaggaggacaaggatggtattttgatctatggggaagaggaacactaatagtagtaagtagtgcaagtacaaaaggaccaagtgtatttccacatgattta

SEQ ID NO: 48774 - RNA, 381 nt, synthetic construct
  misc_feature 1..381: note = derived and/or modified sequence opt6 from anti-HIV-1_HeavyChain
  source 1..381: mol_type = other RNA
caagtacaattagtacaatcaggagcagaagtacaaaaaccaggagcatcagtaacagtatcatgcaaagcatcaggatatacactaatatcatacggaatatcatgggtaagacaagccccaggacaaggaccagaatggatgggatggataagaccaaaaacaggagcaagaaatcaagcaagacaattccaaccaagaatatcattaacaagagatagagcactatcaacagcatacctagacttaaactcactaacaagcgcagactcaggaacatactattgcgcaagacaaacatttaaaccagacttttactttgcagatcaaggatggtcattcaatttatggggaagaggagcacactttatagtaagctca

SEQ ID NO: 48775 - RNA, 414 nt, synthetic construct
  misc_feature 1..414: note = derived and/or modified sequence opt6 from anti-HIV-1_HeavyChain
  source 1..414: mol_type = other RNA
caagcacatttagaacaaagcggaagtggagtaaaaaaattaggagcaagtgtaagggtaagctgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagtttaacaagagatagagatttatttacagcacatatggatataagaggattaacacaagatgatacagcaacatatttttgtgcaagacaaaaatttgcaagaggagatcaaggatggttttttgatttatggggaagaggaacattaatagtagtaagtagcgcaagtacgaaaggaccaagtgtatttccacaaatatgt

SEQ ID NO: 48776 - RNA, 378 nt, synthetic construct
  misc_feature 1..378: note = derived and/or modified sequence opt6 from anti-HIV-1_HeavyChain
  source 1..378: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagtccaaattttagacatagagtaagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatatgtgtaagtagcgca

SEQ ID NO: 48777 - RNA, 438 nt, synthetic construct
  misc_feature 1..438: note = derived and/or modified sequence opt6 from anti-HIV-1_HeavyChain
  source 1..438: mol_type = other RNA
caaggatacttagcacaaagcggaggaggagtaaaaaaaccaggaacaagcgcaagctttagctgtagaacaagtgatgacatatacgataacgaattctttgactcagcatttatgcattgggtaagattaataccaggacaaagaccagaatggatgggatggatgaacccaagatcaggagcagtaaattacgcaagacaattacaaccaagagtatcaatgtatagagatagagatctatcaacagcatacttagacttaaactcattaacaagcgcagactcaggaacatacttttgcgcaagacaaacatttaaaccagacttttactttgcagatcaaggatggtcattcaatttatggggaagaggagcacactttatagtaagctcagcatcaacaaaaggaccaagcgtattaccacacgatttaaga

SEQ ID NO: 48778 - RNA, 414 nt, synthetic construct
  misc_feature 1..414: note = derived and/or modified sequence opt6 from anti-HIV-1_HeavyChain
  source 1..414: mol_type = other RNA
caagcacatttagaacaaagtggaagtggagtaaaaaaaccaggagcaagtgtaagagtaagttgttggacaagtgaagatatatttgaaagaacagaattaacacattgggtaagacaagcaccaggacaaggattagaatggataggatgggtaaaaatagtaagtggagcagtaaattttggaagtccaaattttagacaaagagtaagtttaacaagagatagagatttatttacagcacatatggatataagaggattaacacaaggagatacagcaacatatttttgtgcaagacaaaaatttgaaagaggaggacaaggatggatatttgatttatggggaagaggaacattaatagcagtaagtagtgcaagtacaaaaggaccaagtgtatttccaagaagtgca

SEQ ID NO: 48779 - RNA, 414 nt, synthetic construct
  misc_feature 1..414: note = derived and/or modified sequence opt6 from anti-HIV-1_HeavyChain
  source 1..414: mol_type = other RNA
caagcacatttagaacaaagcggaagtggagtaaaaaaaccaggagcaagtgtaagagtaagttgttggacaagtgaagatatatttgaaaaaaaagaattaatacattgggtaagacaagcaccaggacaaggattagaatggataggatgggtaaaaacagtaacaggagcagtaaattttggaagtagtgattttagacaaagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagtgcaagtacaaaaggaccaagtgtatttccacatgattta

SEQ ID NO: 48780 - RNA, 384 nt, synthetic construct
  misc_feature 1..384: note = derived and/or modified sequence opt6 from anti-HIV-1_HeavyChain
  source 1..384: mol_type = other RNA
caagcacatctagaacaaagtggaagtggagtaaaaaaaccaggagcaagtgtaagagtaagttgttggacaagtgaagatatatttgaaaaaagtgaattaatacattgggtaagacaagcaccaggacaaggattagaatggataggatgggtaaaaacagtaacaggagcagtaaattttggaagtctagattttagacatagaataagtttaacaagagatagagatttatttacagcacatatggatataagaggattaacacaaggagatacagcaacatattattgtgcaagacaaaaatttgaaagtagatatacaggaggacaaggatggtattttgatttatggggaagaggaacacatatagtagtaagtagt

SEQ ID NO: 48781 - RNA, 414 nt, synthetic construct
  misc_feature 1..414: note = derived and/or modified sequence opt6 from anti-HIV-1_HeavyChain
  source 1..414: mol_type = other RNA
caagcacatttagaacaatcaggatcaggagtaaaaaaaccaggagcatcagtaagagtatcatgctggacatcagaagatatatttgaaaaaagtgaattaatacattgggtaagacaagcaccaggacaaggattagaatggataggatgggtaaaaacagtaacaggagcagtaaattttggatcaagtgatttcagacaaagagtatcattaacaagagatagagatttatttacagcacatatggatataagagggttaacacaaggagatacagcaacatattattgtgcaagacaaaaattttatgcaggaggacaaggatggtattttgatttatggggaagaggaacattaatagtagtaagttcagcatcaacaaaaggaccaagtgtatttccaacaatatgt

SEQ ID NO: 48782 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaattaggagcaagtgtaagagtaagttgttggacaagtgaagatatatttgaaagaacagaactaatacattgggtaagacaagcaccaggacaaggattagaatggataggatgggtaaaagcagtaagtggagcagtaaattatggaagtttagattttagacatagagtaagtttaacaagagatagagatttaagtacagcacatatggatataagaggactaacacaagatgatacagcaacatatttttgtgcaagacaaaaatttgaaagtttatatagtgatgatcaaggaagttattttgatttatggggaagaggaacattaataatagtaagtagt

SEQ ID NO: 48783 - RNA, 426 nt, synthetic construct
  misc_feature 1..426: note = derived and/or modified sequence opt6 from anti-HIV-1_HeavyChain
  source 1..426: mol_type = other RNA
caagcacatttagaacaaagtggaagtggagtaaaaaaaccaggagcaagtgtaagagtaagttgttggacaagtgaagatatatttgaaggatcagaattaatacattgggtaagacaagcaccaggacaaggattagaatggataggatgggtaaaaacagtaacaggagcagtaaattttggaagtgcatattttagacatagagtaagtttaacaagagatagagatttatttacagcacatatggatataagaggactaacacaaggagatacagcaacatatttttgtgcaagacaaaaatttgaaagtagatatacaggaggacaaggatggtattttgatctatggggaagaggaacacatatagtagtatcatcagcatcaacaaaaggaccaagtgtatttccacatgatctaaga

SEQ ID NO: 48784 - RNA, 408 nt, synthetic construct
  misc_feature 1..408: note = derived and/or modified sequence opt6 from anti-HIV-1_HeavyChain
  source 1..408: mol_type = other RNA
caagtacaattagtacatagtggagcagaagtaaaaaaaccaggagcaagcatgaaagtaagctgtaaaacaagtggatactcattcacaggatattacatgcactgggtaagacaagcaccaggacaaggactagaatggatgggatggataaatccatcaagcaatgacacaaactatgcacaaaaatttcaaggaagagtaacaatgacaagagacacaagcataaacacagcatatatggaattatcaagattaagatcaggagatacagcgatatatttctgtgcaagacaaaaattctatgcaggaggacaaggatggtactttgacttatggggaagaggaacattaatagtagtatcaagcgcaagtacaaaaggaccatcagtatttccaacaatatgt

SEQ ID NO: 48785 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggaggaggagtaaaaaaaccaggagcaagtgtaacattaagttgtaaaacagcagatgaagatgtatttgatgcagcatatatgcattgggtaagacaagcaccaggacaaacatttgaatggttaggatggatgaaaccagtaacaggagcagtaagttatgcaagaagatttcaaggaagagtaagtttttatatgacaagagaattaggaatggcatatatggatttaagaaatttaagatttgatgatacagcagtatatttttgtgcaagaaaaacagcaggagatgtaagtggagataatagaggatatttttttgatttatggggaagaggaagtagagtaatagtaagtagt

SEQ ID NO: 48786 - RNA, 414 nt, synthetic construct
  misc_feature 1..414: note = derived and/or modified sequence opt6 from anti-HIV-1_HeavyChain
  source 1..414: mol_type = other RNA
caaggaacattagaacaaagttggagtgaagtaaaaaaattaggagcaagtgtaagagtaagttgttggacaagtgaagatatatttaaaacagaattaatacattgggtaagacaagcaccaggacaaggactagaatggataggaggaatgaaagcagtaagtggagcagtaaattatggatcattagatttcagacatagagtatcattaacaccagatagagatttatcaacagcacatatggatataagaggactaacacaagatgatacagcaacatatttttgtgcaagacaaaaatttgcaagaggagatcaaggatggttttttgatttatggggaagaggaacattaatagtagtaagttcagcatcaacaaaaggaccaagtgtatttccacatgatttaaga

SEQ ID NO: 48787 - RNA, 423 nt, synthetic construct
  misc_feature 1..423: note = derived and/or modified sequence opt6 from anti-HIV-1_HeavyChain
  source 1..423: mol_type = other RNA
caagcacatttagaacaaagtggaagtggagtaaaaaaaccaggagcaagtgtaagagtaagttgttggacaagtgaagatatatttgaaaaatcagaattaatacattgggtaagacaagcaccaggacaaggattagaatggataggatgggtaaaaacagtaacaggagcagtaaattttgcaagtttagattttagaaatagaataagcttaagcagagacagagatttaagtacagcatatatggatataagaggattaacacaagatgatacagcaacatatttttgtgcaagacaaaaatttgcaagcagatattcaggagatcaaggaagctattttgatttatggggaagaggaacattaatatgtgtaagcagtgcatcaacaagagcacatagactaccaccaagatcagca

SEQ ID NO: 48788 - RNA, 414 nt, synthetic construct
  misc_feature 1..414: note = derived and/or modified sequence opt6 from anti-HIV-1_HeavyChain
  source 1..414: mol_type = other RNA
caagcacatctagaacaaagcggaagtggagtaaaaaaaccaggagcaagtgtaagagtaagttgttggacaagtgaagatatatttgaaagaacagaattaatacattgggtaagacaagcaccaggccaaggactagaatggataggatgggtaaaaacagtaacaggagcagtaaattttggaagtccaaattttagacatagagtaagtttaacaagagatagagatttatttacagcacatatggatataagaggattaacacaaggagatacagcaacatatttttgtgcaagacaaaaatttgcaagaggagatcaaggatggttttttgacttatggggaagaggaacattaatagtagtaagtagcgcaagtccaagagcacatagaagttcaccaagaagtgca

SEQ ID NO: 48789 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaatcaggatcaggagtaaaaaaaccaggagcatcagtaagagtatcatgttggacatcagaagatatatttgaaaaaagtgaattaatacattgggtaagacaagcaccaggacaaggattagaatggataggatgggtaaaaacagtaacaggagcagtaaattttggaagtagtgattttagacaaagagtatcattaacaagagatagagatttatttacagcacatatggatataagaggattaacacaaggagatacagcaacatatttttgtgcaagacaaaaattttatgcaggaggacaaggatggtattttgatttatggggaaggggaacattaatagtagtaagttcagcatcaactaaaggaccaagtgtatttccacatgatagtgca

SEQ ID NO: 48790 - RNA, 414 nt, synthetic construct
  misc_feature 1..414: note = derived and/or modified sequence opt6 from anti-HIV-1_HeavyChain
  source 1..414: mol_type = other RNA
caagcacatttagtacaaagtggaagtggagtaaaaaaaccaggagcaagtgtaagagtaagctgttggacaagtgaagatatatttaaaagtgaattaatacattgggtaaggcaagcaccaggacaaggattagaatggataggatgggtaaaaacagtaacaggagcagtaaattttggatcaagtgattttagacaaagagtatcactaacaagagatagagatttatttacagcacatatggatataagaggattaacacaaggagatacagcaacatatttttgtgcaagacaaaaattttatgcaggaggacaaggatggtattttgatctatggggaagaggaacattaatagtagtaagttcagcatcaacaaaaggaccaagtgtatttccacatgatttaaga

SEQ ID NO: 48791 - RNA, 414 nt, synthetic construct
  misc_feature 1..414: note = derived and/or modified sequence opt6 from anti-HIV-1_HeavyChain
  source 1..414: mol_type = other RNA
caagcacaattagaacaaagtggaagtggagtaaaaaaaccaggagcaagcgtaagagtaagttgttggacaagtgaagatatatttaaaacagaattaatacattgggtaagacaagcaccaggacaaggattagaatggataggatgggtaaaaacagtaacaggagcagtaaattttggatcaccaaattttagacatagggtatcattaacaagagatagagatttatttacagcacatatggatataagaggattaacacaaggagatacagcaacatatttttgtgcacgacaaaaatttgaaagaggaggacaaggatggtattttgatttatggggaagaggaacattaatagtagtaagttcagcaagtacaaaaggaccaagtgtatttccacatgatttaaga

SEQ ID NO: 48792 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaatcaggaagagaagtaaaaaaaccaggagcatcagtaagagtatcatgttggacatcagaagatatatttgaaaaaagtgaattaatacattgggtaagacaagcaccaggacaaggattagaatggataggatgggtaaaaacagtaacaggagcagtaaactttggatcaagtgattttagacaaagagtatcactaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagttcagcatcaacaaaaggaccaagtgtatttccacatgatttaaga

SEQ ID NO: 48793 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaagcggagcagtaaattttggaagcccaaattttagacatagaataagtttaacaagagatagagatttatttacagcacatatggatataagaggattaacacaaggagatacagcaacatattattgtgcaagacaaaaatttgaaagtagatatacaggaggacaaggatggtattttgatttatggggaagaggaacacatatagtagtaagtagt

SEQ ID NO: 48794 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaggaagtgaattaatacattgggtaagacaagcaccaggacaaggattagaatggataggatgggtaaaaacagtaacaggagcagtaaattttggaagcgcatattttagacatagagtaagtttaacaagagatagagatttatttacagcacatatggatataagaggattaacacaaggagatacagcaacatattattgtgcaagacaaaaattttataaaggaggacaaggatggtattttgatttatggggaagaggaacattaatagtagtaagtagt

SEQ ID NO: 48795 - RNA, 381 nt, synthetic construct
  misc_feature 1..381: note = derived and/or modified sequence opt6 from anti-HIV-1_HeavyChain
  source 1..381: mol_type = other RNA
caagtacaattagtacaatcaggagcagaagtaaaaaaaccaggagcatcagtaaaagtaagctgtaaagcatcaggatatacatttacagattattatttacactgggtaagacaagcaccaggacaaggactagactgggtaggatggataaatccaaattcaggaggaacaaattatgcacaaaaatttcaaggaagagtagcaatgacaagagacacatcattatcaagtgtatatctagatttaaattcattaacatcagcagactcaggaacatatttctgtgcaagacaaacatttaaaccagatttttatttcgcagaccaaggatggtcatttaatttatggggaagaggagcacattttatagtatcatca

SEQ ID NO: 48796 - RNA, 414 nt, synthetic construct
  misc_feature 1..414: note = derived and/or modified sequence opt6 from anti-HIV-1_HeavyChain
  source 1..414: mol_type = other RNA
caagcagatttagaacaaagtggaagtggagtaaaaaaaccaggagcaagtgtaagagtaagttgttggacatcagaagatatatttgaaagaacaaattatgtacattgggtaagacaagcaccaggaagaggattagaatggataggatggagtaaaacagtaacaggagcagtaaattttggaagtccaaattttagacatagagtaagcttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagttcagcaagtacaaaaggaccaagtgtatttccacatgattta

SEQ ID NO: 48797 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggaggaggaatgaaaaaaccaggagcaagtatgacagtaagttgtaaaacagcagatgaagatatatttgatgcagcatatatgcattgggtaagacaagcaccaggacaaacatttgaatggttaggatggatgaaaccagtaacaggagcagtaaattatgcaagacaatttcaaggaagagtaagtttttatagaacaagagaattaggaatagcatatatggatttaagagatttaaaatttgatgatacagcagtatatttttgtgcaagaaaaacaaaaggagatgtaagcggagatgatagaggatttttttttgatttatggggaagaggaacaagagtaatagtaagtagt

SEQ ID NO: 48798 - RNA, 384 nt, synthetic construct
  misc_feature 1..384: note = derived and/or modified sequence opt6 from anti-HIV-1_HeavyChain
  source 1..384: mol_type = other RNA
caaagccatctagaacaatcaggatcagcaatgaaaaaaccaggagcatcagtaagagtatcatgctggacatcagaagatatatttgaaaggacagaactaatatactgggtaagacaagcaccaggaagaggactagaatggataggatgggtaaaaacagtaagcggaacagtaaactttggatcaagtgatttcagaaacagaatatcactaacaagagatagagatttatcaacagcacacatggacataagaggattaacacaagatgacacagcaacatacttttgcgcaagacaaaaatttgaatcattatatagcgatgaccaaggatcatactttgacttatggggaagaggaacattaataatagtatcaagc

SEQ ID NO: 48799 - RNA, 414 nt, synthetic construct
  misc_feature 1..414: note = derived and/or modified sequence opt6 from anti-HIV-1_HeavyChain
  source 1..414: mol_type = other RNA
caagcacatttagaacaaagtggaagcggagtaaaaaaactaggagcaagtgtaagagtaagttgttggacaagtgaagatatatttgaaagaacaaatttaatacattgggtaagacaagcaccaggacaaggattagaatggataggatgggtaaaagcagtaagtggagcagtaaattatggaagcctagattttagacatagagtaagcttaacaagagatagagatttaagtacagcacatatggacattagaggactaacacaagatgatacagcaacatatttttgtgcaagacaaaaatttgcaagaggagatcaaggatggttttttgatctatggggaagaggaacattaatagtagtatcaagtgcaagtacaaaaggaccatcagtatttccacatgattta

SEQ ID NO: 48800 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggaggaggagtaaaaaaaccaggagcaagtgtaacattaagttgtaaaacagcaggagaagatgtatttgatgcagcatatatgcattgggtaagacaagcaccaggacaaacatttgaatggttaggatggatgaaaccagtaacaggagcagtaaattatgcaagaaaatttcaaggaagagtaagtttttatagaacaagagaattaggaatagcatatatggatttaagaaatttaagatttgatgatacagcagtatatttttgtgcaagaaaaacagcaggagatgtaagtggagataaaagaggatttttttttgatttatggggaagaggaagtagagtaatagtaagtagt

SEQ ID NO: 48801 - RNA, 384 nt, synthetic construct
  misc_feature 1..384: note = derived and/or modified sequence opt6 from anti-HIV-1_HeavyChain
  source 1..384: mol_type = other RNA
caaagtcatttagaacaatcaggatcagcaatgaaaaaaccaggagcatcagtaagagtatcatgctggacatcagaagatatatttgaaagaacagaactaatatactgggtaagacaagcaccaggaagaggattagaatggataggatgggtaaaaacagtaagcggaacagtaaactttggatcaagcgatttcagaaacagaatatcattaacaagagatagagatctatcaacagcacacatggacataagaggactaacacaagatgacacagcaacatacttttgcgcaagacaaaaatttgaatcactatatagtgatgaccaaggatcatactttgacttatggggaagaggaacattaataacagtatcaagt

SEQ ID NO: 48802 - RNA, 429 nt, synthetic construct
  misc_feature 1..429: note = derived and/or modified sequence opt6 from anti-HIV-1_HeavyChain
  source 1..429: mol_type = other RNA
caagcacatttagaacaatcaggatcaggagtaaaaaaaccaggagcatcagtaagagtatcatgctggagttcagaagatatatttgaaagaacagaattaatacactgggtaagacaagcaccaggacaaggattagaatggataggatgggtaaaaacagtaacaggagcagtaaattttggatcattagattttagacacagaataagtttaacaagagatagagatttatttacagcacatatggacataagaggattaacacaaggagatacagcaacatatttttgtgcaagacaaaaatttgaatcaagatatacaggaggacaaggatggtattttgacttatggggaagaggaacacatatagtagtatcaagcgcaagtacaaaaggaccatcaggattaccaccaacaatatgtaga

SEQ ID NO: 48803 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaaccaggagcaagtgtaagagtaagttgttggacaagtgaagatatatttgaaaaaagtgaattaatacattgggtaagacaagcaccaggacaaggattagaatggataggatgggtaaaaacagtaacaggagcagtaaattttggaagcagtgattttagacaaagagtaagtctaacaagagatagagatttatttacagcacatatggatataagaggattaacacaaggagatacagcaacatatttttgtgcaagacaaaaatttgcaagaggagatcaaggatggttttttgatttatggggaagaggaacattaatagtagtaagtagtgcaagtacaaaaggaccaagtgtatttccacatgatttaaga

SEQ ID NO: 48804 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaaccaggaacaagtgtaagagtaagttgttggacaagtgaagatatatttgaaagaacagaattaatacattgggtaagacaagcaccaggacaaggattagaatggataggatgggtaaaaacagtaacaggagcagtaaattttggaagtccaaattttagacatagagtaagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagtgcaagtacaaaaggaccaagtgtatttccacatgatttaaga

SEQ ID NO: 48805 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagtccaaattttagacatagagtaagtttaacaagaggaagagatctatttacagcacatatggatataagaggattaacacaaggagatacagcaacatattattgtgcaagacaaaaatttgaaagaggaggacaaggatggtattttgatttatggggaagaggaacattaatagtagtaagtagtgcaagtacaaaaggaccaagtgtatttccacatgatttaaga

SEQ ID NO: 48806 - RNA, 411 nt, synthetic construct
  misc_feature 1..411: note = derived and/or modified sequence opt6 from anti-HIV-1_HeavyChain
  source 1..411: mol_type = other RNA
caagcacatttaggagcaaattggagtggagtaaaaaaattaggagcaagtgtaagagtaagttgttggacaagtgaagatatatttgaaagaacagaactaatacactgggtaagacaagcaccaggacaaggattagaatggataggatgggtaaaagcagtaagtggagcagtaaattatggaagtttagattttagacatagagtaagtctaacaagagatagagatttaagtacagcacatatggatataagaggattaacacaagatgatacagcaacatatttttgtgcaagacaaaaatttgcaagaggagatcaaggatggttttttgatttatggggaagaggaacattaatagtagtaagtagtgcaagtacaaaaggaccaagtgtatttccacaaata

SEQ ID NO: 48807 - RNA, 375 nt, synthetic construct
  misc_feature 1..375: note = derived and/or modified sequence opt6 from anti-HIV-1_HeavyChain
  source 1..375: mol_type = other RNA
caagcacatctagaacaatcaggaagtggagtaaaaaaaccaggagcaagtgtaagagtaagttgttggacaagtgaagatatatttgaaaaaagtgaattaatacattgggtaagacaagcaccaggacaaggattagaatggataggatgggtaaaaacagtaacaggagcagtaaactttggaagtagtgattttagacaaagagtaagtttaacaagagatagagatttattcacagcacatatggatataagaggattaacacaaggagatacagcaacatatttttgtgcaagacaaaaattttatgcaggaggacaaggatggtattttgatttatggggaagaggaacactaatagtagtaagtagt

SEQ ID NO: 48808 - RNA, 423 nt, synthetic construct
  misc_feature 1..423: note = derived and/or modified sequence opt6 from anti-HIV-1_HeavyChain
  source 1..423: mol_type = other RNA
caagcacaattagaacaaagcggggtaggagtaaaaaaaccaggagcaagcgtaagagtaagctgtctagcaagcgaagacatatttaaaacagaattaatacactgggtaagacaagcaccaggacaaggactagaatggataggatgggtaaaaacagtaacaggagcagtaaactttggatcacaaatattcagacacagaatatcactaacaagagatagagatctatttacagcacacatggacataagaggactaacacaaggagacacagcaacatacttttgcgcaagacaaaaatttgaatcaagatatacaggaggacaaggatggtactttgacttatggggaagaggaacacatatagtagtatcaagcgcaagtacaaaaggaccatcagtatttccacatgacttacga

SEQ ID NO: 48809 - RNA, 411 nt, synthetic construct
  misc_feature 1..411: note = derived and/or modified sequence opt6 from anti-HIV-1_HeavyChain
  source 1..411: mol_type = other RNA
caagcacacttagaacaaagcggaagtggagtaaaaaaaccaggagcaagtgtaagagtaagttgttggacgagtgaagacatatttgaaaaatcagaattaatacattgggtaagacaagcaccaggacaaggattagaatggataggatgggtaaaaacagtaacaggagcagtaaattttgcacatcaaatatcagacagagtatcattaacaagagatagagatttatttacagcacatatggatataagaggattaacacaaggagatacagcaacatatttttgtgcaagacaaaaattttacgcaggaggacaaggatggtattttgatttatggggaagaggaacattaatagtagtaagctcagcatcaacaaaaggaccaagtgtatttccaacaatatgt

SEQ ID NO: 48810 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaagaagtgaattaatacattgggtaagacaagcgccaggacaaggattagaatggataggatgggtaaaaacagtaacaggagcagtaaattttggaagtccaaattttagacatagagtaagtttaacaagagatagagatttatttacagcacatatggatataagaggattaacacaaggagatacagcaacatatttttgtgcaagacaaaaatattatgcaggaggacaaggatggtattttgatttatggggaagaggaacattaatatgtgtaagtagt

SEQ ID NO: 48811 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaagtggagcagtaaattttggaagtccaaattttagacatagagtaagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagcagt

SEQ ID NO: 48812 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagcggagtaaaaaaattaggagcaagtgtaagagtaagttgttggacaagtgaagatatatttgaaagaacagaattaatacattgggtaagacaagcaccaggaagaggattagaatggataggatgggtaaaagcggtaagtggagcagtaaattatggaagtttagattttagacatagggtaagtttaacaagagatagagatttatttacagcacatatggatataagaggattaacacaagatgatacagcaacatatttttgtgcaagacaaaaatttgcaagaggagatcaaggatggttttttgatttatggggaagaggaacattaatagtagtaagtagt

SEQ ID NO: 48813 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggaggaggagtaaaaaaaccaggagcaagtgtaacattaagttgtaaaacagcagatgaaggagtatttgatgcagcatatatgcattgggtaagacaagcaccaggacaaacatttgaatggttaggatggatgaaaccagtaacaggagcagtaaattatgcaagaaaatttcaaggaagagtaagtttttatagaacaagagaattaggaatagcatatatggatttaagaaatttaagatttgatgatacagcagtatatttttgtgcaagaaaaacagcaggagatgtaagtggagataaaagaggatttttttttgatttatggggaagaggaagtagagtaatagtaagtagt

SEQ ID NO: 48814 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaggaagtgaattaatacattgggtaagacaagcaccaggacaaggattagaatggataggatgggtaaaaacagtaacaggagcagtaaattttggaagtgcatattttagacatagagtaagtttaacaagagatagagatttatttacagcacatatggatataagaggattaacacaaggagatacagcaacatatttttgtgcaagacaaaaatattatgcaggaggacaaggatggtattttgatttatggggaagaggaacattaatagtagtaagtagt

SEQ ID NO: 48815 - RNA, 378 nt, synthetic construct
  misc_feature 1..378: note = derived and/or modified sequence opt6 from anti-HIV-1_HeavyChain
  source 1..378: mol_type = other RNA
caagtatatatggaacaaccaggagtagaagtaacaaaaccaggagcaagtgtaacattaagttgtaaaacagcagaagacgtatttgatgcagcatatatgcattgggtaagacaagcaccaggacaaacatttgaatggttaggatggataaaaccagtaacaggagcagtaaattatgcaagaaaatttcaaggaagagtaagtttttatagaacaagagaattaggaatagcatatatggatttaagaaatttaagatttgatgatacagcagtatatttttgtgcaagaaaaacagcaggagatgtaagtggagataaaagaggatttttttttgatttatggggaagaggaagtagagtaatagtaagcagt

SEQ ID NO: 48816 - RNA, 375 nt, synthetic construct
  misc_feature 1..375: note = derived and/or modified sequence opt6 from anti-HIV-1_HeavyChain
  source 1..375: mol_type = other RNA
caagcacatctagaacaaagtggaagtggagtaaaaaaaccaggagcaagtgtaagagtaagttgttggacaagtgaagatatatttgaaaaaagtgaattaatacattgggtaagacaagcaccaggacaaggactagaatggataggatgggtaaaaacagtaacaggagcagtaaattttggaagtagtgattttagacaaagagtaagtttaacaagagatagagatttatttacagcacatatggatataagaggattaacacaaggagatacagcaacatatttttgtgcaagacaaaaatttgaaagaggaggacaaggatggatatttgatttatggggaaggggaacattaataatagtaagtagt

SEQ ID NO: 48817 - RNA, 384 nt, synthetic construct
  misc_feature 1..384: note = derived and/or modified sequence opt6 from anti-HIV-1_HeavyChain
  source 1..384: mol_type = other RNA
caagcacatttagtacaaagtggaagtgaagtaaaaaaaccaggagcatttgtaagagtaagttgttggacaagtgaagatatatttgaagaaacagaattaatacattgggtaaggcaagcaccaggacaaggactagaatggataggatgggtaaaaacagtaacaggagcagtaaattttggaagtttagattttagacatagaataagcttaacaagagatagagatttatttacagcacatatggatataaggggattaacacaaggagatacagcaacatatttttgtgcaagacaaaaatttgaaagtagatatacaggaggacaaggatggtattttgatttatggggaagaggaacacatatagtagtaagtagt

SEQ ID NO: 48818 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgtaaagcaagtgaagatatatttgaaaggacagaattaatacattgggtaagacaagcaccaggacaaggattagaatggataggatgggtaaaaacagtaacaggagcagtaaattttggaagtccaaattttagacatagagtaagtttaacaagagatagagatttatttacagcacatatggatataagaggattaacacaaggagatacagcaacatatttttgtgcaagacaaaaatttgaaagaggaggacaaggatggtattttgatctatggggaagaggaacattaatagtagtaagtagt

SEQ ID NO: 48819 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaatcaggaagtgaagtaaaaaaaccaggagcaagtgtaagagtaagttgttggacaagtgaagatatatttgaaagaacagaattaatacattgggtaagacaagcaccaggacaaggattagaatggataggatgggtaaaaacagtaagtggagcagtaaattttggaagtccaaattttagacatagagtaagtttaacaagagacagagatttatttacagcacatatggatataagaggattaacacaaggagatacagcaacatatttttgtgcaagacaaaaatttgaaagaggaggacaaggatggtattttgatttatggggaagaggaacattaatagtagtaagtagc

SEQ ID NO: 48820 - RNA, 375 nt, synthetic construct
  misc_feature 1..375: note = derived and/or modified sequence opt6 from anti-HIV-1_HeavyChain
  source 1..375: mol_type = other RNA
caagcacatttagtacaaagtggaagtggagtaaaaaaaccaggagcaagtgtaagagtaagttgttggacaagtgaagatatatttgaaaaaagcgaattaatacattgggtaagacaagcaccaggacaaggattagaatggataggatgggtaaaaacagtaacaggagcagtaaattttggaagtagtgattttagacaaagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 48821 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaattaggagcaagtgtaagagtaagctgttggacaagtgaagatatatttgaaagaacagaattaatacattgggtaaggcaagcaccaggacaaggattagaatggataggatgggtaaaagcagtaagtggagcagtaaattatggaagtctagattttagacatagagtaagtttaacaagagatagagatttaagtacagcacatatggatataagaggattaacacaagatgatacagcaacatatttttgtgcaagacaaaaatttgaaagaggaggacaaggatggtattttgatttatggggaagaggaacattaatatgtgtaagtagt

SEQ ID NO: 48822 - RNA, 375 nt, synthetic construct
  misc_feature 1..375: note = derived and/or modified sequence opt6 from anti-HIV-1_HeavyChain
  source 1..375: mol_type = other RNA
caagcacatctagaacaaagcggaagtggagtaaaaaaaccaagagcaagtgtaagagtaagttgttggacaagtgaagatatatttgaaaaaagtgaattaatacattgggtaagacaagcaccaggacaaggattagaatggataggatgggtaaaaacagtaacaggagcagtaaattttggaagtagtgattttagacaaagagtaagtttaacaagagatagagatttatttacagcacatatggatataagaggattaacacaaggagatacagcaacatatttttgtgcaagacaaaaattttatgcaggaggacaaggatggtattttgatctatggggaagaggaacattaatagtagtaagttca

SEQ ID NO: 48823 - RNA, 381 nt, synthetic construct
  misc_feature 1..381: note = derived and/or modified sequence opt6 from anti-HIV-1_HeavyChain
  source 1..381: mol_type = other RNA
caagtacaattagaacaagcaggagcaggagtaaaaaaaccaggaccaagtgtaacattatcatgtaaaacagcagatgaagatgtatttgatgcagcatatatgcattgggtaagacaagcaccaggacaaacattcgaatggttaggatggatgaaaccagtaacaggagcagtaagttatgcaagaaaatttcaaggaagagtaagtttttatatgacaagagaattaggaatggcatatatggatttaagaaatttaagatttgatgatacagcagtatatttttgtgcaagaaaaacagcaggagatgtaagtggagataatagaggatatttttttgatttatggggaagaggatcaagagtaatagtaagtagt

SEQ ID NO: 48824 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagcgaagatatatttgaaagaacagaattaatacattgggtaagacaagcaccaggacaaggattagaatggataggatgggtaaaaacagtaagtggagcagtaaattttggaagtccaaattttagacaaagagtaagtttaacaagagatagagatttatttacagcacatatggatataagaggactaacacaaggagatacagcaacatatttttgtgcaagacaaaaattttatgcaggaggacaaggatggtattttgatttatggggaagaggaacattaatagtagtaagtagt

SEQ ID NO: 48825 - RNA, 381 nt, synthetic construct
  misc_feature 1..381: note = derived and/or modified sequence opt6 from anti-HIV-1_HeavyChain
  source 1..381: mol_type = other RNA
caagtatttatggaacaagcaggagcaggaatgaaaaaaccaggagcaagtatgacagtaagttgtaaaacagcagatgaagatgtatttgatgcagcgtatatgcattgggtaagacaagcaccaggacaaacatttgaatggttaggatggatgaaaccagtaacaggagcagtaaattatgcaagaaaatttcaaggaagagtaagtttttatagaacaagagaactaggaatagcatatatggatttaagaaatttaagatttgatgatacagcagtatatttttgtgcaagaaaaacagcaggagatgtaagtggagataaaagaggatttttttttgatttatggggaagaggaagtagagtaatagtaagtagt

SEQ ID NO: 48826 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagcaagttgttggacaagtgaagatatatttgaaagaacagaattaatacattgggtaagacaagcaccaggacaaggattagaatggataggatgggtaaaaatagtaagtggagcagtaaattttggaagtccaaattttagacaaagagtaagtttaacaagagatagagatttattcacagcacatatggatataagaggattaacacaaggagatacagcaacatatttttgtgcaagacaaaaatttgaaagaggaggacaaggatggatatttgatttatggggaagaggaacattaatagcagtaagtagt

SEQ ID NO: 48827 - RNA, 381 nt, synthetic construct
  misc_feature 1..381: note = derived and/or modified sequence opt6 from anti-HIV-1_HeavyChain
  source 1..381: mol_type = other RNA
caagtatacatggaacaagcaggaggaggaatgaaaaaaccaggagcaagtatgacagtaagttgtaaaacagcagatgaagatatatttgatgcagcatatatgcattgggtaagacaagcaagaggacaaacatttgaatggttaggatggatgaaaccagtaacaggagcagtaaattatgcaagacaatttcaaggaagagtaagtttttatagaacaagagaattaggaatagcatatatggatttaagagatttaaaatttgatgatacagcagtatatttttgtgcaagaaaaacaaaaggagatgtaagtggagatgatagaggatttttttttgatttatggggaagaggaacaagagtaatagtaagtagt

SEQ ID NO: 48828 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggagcaggagtaaaagaaccaggagcaagtgtaagagtaagttgttggagtagtgaagatatatttgaaagaacagaattaatacattgggtaagacaagcaccaggacaaggattagaatggataggatgggtaaaaacagtaacaggagcagtaaattttggaagtttagattttagacatagaataagtttaacaagggatagagatttattaacagcacatatggatataagaggattaacacaaggagatacagcaacatatttttgtgcaagacaaaaatttgaaagtagatatacaggaggacaaggatggtattttgatttatggggaagaggaacacatatagtagtaagtagt

SEQ ID NO: 48829 - RNA, 384 nt, synthetic construct
  misc_feature 1..384: note = derived and/or modified sequence opt6 from anti-HIV-1_HeavyChain
  source 1..384: mol_type = other RNA
caagtacaattagtacaaagtggaagcgcaatgaaaaaaccaggagcaagtgtaagagtaagttgttggacaagtgaagatatatttgaaaggacagaattaatatattgggtaagacaagcaccaggaagaggattagaatggataggatgggtaaaaacagtaagtggaacagtaaattttggaagtagtgattttagaaatagaataagtttaacaagagatagagatttaagtacagcacatatggatataagaggattaacacaagatgatacagcaacatatttttgtgcaagacaaaaatttgaaagtttatatagtgatgatcaaggaagttattttgatttatggggaagaggaacactaataatagtaagtagt

SEQ ID NO: 48830 - RNA, 384 nt, synthetic construct
  misc_feature 1..384: note = derived and/or modified sequence opt6 from anti-HIV-1_HeavyChain
  source 1..384: mol_type = other RNA
caagcacatttagtacaaagtgcaagcggagtaaaaagaccaggagcaagcgtaagagtaagttgttggacaagtgaagatatatttgaaagaacagaactaatatattgggtaagacaagcaccaggacaaggattagaatggataggatgggtaaaaacagtaagtggagcagtaaattttggaagtcaagattttagacatagaataagtttaacaagagatagagatttatttacagcacatatggatataaggggattaacacaaggagatacagcaacatatttttgtgcaagacaaaaatttgaaagtagatatacaggaggacaaggatggtattttgatttatggggaagaggaacacatatagtagtaagtagt

SEQ ID NO: 48831 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggaggaggagtaaaaaaaccaggagcaagtgtaacattaagttgtaaaacagcagatgaagatgtatttgatgcagcatatatgcattgggtaagacaagcaccaggacaaacatttgaatggttaggatggatgaaaccagtaacaggagcagtaagttatgcaagaaaatttcaaggaagagtaagtttttatatgacaagagaattaggaatggcatatatggatttaagaaatttaagatttgatgatacagcagtatatttttgtgcaagaaaaacagcaggagatgtaagtggagataaaagaggatttttttttgatttatggggaagaggaagcagagtaatagtaagtagt

SEQ ID NO: 48832 - RNA, 372 nt, synthetic construct
  misc_feature 1..372: note = derived and/or modified sequence opt6 from anti-HIV-1_HeavyChain
  source 1..372: mol_type = other RNA
caagcacatttagaacaaagtggaagtggagtaaaaaaaccaggagcaagtgtaagagtaagctgttggacaagtgaagatatatttgaaggatatatgatacattgggtaagacaagcaccaggacaaggattagaatggataggatgggtaaaaacagtaacaggagcagtaaattttggatcagcatattttagacatagagtatcattaacaagagatagagatttatttacagcacatatggatataagaggattaacacaaggagatacagcaacatatttttgtgcaagacaaaaattttataaaggaggacaaggatggtattttgatttatggggaagaggaacattaatagtagtaagttca

SEQ ID NO: 48833 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaattaggagcaagtgtaagagtaagttgttggacaagtgaagatatatttgaaagaacagaattaatacattgggtaagacaagcaccaggaagaggattagaatggataggatgggtaaaagcagtaagtggagcagtaaattatggaagtttagattttagacatagagtaagtttaacaagagatagagatttatttacagcacatatggatataagaggattaacacaagatgatacagcaacatatttttgtgcaagacaaaaatttgcaaggggagatcaaggatggttttttgatttatggggaagaggaacattaatatgtgtaagtagt

SEQ ID NO: 48834 - RNA, 375 nt, synthetic construct
  misc_feature 1..375: note = derived and/or modified sequence opt6 from anti-HIV-1_HeavyChain
  source 1..375: mol_type = other RNA
caagcacatttagtacaaagtggaagtggagtaaaaaaaagtggagcaagtgtaagagtaagttgttggacaagtgaagatatatttgaaaaaagtgaattaatacattgggtaagacaagcaccaggacaaggattagaatggataggatgggtaaaaacagtaacgggagcagtaaattttggaagtagtgattttagacaaagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 48835 - RNA, 378 nt, synthetic construct
  misc_feature 1..378: note = derived and/or modified sequence opt6 from anti-HIV-1_HeavyChain
  source 1..378: mol_type = other RNA
caagtatatatggaaagagcaggagcaggagtaaaaaaaccaggagcaagtgtaacattaagttgtaaaacagcagatgaagatgtatttggagcatatatgcattgggtaagacaagcaccaggacaaacatttgaatggttaggatggatgaaaccagtaacaggagcagtaagttatgcaagaaaatttcaaggaagagtaagtttttatatgacaagagaattaggaatggcatatatggatttaagaaatttaagatttgatgatacagcagtatatttttgtgcaagaaaaacagcaggagatgtaagtggagataatagaggatatttttttgatttatggggaagaggaagtagagtaatagtaagtagc

SEQ ID NO: 48836 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagcggagtaaaaaaaccaggagcaagtgtaagagtaagttgttggacaagtgaagatatatttgaaggaagtgaattaatacattgggtaagacaagcaccaggacaaggattagaatggataggatgggtaaaaacagtaacaggagcagtaaattttggaagcgcatattttagacatagagtaagtttaacaagagatagagatttatttacagcacatatggatataagaggattaacacaaggagatacagcaacatatttttgtgcaagacaaaaattttataaaggaggacaaggatggtattttgatttatggggaagaggaacattaatagtagtaagtagt

SEQ ID NO: 48837 - RNA, 375 nt, synthetic construct
  misc_feature 1..375: note = derived and/or modified sequence opt6 from anti-HIV-1_HeavyChain
  source 1..375: mol_type = other RNA
caaagtcatttagaacaaagtggaagtgcaatgaaaaaaccaggagcaagtgtaagagtaagttgttggacaagtgaagatatatttgaaagaacagaattaatatattgggtaagacaagcaccaggaagaggattagaatggataggatgggtaaaaacagtaagtggaacagtaaattttggaagtagtgattttagaaatagagtaagtttaacaagggatagagatttatttacagcacatatggatataagaggattaacacaagatgatacagcaacatatttttgtgcaagacaaaaatttgcaagaggagatcaaggatggttttttgatttatggggaagaggaacattaatagtagtaagtagt

SEQ ID NO: 48838 - RNA, 384 nt, synthetic construct
  misc_feature 1..384: note = derived and/or modified sequence opt6 from anti-HIV-1_HeavyChain
  source 1..384: mol_type = other RNA
caagcacatttagtacaaagtggaagtggagtaaaaaaaccaggagcaagtgtaagagtaagctgttggacaagtgaagatatatttgaaagaacagaattaatacattgggtgagacaagcaccaggacaaggattagaatggataggatgggtaaaaacagtagcaggagcagtaaattttagtagtttagattttagacatagaataagtttaacaagagatagagatttatttacagcacatatggatataagaggattaacacaaggagatacagcaacatatttttgtgcaagacaaaaatttgaaagtaggtatacaggaggacaaggatggtattttgatttatggggaagaggaacacatatagtagtaagtagt

SEQ ID NO: 48839 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtgaaaaaaagtggagcaagtgcaagagtaagttgttggagtagtgaagatatatttgaaaggacagaattaatacattgggtaagacaagcaccaggacaaggattagaatggataggatgggtaaaaacagtaacaggagcagtaaattttggaagtttagattttagacatagaataagcttaacaagagatagagatttatttacagcgcatatggatataagaggactaacgcaaggagatacagcaacatatttttgtgcaagacaaaaatttgaaagtagatatacaggaggacaaggatggtattttgatttatggggaagaggaacacatatagtagtaagtagt

SEQ ID NO: 48840 - RNA, 369 nt, synthetic construct
  misc_feature 1..369: note = derived and/or modified sequence opt6 from anti-HIV-1_HeavyChain
  source 1..369: mol_type = other RNA
ttattacaattagtacaatcaggagcagaagtaaaaaaaccaggagcatcagtaaaagtaacatgtaaagcatcaggatatacatttacaggatatatacattgggtaagacaagcaccaggacaaggattagaatggataggatgggtaaaagcagtaagtggagcagtaaattatggatcattagattttagacatagagtatcattaacacatgatagagatttatcaacagcacatatggatataagaggattaacacaagatgatacagcaacatatttttgtgcaagacaaaaatttgcaagaggagatcaaggatggttttttgatttatggggaagaggaacattaatagtagtaagttca

SEQ ID NO: 48841 - RNA, 369 nt, synthetic construct
  misc_feature 1..369: note = derived and/or modified sequence opt6 from anti-HIV-1_HeavyChain
  source 1..369: mol_type = other RNA
caagtacaattagtacaaagtggagcagaagtaaaaaaaccaggagcaagtgtaaaagtaagttgtaaagcaagtggatgtacatttacaggatattatatgcattgggtaagacaagcaccaggacaaggactagaatggatgggatggataaatccaaatagtggaggaacaaattatgcacaaaaatttcaaggaagagtaacaatgacaagagatacaagtataagtacagcatatatggaattaagtagattaagaagtgatgatacagcagtatattattgtgcaagacaaaaatttgcaagaggagatcaaggatggttttttgatttatggggaagaggaacattaatagtagtaagtagt

SEQ ID NO: 48842 - RNA, 369 nt, synthetic construct
  misc_feature 1..369: note = derived and/or modified sequence opt6 from anti-HIV-1_HeavyChain
  source 1..369: mol_type = other RNA
caagtacaattagtacaaagcggaacagaattaagaaaaccaggagcaagtgtaaaagtaagttgtaaagcaagcggatatacattctcaggatcatacatacactgggtaagacaagcaccagggcaaggactagaatgggtaggatggataaatccatcaagcggagcaacacaatgtgcaaaaaaatttcaagataaagtaacaatgacaagagacacaacaaataacacagtatatatggaagtaaacagattaataagtgacgatacagcaacatatttctgtgcaagacaaaaattcgcaagaggagaccaaggatggttttttgacttatggggaagaggaacattaatagtagtatcaagc

SEQ ID NO: 48843 - RNA, 372 nt, synthetic construct
  misc_feature 1..372: note = derived and/or modified sequence opt6 from anti-HIV-1_HeavyChain
  source 1..372: mol_type = other RNA
caagtattattagtacaaagtggagcagaagtaaaaaaaccaggaagtagtgtaaaagtaagttgtaaaacaagtggagatagtttaacaaaatatgcattacattgggcaagacaagcaccagggcaaggattagaatggataggatgggtaaaaacagtaacaggagcagtaaattttggaagcagtgattttagacaaagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagcagt

SEQ ID NO: 48844 - RNA, 372 nt, synthetic construct
  misc_feature 1..372: note = derived and/or modified sequence opt6 from anti-HIV-1_HeavyChain
  source 1..372: mol_type = other RNA
caagtacaattagtacaaagtggaacagaagtaaaaacaccaggagcaagtgtaaaagtaagttgtaaagcaagtggatatacatttacaaattatgatataaattgggtaagacaagcaccaggacaaggattagaatggataggatgggtaaaaacagtaacaggagcagtaaattttggaagtagtgatttcagacaaagagtatcattaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagttca

SEQ ID NO: 48845 - RNA, 372 nt, synthetic construct
  misc_feature 1..372: note = derived and/or modified sequence opt6 from anti-HIV-1_HeavyChain
  source 1..372: mol_type = other RNA
caagtacaattagtacaaagtggagatgaagtaaaaaaaccaggagcaagtgtaaaagtaagttgtaaagcaagtggaaaaggatttccaacatcattagtaacatgggtaagacaagcaccaggacaaggattagaatggataggatgggtaaaagcagtaagtggagcagtaaattatggatcattagattttagacatagagtatcactaacaagagatagagatctatttacagcacatatggatataagaggattaacacaagatgatacagcaacatatttttgtgcaagacaaaaatttgcaagaggagatcaaggatggttttttgatttatggggaagaggaacattaatagtagtaagttca

SEQ ID NO: 48846 - RNA, 372 nt, synthetic construct
  misc_feature 1..372: note = derived and/or modified sequence opt6 from anti-HIV-1_HeavyChain
  source 1..372: mol_type = other RNA
caagtacaattagtacaaagtggagcagaagtaaaaaaaccaggaagtagtgtaaaagtaagttgtaaaacaagcggagatatattaacaaattatggattaaattgggtaagacaagcaccaggacaaggattagaatggataggatgggtaaaagcagtaagcggagcagtaaattatggaagtctagattttagacatagagtaagtttaacaagagatagagatttaagtacagcacatatggatataagaggattaacacaagatgatacagcaacatatttttgtgcaagacaaaaatttgcaagaggagatcaaggatggttttttgatttatggggaagaggaacattaatagtagtaagtagt

SEQ ID NO: 48847 - RNA, 372 nt, synthetic construct
  misc_feature 1..372: note = derived and/or modified sequence opt6 from anti-HIV-1_HeavyChain
  source 1..372: mol_type = other RNA
caagtacaactagtacaaagtggagcagaagtaaaaaaaccgggagcaagtgtaagagtaagttgtaaaacaagtggatatccattttcaagatatggaataagttgggtaagacaagcaccaggacaaggattagtatggatggcatgggtaaaagcagtaagcggagcagtaaattatggatcattagattttagacatagagtatcattaacaagagatagagatttatcaacagcacatatggatataagaggattaacacaagatgatacagcaacatatttttgtgcaagacaaaaatttgcaagaggagatcaaggatggttttttgatttatggggaagaggaacattaatagtagtaagttca

SEQ ID NO: 48848 - RNA, 372 nt, synthetic construct
  misc_feature 1..372: note = derived and/or modified sequence opt6 from anti-HIV-1_HeavyChain
  source 1..372: mol_type = other RNA
agagaacaattagtacaaagtggagcagaagtaaaaaaaccaggagcaagtgtaaaagtaagctgtaaaacaagtggaaatacatttggaagttatgattttaattgggtaagacaagcaccaggacaagggctagaatggataggatgggtaaaaatagtaagcggagcagtaaattttggaagtccaaattttagacaaagagtaagtttaacaagagatagagatttatttacagcacatatggatataagaggattaacacaaggagatacagcaacatatttttgtgcaagacaaaaatttgaaaggggaggacaaggatggatatttgatttatggggaagaggaacattaatagcagtaagtagt

SEQ ID NO: 48849 - RNA, 372 nt, synthetic construct
  misc_feature 1..372: note = derived and/or modified sequence opt6 from anti-HIV-1_HeavyChain
  source 1..372: mol_type = other RNA
caagtacaattagtacaaagcggagcagaagtaaaaaaaccaggagcaagtgtaaaagtaagttgtaaagcaagtggatatacatttacaagctattatatgcattgggtaagacaagcaccaggacaaggattagaatggataggatgggtaaaaacagtaacaggagcagtaaattttggatcaccaaattttagacatagagtatcattaacaagagatagagatttatttacagcacatatggatataagaggattaacacaaggagatacagcaacatatttttgtgcaagacaaaaatattatgcaggaggacaaggatggtattttgatttatggggaagaggaacgttaatagtagtaagttca

SEQ ID NO: 48850 - RNA, 372 nt, synthetic construct
  misc_feature 1..372: note = derived and/or modified sequence opt6 from anti-HIV-1_HeavyChain
  source 1..372: mol_type = other RNA
caagtacaactagtacaaagtggagcagaagtaaaaaaaccaggagcaagtgtaaaagtaagttgtaaagcaagtggatatacatttacaagttattatatgcattgggtaagacaagcaccaggacaaggattagaatggataggatgggtaaaaacagtaacaggaacagtaaattttggatcattaaattttagacaaagagtatcattaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagttca

SEQ ID NO: 48851 - RNA, 372 nt, synthetic construct
  misc_feature 1..372: note = derived and/or modified sequence opt6 from anti-HIV-1_HeavyChain
  source 1..372: mol_type = other RNA
caagtacaattaggacaaagtggagcagaaatgaaaaaaccaggaagtagtgtaaaagtaagttgtaaagcaagtggaggaacatttagacatagtccaataagttgggtaagacaagcaccaggacaaggactagaatggataggatgggtaaaagcagtaagtggagcagtaaattatggaagtttagattttagacatagagtaagtttaacaagagatagagatttaagtacagcacatatggatataagaggattaacacaagatgatacagcaacatatttttgtgcaagacaaaaatttgcaagaggagatcaaggatggttttttgatttatggggaagaggaacattaatagtagtaagcagt

SEQ ID NO: 48852 - RNA, 369 nt, synthetic construct
  misc_feature 1..369: note = derived and/or modified sequence opt6 from anti-HIV-1_HeavyChain
  source 1..369: mol_type = other RNA
caagtacaattagtacaaagtggagcagaagtaagaacaccaggagcaagtgtaaaagtaagttgtaaagcaagtggatataattttatagcatatcatgtacattgggtaagacaagcaccaggacaaggattaacatggatgggatggataaatccagatagtggagatacagtatatgcacaaaattttgtagatagagtaatgatgacaagaaatacaagtatacaaacagtatatttagaattaaatgtattaacattagaagatacagcaacatatttttgtgcaagacaaaaatttgcaagaggagatcaaggatggttttttgatttatggggaagaggaacactaatagtagtaagtagt

SEQ ID NO: 48853 - RNA, 372 nt, synthetic construct
  misc_feature 1..372: note = derived and/or modified sequence opt6 from anti-HIV-1_HeavyChain
  source 1..372: mol_type = other RNA
caagtacaattagtacaaagtggagcagaagtaaaaaaaccaggagcaagtgtaaaagtaagttgtaaagcaagtggatatacatttacagtatattatatgcattgggtaagacaagcaccaggaagaggattagaatggataggatgggtaaaagcagtaagtggagcagtaaattatggatcattagattttagacatagagtatcattaacaagagatagagatttatttacagcacatatggatataagaggattaacacaagatgatacagcaacatatttttgtgcaagacaaaaatttgcaagaggagatcaaggatggttttttgatctatggggaagaggaacattaatagtagtaagttca

SEQ ID NO: 48854 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaattaggagcaagtgtaagagtaagttgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagtttaacaagagatagagatttatttacagcacatatggatataagaggattaacacaaggagatacggcaacatatttttgtgcaagacaaaaatttgaaagaggaggacaaggatggtattttgatttatggggaagaggaacattaatagtagtaagtagt

SEQ ID NO: 48855 - RNA, 372 nt, synthetic construct
  misc_feature 1..372: note = derived and/or modified sequence opt6 from anti-HIV-1_HeavyChain
  source 1..372: mol_type = other RNA
caagtacaattagtacaaagtggagcagaagtaaaaaaaccaggagcaagtgtaaaagtaagttgtaaagcaagtggatatacattcataggatattatatgcattgggtaagacaagcaccaggacaaggattagaatggatgggatgggtaaaaacagtaacaggagcagtaaattttggatcaccaaattttagacatagagtatcattaacaagagatagagatttatttacagcacatatggatataagaggactaacacaaggagatacagcaacatatttttgtgcaagacaaaaatttgaaagaggaggacaaggatggtattttgatttatggggaagaggaacattaatagtagtaagttca

SEQ ID NO: 48856 - RNA, 375 nt, synthetic construct
  misc_feature 1..375: note = derived and/or modified sequence opt6 from anti-HIV-1_HeavyChain
  source 1..375: mol_type = other RNA
caagcacatctagaacaaagtggaagtggagtaaaaaaaccaggagcaagtgtaagagtaagctgttggacaagtgaagatatatttgaaagaacagaattaatacattgggtaagacaagcaccaggacaaggattagaatggataggatgggtaaaaacagtaagtggagcagtaaattttggaagtttaaattttagacatagagtaagtttaacaagagatagagatttatttacagcacatatggatataagaggattaacacaaggagatacagcaacatatttttgtgcaagacaaaaatttgcaagaggagatcaaggatggttttttgatctatggggaagaggaacattaatagtagtaagtagt

SEQ ID NO: 48857 - RNA, 372 nt, synthetic construct
  misc_feature 1..372: note = derived and/or modified sequence opt6 from anti-HIV-1_HeavyChain
  source 1..372: mol_type = other RNA
caagcacatttagaacaaagtggaagtggagtaaaaaaattgggagcaagtgtaagagtaagttgttggacaagtgaagatatatttaaagatagaatagatcattgggtaagacaagcaccaggacaaggattagaatggataggatgggtaaaagcagtaagtggagcagtaaattatggatcattagattttagacatagagtatcattaacaagagatagagatttatttacagcacatatggatataagaggattaacacaagatgatacagcaacatatttttgtgcaagacaaaaatttgcaagaggagatcaaggatggttttttgatttatggggaagaggaacattaatagtagtaagttca

SEQ ID NO: 48858 - RNA, 375 nt, synthetic construct
  misc_feature 1..375: note = derived and/or modified sequence opt6 from anti-HIV-1_HeavyChain
  source 1..375: mol_type = other RNA
caagtacaattagcacaaagtggagcagaagtaaaaaaattaggagcaagtgtaagagtaagttgttggacaagtgaagatatatttgaaagaacagaattaatacattgggtaagacaagcaccaggacaaggattagaatggataggatgggtaaaagcagtaagtggagcagtgaattatggaagtttagattttagacatagagtaagtttaacaagagatagagatttatttacagcacatatggatataagaggattaacacaagatgatacagcaatatatttttgtgcaagacaaaaatttgcaagaggagatcaaggatggttttttgatttatggggaagaggaacactaatagtagtaagtagt

SEQ ID NO: 48859 - RNA, 372 nt, synthetic construct
  misc_feature 1..372: note = derived and/or modified sequence opt6 from anti-HIV-1_HeavyChain
  source 1..372: mol_type = other RNA
caagcacatctagaacaaagtggaagtggagtaaaaaaaccaggagcaagtgtaagagtgagttgttggacaagtgaagatataagtaaagcagaattaatacattgggtaagacaagcaccaggacaaggattagaatggataggatgggtaaaaacagtaagtggagcagtaaattttggatcaccaaattttagacatagagtatcattaacaagagatagagatctatttacagcacatatggatataagaggattaacacaaggagatacagcaacatatttttgtgcaagacaaaaatttgaaagaggaggacaaggatggtattttgatttatggggaagaggaacattaatagtagtaagttca

SEQ ID NO: 48860 - RNA, 372 nt, synthetic construct
  misc_feature 1..372: note = derived and/or modified sequence opt6 from anti-HIV-1_HeavyChain
  source 1..372: mol_type = other RNA
acagcacatttagaacaaagtggaagtggagtaagaagaccaggagcaagtgtaagagtaagttgttggacaagtggagatatatttaaaagcgaattaatacattgggtaagacaagcaccaggacaaggattagaatggataggatgggtaaaaacagtaacaggagcagtaaattttggatcaagtgattttagacaaagagtatcattaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagttca

SEQ ID NO: 48861 - RNA, 372 nt, synthetic construct
  misc_feature 1..372: note = derived and/or modified sequence opt6 from anti-HIV-1_HeavyChain
  source 1..372: mol_type = other RNA
caagcgcatttagaacaaagtggaagtggagtaaaaagaccaggagcaagtgtaagagtaagttgttggacaagtgaagatatatttaatacagaattaatacattgggtaagacaagcaccaggacaaggattagaatggataggatgggtaaaaacagtaagtggagcagtaaattttggatcattaaattttagacatagagtatcattaacaagagatagagatttatttacagcacatatggatataagaggattaacacaaggagatacagcaacatatttttgtgcaagacaaaaatttgcaagaggagatcaaggatggttttttgatttatggggaagaggaacattaatagtagtaagttca

SEQ ID NO: 48862 - RNA, 372 nt, synthetic construct
  misc_feature 1..372: note = derived and/or modified sequence opt6 from anti-HIV-1_HeavyChain
  source 1..372: mol_type = other RNA
caagcacatttagaacaaagtggaagtggagtaaaaaaaccaggagcaagtgtaagagtaagttgttggacaagtgaagatatatttaaaacagaattaatacattgggtaagacaagcaccaggacaaggattagaatggataggatgggtaaaagcagtaagtggagcagtgaattatggatcattagattttagacatagagtatcattaacaagagatagagatttatcaacagcacatatggatataagaggattaacacaagatgatacagcaacatatttttgtgcaagacaaaaatttgcaagaggagatcaaggatggttttttgatctatggggaagaggaacattaatagtagtaagttca

SEQ ID NO: 48863 - RNA, 372 nt, synthetic construct
  misc_feature 1..372: note = derived and/or modified sequence opt6 from anti-HIV-1_HeavyChain
  source 1..372: mol_type = other RNA
caagtacaattagtacaaagtggagcagaagtaaaaaaaccaggagcaagtgtaagagtaagttgtaaagcaagtggatatacatttacagcatattatatacattgggtaagacaagcaccaggacaaggattagaatggataggatgggtaaaaacagtaagtggagcagtaaattttggatcaccaaattttagacatagagtatcactaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagt

SEQ ID NO: 48864 - RNA, 372 nt, synthetic construct
  misc_feature 1..372: note = derived and/or modified sequence opt6 from anti-HIV-1_HeavyChain
  source 1..372: mol_type = other RNA
caagcacatttagaacaaagtggaagtgaaagtaaaaaaccaggagcaagtgtaagagtaagttgttggtcaagtgaagatatatttaaaacagaattaatacattgggtaagacaagcaccaggacaaggattagaatggataggatgggtaaaaatagtaagtggagcagtaaattttggatcaccaaattttagacaaagagtatcattaacaagagatagagatttatttacagcacatatggatataagaggattaacacaaggagatacagcaacatatttttgtgcaagacaaaaatttgaaagaggaggacaaggatggatatttgatttatggggaagaggaacattaatagcagtaagttca

SEQ ID NO: 48865 - RNA, 375 nt, synthetic construct
  misc_feature 1..375: note = derived and/or modified sequence opt6 from anti-HIV-1_HeavyChain
  source 1..375: mol_type = other RNA
caagcacatctagaacaaagcggaagtgaagtaaaaaaaccaggagcaagtgtaagagtaagttgttggacaagtgaagatatatttgaaaaaagtgaattaatacattgggtaagacaagcaccaggacaaggattagaatggataggatgggtaaaaacagtaacaggagcagtaaattttggaagtagcgattttagacaaagagtaagtttaacaagagatagagatttatttacagcacatatggatataagaggactaacacaaggagatacagcaacatatttttgtgcaagacaaaaattttatgcaggaggacaaggatggtattttgatttatggggaagaggaacattaatagtagtaagtagt

SEQ ID NO: 48866 - RNA, 372 nt, synthetic construct
  misc_feature 1..372: note = derived and/or modified sequence opt6 from anti-HIV-1_HeavyChain
  source 1..372: mol_type = other RNA
caagcacatttagaacaagtatgggcaggagtaaaaaaattaggagcaagtgtaagagtaagttgttggacaagtgaagatatatttaaaacagaattaatacattgggtaagacaagcaccaggacaaggattagaatggataggatgggtaaaagcagtaagtggagcagtaaattatggaagtttagattttagacatagagtaagtttaacaagagatagagatctaagtacagcacatatggatataagaggattaacacaagatgatacagcaacatatttttgtgcaagacaaaaatttgcaagaggagatcaaggatggttttttgatttatggggaagaggaacattaatagtagtaagtagt

SEQ ID NO: 48867 - RNA, 372 nt, synthetic construct
  misc_feature 1..372: note = derived and/or modified sequence opt6 from anti-HIV-1_HeavyChain
  source 1..372: mol_type = other RNA
caagcacatttagaacaaagtggaagtggagtaaaaaaaccaggagcaagcgtaagagtaagttgttggacaagtgaagatatatttgaaagatcagaattaatacattgggtaagacaagcaccaggacaaggattagaatggataggatgggtaaaaacagtaacaggagcagtaaattttggaagtaattttagacaaagagtatcattaacaagagatagagatttatttacagcacatatggatataagaggattaacacaaggagatacagcaacatatttttgtgcaagacaaaaattttatgcaggaggacaaggatggtattttgatttatggggaaggggaacattaatagtagtaagttca

SEQ ID NO: 48868 - RNA, 375 nt, synthetic construct
  misc_feature 1..375: note = derived and/or modified sequence opt6 from anti-HIV-1_HeavyChain
  source 1..375: mol_type = other RNA
caaagtcatttagaacaaagtggaagtgcaatgaaaaaaccaggagcaagtgtaagagtaagctgttggacaagtgaagatatatttgatacaacagaattaatatattgggtaagacaagcaccaggacaaggattagaatggataggatgggtaaaaatagtaagtggaacagtaaattttgcaagtttagattttagacatagagtaagtttaacaagagatagggatttaagtacagcacatatggatataagaggattaacacaagatgatacagcaacatatttttgtgcaagacaaaaatttgcaagaggagatcaaggatggttttttgatttatggggaagaggaacattaatagtagtaagtagt

SEQ ID NO: 48869 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggaacaagtgtaagagtaagttgttggacaagcgaagatatatttgaaagaacagaattaatacattgggtaagacaagcaccaggacaaggattagaatggatagggtgggtaaaaacagtaacaggagcagtaaattttggaagtccaaattttagacatagagtaagtttaacaagagatagagatttatttacagcacatatggatataagaggattaacacaaggagatacagcaacatatttttgtgcaagacaaaaatttgcaagaggagatcaaggatggttttttgatttatggggaagaggaacattaatagtagtaagtagt

SEQ ID NO: 48870 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagcggagtaaaaaaaccaggagcaagtgtaagagtaagttgttggacaagtggaggaatatttgaaagaacagaactaatacattgggtaagacaagcaccaggacaaggattagaatggataggatgggtaaaaacagtaacaggagcagtaaattttggaagtccaaattttagacatagagtaagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagt

SEQ ID NO: 48871 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggagtagtgaagatatatttgaaagaacagaattaatacattgggtaagacaagcaccaggacaaggattagaatggataggatgggtaaaaacagtaacaggagcagtaaattttggaagtttagattttagacatagaataagcttaacaagagatagagatttatttacagcacatatggatataagaggattaacacaagatgatacagcaacatatttttgtgcaagacaaaaatttgcaagaggagatcaaggatggttttttgatttatggggaagaggaacattaatagtagtaagcagt

SEQ ID NO: 48872 - RNA, 372 nt, synthetic construct
  misc_feature 1..372: note = derived and/or modified sequence opt6 from anti-HIV-1_HeavyChain
  source 1..372: mol_type = other RNA
caagcacatttagaacaaagtggaagtggagtaaaaaaaccaggagcaagtgtaagagtaagttgttggacaagtgaagatatatttaaaagtgaattaatacattgggtaagacaagcaccaggacaaggattagaatggataggatgggtaaaaacagtaacaggagcagtaaattttggaagtagtgattttagacaaagggtaagtttaacaagagatagagatttatttacagcacatatggatataagaggattaacacaaggagatacagcaacatatttttgtgcaagacaaaaatttgaaagaggaggacaaggatggatatttgatctatggggaagaggaacattaatagcagtaagtagt

SEQ ID NO: 48873 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaagaccaggagcaagtgtaagagtaagctgttggacaagtgaagatatatttgaaacaacagaattaatacattgggtaagacaagcaccaggacaaggattagaatggataggatgggtaaaaacagtaagtggagcagtaaattttggaagtttaaattttagacatagagtaagtttaacaagagatagagatttatttacagcacatatggatataagaggattaacacaaggagatacagcaacatatttttgtgcaagacaaaaatttgcaagaggagatcaaggatggttttttgatttatggggaagaggaacattaatagtagtaagtagt

SEQ ID NO: 48874 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaattaggagcaagcgtaagagtaagttgttggacaagtgaagatatatttgaaagaacagaattaatacattgggtaagacaagcaccaggacaaggattagaatggataggatgggtaaaagcagtaagtggagcagtaaattatggaagtttagattttagacaaagagtgagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 48875 - RNA, 372 nt, synthetic construct
  misc_feature 1..372: note = derived and/or modified sequence opt6 from anti-HIV-1_HeavyChain
  source 1..372: mol_type = other RNA
caagcacatttagaacaaagcggaagtggagtaaaaaaaccaggagcaagtgtaagagtaagttgttggacaagtgaagatatatttgaaaaatcagaattaatacattgggtaagacaagcaccaggacaaggattagaatggataggatgggtaaaaacagtaacaggagcagtaaatttagtacatcaaatatcagatagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagttca

SEQ ID NO: 48876 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagcgaagatatatttgaaaaaagtgaattaatacattgggtaagacaagcaccaggacaaggattagaatggataggatgggtaaaaacagtaacaggagcagtaaattttggaagcagtgattttagacaaagagtaagtttaacaagaggaagagatttatttacagcacatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 48877 - RNA, 375 nt, synthetic construct
  misc_feature 1..375: note = derived and/or modified sequence opt6 from anti-HIV-1_HeavyChain
  source 1..375: mol_type = other RNA
caagcacatctagaacaaagtggagcaggagtaaaaaaaccaggagcaagtgtaagagtaagttgttggacaagtgaagatatatttgaaagaacagaactaatacattgggtaagacaagcaccaggacaaggattagaatggataggatgggtaaaaacagtaacaggagcagtaaattttggaagcccaaattttagacatagagtaagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagc

SEQ ID NO: 48878 - RNA, 375 nt, synthetic construct
  misc_feature 1..375: note = derived and/or modified sequence opt6 from anti-HIV-1_HeavyChain
  source 1..375: mol_type = other RNA
caaagtcatttagaacaaagtggaagcgcaatgaaaaaaccaggagcaagtgtaagggtaagttgttggacaagtgaagatatatttgatacaacagaattaatacattgggtaagacaagcaccaggacaaggattagaatggataggatgggtaaaagcagtaagtggagcagtaaattatggaagtttagattttagacatagagtaagtttaacaagagatagagatttaagtacagcacatatggatataagaggattaacacaagatgatacagcaacatatttttgtgcaagacaaaaatttgcaagaggagatcaaggatggttttttgatttatggggaagaggaacattaatagtagtaagtagt

SEQ ID NO: 48879 - RNA, 372 nt, synthetic construct
  misc_feature 1..372: note = derived and/or modified sequence opt6 from anti-HIV-1_HeavyChain
  source 1..372: mol_type = other RNA
caagcacatttagaacaaagcggaagtggagtaaaaaaaccaggagcaagtgtaagagtaagctgttggacaagtgaagatatatttaaaacagaattaatacattgggtaagacaagcaccaggacaaggattagaatggataggatgggtaaaaacagtaagtggagcagtaaattttggaagtccaaattttagacatagagtatcattaacaagagatagagatttatttacagcacatatggatataagaggattaacacaaggagatacagcaacatatttttgtgcaagacaaaaatttgaaagaggaggacaaggatggtattttgatttatggggaagaggaacactaatagtagtaagttca

SEQ ID NO: 48880 - RNA, 375 nt, synthetic construct
  misc_feature 1..375: note = derived and/or modified sequence opt6 from anti-HIV-1_HeavyChain
  source 1..375: mol_type = other RNA
caagtacatttagaacaaagtggaagtggagtaaaaaaattaggagcaagtgtaagagtaagttgttggacaagtgaagatatatttgaaagaacagaattaatacattgggtaagacaagcaccaggacaaggattagaatggataggatgggtaaaagcagtaagtggagcagtaaattatggaagtttagattttaggcatagagtaagtttaacaagagatagagatttatttacagcacatatggatataagaggattaacacaagatgatacagcaacatatttttgtgcaagacaaaaatttgcaagaggagatcaaggatggttttttgatttatggggaagaggaacactaatagtagtaagtagt

SEQ ID NO: 48881 - RNA, 372 nt, synthetic construct
  misc_feature 1..372: note = derived and/or modified sequence opt6 from anti-HIV-1_HeavyChain
  source 1..372: mol_type = other RNA
caagcacatttagaacaaagtgcaagtggagtaaaaagaccgggagcaagtgtaagagtaagttgttggacaagtgaagatatatttgaaagatcagaattaatatattgggtaagacaagcaccaggacaaggattagaatggataggatgggtaaaaacagtatcaggagcagtaaatttagcaccaaattttagacaaagagtatcattaacaagagatagagatttatttacagcacatatggatataagaggattaacacaaggagatacagcaacatatttttgtgcaagacaaaaatttgaaagaggaggacaaggatggatatttgatttatggggaagaggaacattaatagcagtaagttca

SEQ ID NO: 48882 - RNA, 372 nt, synthetic construct
  misc_feature 1..372: note = derived and/or modified sequence opt6 from anti-HIV-1_HeavyChain
  source 1..372: mol_type = other RNA
caagcacatttagaacaaagtggaagtggagtaaaaaaaccaggagcaagtgtaagagtaagctgttggacaagtgaagatatatttaaaagtgaattaatacattgggtaagacaagcaccaggacaaggattagaatggataggatgggtaaaaacagtaacaggagcagtaaattttggatcaagtgattttagacaaagagtatcattaacaagagatggagatttatttacagcacatatggatataagaggattaacacaaggagatacagcaacatatttttgtgcaagacaaaaattttatgcaggaggacaaggatggtattttgatttatggggaagaggaacgttaataatagtaagttca

SEQ ID NO: 48883 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaattaggagcaagtgtaagagtaagttgttggacaagtgaagatatatttgaaagaacagaattaatacattgggtaagacaagcaccaggacaaggactagaatggataggatgggtaaaagcagtaagtggagcagtaaattatggaagcttagattttagacatagagtaagtttaacaagtgatagagatttaagtacagcacatatggatataagaggattaacacaagatgatacagcaacatatttttgtgcaagacaaaaatttgcaagaggagatcaaggatggttttttgatttatggggaagaggaacattaatagtagtaagtagt

SEQ ID NO: 48884 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaaaaagtgaattaatacattgggtgagacaagcaccaggacaaggattagaatggataggatgggtaaaaacagtaacgggagcagtaaattttggaagtagtgactttagacaaagagtaagtttaacaagagatagagatttaagtacagcacatatggatataagaggattaacacaagatgatacagcaacatatttttgtgcaagacaaaaatttgcaagaggagatcaaggatggttttttgatttatggggaagaggaacattaatagtagtaagcagt

SEQ ID NO: 48885 - RNA, 372 nt, synthetic construct
  misc_feature 1..372: note = derived and/or modified sequence opt6 from anti-HIV-1_HeavyChain
  source 1..372: mol_type = other RNA
caagcacatttagaacaaagtggaagtggagtaaaaaaaccaggagcaagtgtaagagtaagttgttggacaagtgaagatatatttaaaagtgaactaatacattgggtaagacaagcaccaggacaaggattagaatggataggatgggtaaaaacagtaacaggagcagtaaattttggatcaagtgattttagacaaagagtatcactaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagttca

SEQ ID NO: 48886 - RNA, 372 nt, synthetic construct
  misc_feature 1..372: note = derived and/or modified sequence opt6 from anti-HIV-1_HeavyChain
  source 1..372: mol_type = other RNA
caagcacatttagaacaaagcggaagtggagtaaaaaaaccaggagcaagtgtaagagtaagttgttggacaagtgaagatatatttgaaaaatcagaattaatacattgggtaagacaagcaccaggacaaggattagaatggataggatgggtaaaaacagtaacaggagcagtaaattttggacatcaaatatcagatagagtaagtttaacaagagatagagatttatttacagcacatatggatataagaggattaacacaaggagatacagcaacatatttttgtgcaagacaaaaattttatgcaggaggacaaggatggtattttgatctatggggaagaggaacattaatagtagtaagttca

SEQ ID NO: 48887 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaaaaagtgaattaatacattgggtaagacaagcaccaggacaaggattagaatggataggatgggtaaaaacagtaacaggagcagtaaattttggaagtagtgattttagacaaagagtaagtctaacaagagatagagatttatttacagcacatatggatataagaggattaacacaagatgatacagcaacatatttttgtgcaagacaaaaatttgcaagaggagatcaaggatggttttttgatttatggggaagaggaacattaatagtagtaagtagt

SEQ ID NO: 48888 - RNA, 372 nt, synthetic construct
  misc_feature 1..372: note = derived and/or modified sequence opt6 from anti-HIV-1_HeavyChain
  source 1..372: mol_type = other RNA
caagcgcatttagaacaaagtggaagtggagtaaaaaaattaggagcaagtgtaagagtaagctgttggacaagcgaagatatattaaaaacagaattaatacattgggtaagacaagcaccaggacaaggattagaatggataggatgggtaaaagcagtaagtggagcagtaaattatggatcattagattttagacatagagtatcattaacaagagatagagatttatttacagcacatatggatataagaggactaacacaagatgatacagcaacatatttttgtgcaagacaaaaatttgcaagaggagatcaaggatggttttttgatttatggggaagaggaacattaatagtagtaagctca

SEQ ID NO: 48889 - RNA, 372 nt, synthetic construct
  misc_feature 1..372: note = derived and/or modified sequence opt6 from anti-HIV-1_HeavyChain
  source 1..372: mol_type = other RNA
gtaagaagtgtagtacaatgtgaagcaggagtaaaaaaaccaggagcaagtgtaaaaataagttgtgcaacaagtggatatgcatttacattatattatttacattgggtaagacaagcaccaggacaaggattagaatggataggatgggtaaaaacagtaacaggagcagtaaattttggatcagcatattttagacatagagtatcattaacaccagatagagatttatttacagcacatatggatataagaggattaacacaaggagatacagcaacatatttttgtgcaagacaaaaattttataaaggaggacaaggatggtattttgatttatggggaagaggaacattaatagtagtaagcagt

SEQ ID NO: 48890 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaattaggagcaagtgtaagagtaagttgtttagatagtgaagatatatttgaaagaacagaattaatacattgggtaagacaagcaccaggacaaggattagaatggataggatgggtaaaagcagtaagtggagcagtgaattatggaagtttagattttagacatagagtaagtttaacaagagatagagatttatttacagcgcatatggatataagaggattaacacaagatgatacagcaacatatttttgtgcaagacaaaaatttgcaagaggagatcaaggatggttttttgatttatggggaagaggaacattaatagtagtaagtagt

SEQ ID NO: 48891 - RNA, 375 nt, synthetic construct
  misc_feature 1..375: note = derived and/or modified sequence opt6 from anti-HIV-1_HeavyChain
  source 1..375: mol_type = other RNA
caaagtcatttagaacaaagtggaagtgcaatgaaaaaaccaggagcaagtgtaagagtaagttgttggacaagcgaagatatatttgatacaacagaattaatatattgggtaagacaagcaccaggacaaggattagaatggataggatgggtaaaaatagtaagtggaacagtaaattttgcaagtttagattttagaaatagaataagtttaagtagagatagagatttaagtacagcacatatggatataagaggattaacacaagatgatacagcaacatatttttgtgcaagacaaaaatttgcaagaggagatcaaggatggttttttgatttatggggaagaggaacattaatagtagtaagtagt

SEQ ID NO: 48892 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaattaggagcaagtgtaaaaagtagttgttggacaagcgaagatatatttgaaagaacagaattaatacattgggtaagacaagcaccaggacaaggattagaatggataggatgggtaaaagcagtaagtggagcagtaaattatggaagtttagattttagacatagagtaagcttaacaagagatagagatttaagtacagcacatatggatataagaggattaacacaagatgatacagcaacatatttttgtgcaagacaaaaatttgcaagaggagatcaaggatggttttttgatttatggggaagaggaacattaatagtagtaagtagt

SEQ ID NO: 48893 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggagcaggagtaaaaaaaccaggagcaagtgtaagagtaagttgttggacaagtgaagatatatttgaaagaacagaattaatacattgggtaagacaagcaccagggcaaggattagaatggataggatgggtaaaaatagtaagtggagcagtaaattttggaagtccaaattttagacaaagagtaagcttaacaagagatagagatttatttacagcacatatggatataagaggattaacacaaggagatacagcaacatatttttgtgcaagacaaaaatttgaaagaggaggacaaggatggatatttgatttatggggaagaggaacattaatagcagtatcaagt

SEQ ID NO: 48894 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatggatgaaaacagtaacaggagcagtaaattttggaagtccaaattttagacatagagtaagtttaacaagagatagagatttatttacagcacatatggatataagaggattaacgcaaggagatacagcaacatatttttgtgcaagacaaaaatttgaaagaggaggacaaggatggtattttgatctatggggaagaggaacattaatagtagtaagtagt

SEQ ID NO: 48895 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtgaagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagtccaaattttagacatagagtaagtttaacaagagacagagatttatttacagcacatatggatataagaggattaacacaaggagatacagcaacatatttttgtgcaagacaaaaatttgaaagaggaggacaaggatggtattttgatttatggggaagaggaacattaatagtagtaagtagt

SEQ ID NO: 48896 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagcggagcaggagtaaaaaaattaggagcaagtgtaagagtaagttgttggacaagtggagatatatttgaaagaacagaattaatacattgggtaagacaagcaccaggacaaggactagaatggataggatgggtaaaagcagtaagcggagcagtaaattatggaagtttagattttagacaaagagtaagtttaacaagagatagagatttatttacagcacatatagatataagaggactaacacaaggggatacagcaacatatttttgtgcaagacaaaaatttgaaagaggaggacaaggatggatatttgatttatggggaagaggaacattaatagcagtaagtagt

SEQ ID NO: 48897 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaattaggagcaagtgtaagagtaagttgttgggcaagtgaagatatatttgaaagaacagaattaatacattgggtaagacaagcaccaggacaaggattagaatggataggatgggtaaaagcagtaagtggagcagtaaattatggaagtctagattttagacatagagtaagtttaacaagagatagagatttaagtacagcacatatggatataagaggattaacacaagatgatacagcaacatatttttgtgcaagacaaaaatttgcaagaggagatcaaggatggttttttgatttatggggaagaggaacattaatagtagtaagtagt

SEQ ID NO: 48898 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggaacagtaaattttggaagtcaaaattttagacaaagagtaagtttaacaagagatagagatttatttacagcacatatggatataagaggattaacacaaggagatacagcaacatatttttgtgcaagacaaaaatttgaaagaggaggacaaggatggatatttgatttatggggaagaggaacactaatagcagtaagtagt

SEQ ID NO: 48899 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaagaccaggagcaagtgtaagagtaagttgttggacaagtgaagatatatttgaaacaacagaattaatacattgggtaagacaagcaccaggacaaggattagaatggataggatgggtaaaaacagtaacaggagcagtaaattttggaagtccaaattttagacatagggtaagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagt

SEQ ID NO: 48900 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcatcagtaagagtaagttgttggacaagtgaagatatattaagaaaaagtgaattaatacattgggtaagacaagcaccaggacaaggattagaatggataggatgggtaaaaacagtaacaggagcagtaaattttggaagtagtgattttagacaaagagtaagtttaacaagagatagagatttatttacagcacatatggatataagaggactaacacaaggagatacagcaacatatttttgtgcaagacaaaaattttatgcaggaggacaaggatggtattttgatttatggggaagaggaacattaatagtagtaagcagc

SEQ ID NO: 48901 - RNA, 372 nt, synthetic construct
  misc_feature 1..372: note = derived and/or modified sequence opt6 from anti-HIV-1_HeavyChain
  source 1..372: mol_type = other RNA
caagcacatttagaacaaagtggaagcggagtaaaaaaaccaggagcaagtgtaagagtaagttgttggacaagtgaagatatatttaaaacagaattaatacattgggtaagacaagcaccaggacaaggattagaatggataggatgggtaaaaacagtaacaggaacagtaaattttggatcattaaattttagacaaagagtatcattaacaagagatagagatttatttacagcacatatggatataagaggattaacacaaggagacacagcaacatatttttgtgcaagacaaaaattttatgcaggaggacaaggatggtattttgatttatggggaagaggaacattaatagtagtaagttca

SEQ ID NO: 48902 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaattaggagcaagtgtaagagtaagttgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagtttaacaagagatagagatttatttacagcacatatggatataagaggattaacacaagatgatacagcaacatatttttgtgcaagacaaaaatttgcaagaggagatcaaggatggttttttgatttatggggaagaggaacattaatagtagtaagtagt

SEQ ID NO: 48903 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggactagaatggataggatgggtaaaaacagtaacaggagcagtaaattttggaagtagtgattttagacaaagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 48904 - RNA, 375 nt, synthetic construct
  misc_feature 1..375: note = derived and/or modified sequence opt6 from anti-HIV-1_HeavyChain
  source 1..375: mol_type = other RNA
caagtacaattagtacaaagtggagcagaagtaaaaaaaccaggagcaagtgtaagagtaagttgttggacaagtgaagatatatttgaaagaagtgaattaatatattgggtaagacaagcaccaggaagaggattagaatggataggatggataaaattagtaagtggagcagtaaattttggaagtgtagattttagagatagagtaagtttaacaagagatagagatttatttacagcacatatggatataagaggattaacacaagatgatacagcaacatatttttgtgcaagacaaaaatttgcaagaggagatcaaggatggttttttgatttatggggaagaggaacattaatagtagtaagtagt

SEQ ID NO: 48905 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtagaagtggagtaaaaaaaccaggagcaagtgtaagagtaagctgttggacaagcgaagatatatttgaaagaacggaattaatacattgggtaagacaagcaccaggacaaggattagaatggataggatgggtaaaagcagtaagtggagcagtaaattttggaagtccaaattttagacatagagtaagtttaacaagagatagagatttaagtacagcacatatggatataagaggattaacacaagatgatacagcaacatatttttgtgcaagacaaaaatttgcaagaggagatcaaggatggttttttgatttatggggaagaggaacattaatagtagtaagcagt

SEQ ID NO: 48906 - RNA, 375 nt, synthetic construct
  misc_feature 1..375: note = derived and/or modified sequence opt6 from anti-HIV-1_HeavyChain
  source 1..375: mol_type = other RNA
caaagttatttagaacaaagtggaagtgcaatgaaaaaaccaggagcaagcgtaagagtaagttgttggacaagtgaagatatatttgatacaacagaattaatatattgggtaagacaagcaccaggacaaggattagaatggataggatgggtaaaaatagtaagtggaacagtaaattttgcaagtttagattttagaaatagaataagtttaagcagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 48907 - RNA, 375 nt, synthetic construct
  misc_feature 1..375: note = derived and/or modified sequence opt6 from anti-HIV-1_HeavyChain
  source 1..375: mol_type = other RNA
caagcacatctagaacaaagtggaagtggagtaaaaaaaccaggagcaagtgtaagagtaagttgttggacaagtgaagatatatttgaaaaaacagaattaatacattgggtaagacaagcaccaggacaaggattagaatggataggatgggtaaaagcagtaagtggagcagtaaattatggaagtttagattttagacatagagtaagtttaacaagagatagagatttatttacagcacatatggatataagaggattaacacaagatgatacagcaacatatttttgtgcaagacaaaaatttgcaagaggagatcaaggatggttttttgatttatgggggagaggaacattaatagtagtaagtagt

SEQ ID NO: 48908 - RNA, 372 nt, synthetic construct
  misc_feature 1..372: note = derived and/or modified sequence opt6 from anti-HIV-1_HeavyChain
  source 1..372: mol_type = other RNA
caagcacatttagaacaaagtggaagtggagtaaaaaaaccaggagcaagcgtaagagtaagttgttggacaagtgaagatatatttaaaagtgaattaatacattgggtaagacaagcaccaggacaaggattagaatggataggatgggtaaaaacagtaacaggagcagtaaattttggatcaagtgattttagacaaagagtatcattaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagttca

SEQ ID NO: 48909 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtgaaaaaaccaggagcaagtgtaagagtaagttgttggacaagtgaagatatatttgaaagaacagaattaatacattgggtaagacaagcaccaggacaaggattagaatggataggatgggtaaaaacagtaagtggagcagtaaattttggaagtccaaattttagacatagagtaagtttaacaagagatagagatttatttacagcacatatggatataagaggattaacacaagatgatacagcaacatatttttgtgcaagacaaaaatttgcaagaggagatcaaggatggttttttgatttatggggaagaggaacattaatagtagtaagtagt

SEQ ID NO: 48910 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaatagtaagtggagcagtaaattttggaagcccaaattttagacaaagagtaagtttaacaagagatagagatttatttacagcacatatggatataagaggattaacacaaggagatacagcaacatatttttgtgcaagacaaaaatttgcaagaggagatcaaggatggttttttgatttatggggaagaggaacattaatagtagtaagtagt

SEQ ID NO: 48911 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaattaggagcaagtgtaagagtaagttgttggacaagtgaagatatatttgaaaggacagaattaatacattgggtaagacaagcaccaggacaaggattagaatggataggatgggtaaaagcagtaagtggagcagtaaattatggaagtttagattttagacatagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 48912 - RNA, 375 nt, synthetic construct
  misc_feature 1..375: note = derived and/or modified sequence opt6 from anti-HIV-1_HeavyChain
  source 1..375: mol_type = other RNA
caaagtcatttagaacaaagcggaagtgcaatgaaaaaaccaggagcaagtgtaagagtaagttgttggacaagtgaagatatatttgatacaacagaattaatatattgggtaagacaagcaccaggacaaggattagaatggataggatgggtaaaaatagtaagtggaacagtgaattttgcaagtttagattttagaaatagaataagtttaagtagagatagagatttaagcacagcacatatggatataagaggactaacacaaggagatacagcaacatatttttgtgcaagacaaaaatttgaaagaggaggacaaggatggtattttgatttatggggaagaggaacattaatagtagtaagtagt

SEQ ID NO: 48913 - RNA, 375 nt, synthetic construct
  misc_feature 1..375: note = derived and/or modified sequence opt6 from anti-HIV-1_HeavyChain
  source 1..375: mol_type = other RNA
caaagtcatttagaacaaagtggaagtgcaatgaaaaaaccaggagcaagtgtaagagtaagctgttggacaagtgaagatatatttgatacaacagaattaatatattgggtaagacaagcaccaggacaaggattagaatggataggatgggtaaaaatagtaagtggaacagtaaattttgcaagtttagattttagacaaagagtaagtttaacaagagatagagatttatttacagcacatatggatataagaggattaacacaaggagatacagcaacatatttttgtgcaagacaaaaatttgaaagaggaggacaaggatggatatttgatttatggggaagaggaacattaatagcagtaagtagt

SEQ ID NO: 48914 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggaacagtaaattttggaagtttaaattttagacaaagagtaagtttaacaagggatagagatttatttacagcacatatggatataagaggattaacacaaggagatacagcaacatatttttgtgcaagacaaaaatttgaaagaggaggacaaggatggatatttgatttatggggaagaggaacattaatagcagtaagtagt

SEQ ID NO: 48915 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagtccaaattttagacatagagtaagtttaacaagagatagagatttatttacagcacatatggatataagaggactaacacaaggagatacagcaacatatttttgtgcaagacaaaaatttgaaagaggaggacaaggatggtattttgatttatggggaagaggaacattaatagtagtaagtagt

SEQ ID NO: 48916 - RNA, 375 nt, synthetic construct
  misc_feature 1..375: note = derived and/or modified sequence opt6 from anti-HIV-1_HeavyChain
  source 1..375: mol_type = other RNA
agacatacagtagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaagtggagcagtaaattttggaagtccaaattttagacatagagtaagtttaacgagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagt

SEQ ID NO: 48917 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaaaaagtgaattaatacattgggtaagacaagcaccaggacaaggattagaatggataggatgggtaaaaacagtaacaggagcagtaaattttggaagtagtgatttcagacaaagagtaagtttaacaagagatagagatttatttacagcacatatggatataagaggattaacacaaggagatacagcaacatatttctgtgcaagacaaaaatttgaaagaggaggacaaggatggtattttgatttatggggaagaggaacattaatagtagtaagtagt

SEQ ID NO: 48918 - RNA, 375 nt, synthetic construct
  misc_feature 1..375: note = derived and/or modified sequence opt6 from anti-HIV-1_HeavyChain
  source 1..375: mol_type = other RNA
agacatacatgggaacaaagcggaagtggagtaaaaaaattaggagcaagtgtaagagtaagctgttggacaagtgaagatatatttgaaagaacagaattaatacattgggtaagacaagcaccaggacaaggattagaatggataggatggatgaaagcagtaagtggagcagtaaattatggaagtctagattttagacatagagtaagtttaacaagagatagagatttaagtacagcacatatagatataagaggattaacgcaagatgatacagcaacatatttttgtgcaagacaaaaatttgcaagaggagatcaaggatggttttttgatctatggggaagaggaacattaatagtagtaagtagt

SEQ ID NO: 48919 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaattaggagcaagtgtaagagtaagttgttggacaagtgaagatatatttgaaagaacagaattaatacattgggtaagacaagcaccgggacaaggattagaatggataggatgggtaaaaacagtaacaggagcagtaaattttggaagtccaaattttaggcatagagtaagtttaacaagagatagagatttatttacagcacatatggatataagaggattaacacaaggagatacagcaacatatttttgtgcaagacaaaaatttgaaagaggaggacaaggatggtattttgatttatggggaagaggaacactaatagtagtaagtagt

SEQ ID NO: 48920 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagtccaaattttagacatagagtaagtttaacaagagatagagatttatttacagcacatatggatataagaggattaacacaaggagatacagcaacatatttttgtgcaagacaaaaatttgaaagaggaggacaaggatggatatttgatttatggggaagaggaacattaatagcagtaagtagt

SEQ ID NO: 48921 - RNA, 375 nt, synthetic construct
  misc_feature 1..375: note = derived and/or modified sequence opt6 from anti-HIV-1_HeavyChain
  source 1..375: mol_type = other RNA
caagcacatctagaacaaagtggaagtggagtaaaaaaaccaggagcaagtgtaagagtaagttgttggacaagtgaagatatatttgaaaaaagtgaattaatacattgggtaagacaagcaccaggacaaggattagaatggataggatgggtgaaaacagtaacaggggcagtaaattttggatcaagtgattttagacatagagtaagtttaacaagagatagagatttatttacagcacatatggatataagaggattaacacaaggagatacagcaacatatttttgtgcaagacaaaaatattatgcaggaggacaaggatggtattttgatttatggggaagaggaacattaatagtagtaagcagt

SEQ ID NO: 48922 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggatcaggagtaaaaaaaccaggagcaagtgtaagagtaagctgttggacaagtgaagatatatttgaaaaaagtgaattaatacattgggtaagacaagcaccaggacaaggattagaatggataggatgggtaaaaacagtaacaggagcagtaaattttggaagtagtgattttagacaaagagtaagcttaacaagagatagagatttatttacagcacatatgggaataagaggattaacacaaggagatacagcaacatatttttgtgcaagacaaaaattttatgcaggaggacaaggatggtattttgatttatggggaagaggaacattaatagtagtaagtagc

SEQ ID NO: 48923 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagcggagtaaaaaaaccaggagcaagcgtaagagtaagttgttggacaagtgaagatatatttgaaaaaagtgaattaatacattgggtaagacaagcaccaggacaaggattagaatggataggatgggtaaaaacagtaacaggagcagtaaattttggaagtagtgattttagacaaagagtatttttaacaagagatagagatttatttacagcacatatggatataagaggattaacacaaggagatacggcaacatatttttgtgcaagacaaaaattttatgcaggaggacaaggatggtattttgatttatggggaagaggaacattaatagtagtaagtagt

SEQ ID NO: 48924 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagctgttggacaagtgaagatatatttgaaagaacagaattaatacattgggtaagacaagcaccagggcaaggattagaatggataggatgggtaaaagcagtaagtggagcagtaaattatggaagtttagattttagacatagagtaagtctaacaagagatagagatttaagtacagcacatatggatataagaggattaacacaagatgatacagcaacatatttttgtgcaagacaaaaatttgcaagaggagatcaaggatggttttttgatttatggggaagaggaacattaatagtagtaagtagt

SEQ ID NO: 48925 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaaaaagtgaattaatacattgggtaagacaagcaccaggacaaggattagaatggataggatgggtaaaaacagtaacaggagcagtaaattttggaagtcaagattttagagatagatttagtttaacaagagatagagatttatttacagcacatatggatataagaggattaacacaaggagatacagcaacatatttttgtgcaagacaaaaattttatgcaggaggacaaggatggtattttgatttatggggaagaggaacactaatagtagtaagtagt

SEQ ID NO: 48926 - RNA, 375 nt, synthetic construct
  misc_feature 1..375: note = derived and/or modified sequence opt6 from anti-HIV-1_HeavyChain
  source 1..375: mol_type = other RNA
caaagtcatttagaacaaagtggaagtgcaatgaaaaaaccaggagcaagtgtaagagtaagttgttggacaagtgaagatatatttgatgcaacaggattaatatattgggtaagacaagcaccaggacaaggattagaatggataggatgggtaaaaatagtaagtggaacagtaaattttgcaagtttagattttagacaaagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 48927 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagcggaagtggagtaaaaaaattaggagcaagtgtaagagtaagctgttggacaagtgaagatatatttgaaagaacagaattaatacattgggtaagacaagcaccaggacaaggattagaatggataggatgggtaaaagcagtaagcggagcagtaaattatggaagtttagattttagacatagagtaagtttaacaagagatagagatttaagtacagcatatatggatataagaggattaacacaagatgatacagcaacatatttttgtgcaagacaaaaatttgcaagaggagatcaaggatggttttttgatttatggggaagaggaacattaatagtagtaagtagt

SEQ ID NO: 48928 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaattaggagcaagtgtaagagtaagttgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagtttaacaagagatagagatttatttacagcacatatggatataagaggattaacacaagatgatacagcaatatatttatgtgcaagacaaaaatttgcaagaggagatcaaggatggttttttgatttatggggaagaggaacattaatagtagtaagtagt

SEQ ID NO: 48929 - RNA, 375 nt, synthetic construct
  misc_feature 1..375: note = derived and/or modified sequence opt6 from anti-HIV-1_HeavyChain
  source 1..375: mol_type = other RNA
caatcacatttagaacaaagcgggagtgcaatgaaaaaaccaggagcaagtgtaagagtaagctgttggacaagtgaagatatatttgatacaacagaattaatatattgggtaagacaagcaccaggacaaggattagaatggataggatgggtaaaaatagtatcaggaacagtaaattttgcaagtttagactttagaaatagaataagtttaagtagagacagagatttaagtacagcacatatggatataagaggattaacacaaggagatacagcaacatatttctgtgcaagacaaaaatttgaaagaggaggacaaggatggatatttgacttatggggaagaggaacattaatagcagtaagtagc

SEQ ID NO: 48930 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagcgaagatatatttgaaaaaagtgaattaatacattgggtaagacaagcaccaggacaaggattagaatggataggatgggtaaaaacagtaacaggagcagtaaattttggaagtccaaattttagacatagagtaagtttaacaagagatagagatttatttacagcacatatggatataagaggattaacacaaggagatacagcaacatatttttgtgcaagacaaaaatttgaaagaggaggacaaggatggtattttgatttatggggaagaggaacgttaatagtagtaagtagt

SEQ ID NO: 48931 - RNA, 375 nt, synthetic construct
  misc_feature 1..375: note = derived and/or modified sequence opt6 from anti-HIV-1_HeavyChain
  source 1..375: mol_type = other RNA
caagcacatccagaacaaagtggaagtggagtaaaaaaaccaggagcaagtgtaagagtatcatgttggacaagtgaagatatatttgaaaaaagtgaattaatacattgggtaagacaagcaccaggacaaggattagaatggataggatgggtaaaaacagtaacaggagcagtaaattttggaagtagtgattttagacaaagagtaagtttaacaagagatagagatttatttacagcacatatggatataagaggattaacacaaggagatacagcaacatatttttgtgcaagacaaaaattttatgcaggaggacaaggatggtattttgatctatggggaagaggaacattaatagtagtaagtagt

SEQ ID NO: 48932 - RNA, 375 nt, synthetic construct
  misc_feature 1..375: note = derived and/or modified sequence opt6 from anti-HIV-1_HeavyChain
  source 1..375: mol_type = other RNA
agagcacatttagaacaaagtggaagtggagtaagaaaaccaggagcaagcgtaagagtaagttgttggacaagtgaagatatatttgaaaaaagtgaattaatacattgggtaaggcaagcaccaggacaaggattagaatggataggatgggtaaaaacagtaacaggagcagtaaattttggaagtagtgattttagacaaagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagc

SEQ ID NO: 48933 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagcgaagatatatttgaaagaacagaattaatacattgggtaagacaagcaccaggacaaggattagaatggataggatgggtaaaaacagtaagtggagcagtaaattttggaagtccaaattttagacatagagtaagtttaacaagagatagagatttatttacagcacatatggatataagaggattaacacaaggagatacagcaacatatttttgtgcaagacaaaaatttgaaagaggaggacaaggatggatatttgatttatggggaaggggaacactaatagcagtaagcagt

SEQ ID NO: 48934 - RNA, 375 nt, synthetic construct
  misc_feature 1..375: note = derived and/or modified sequence opt6 from anti-HIV-1_HeavyChain
  source 1..375: mol_type = other RNA
caaagtcatttagaacaaagtggaagtgcaatgaaaaaaccaggagcaagtgtaagagtaagttgttggacaagtgaagatatatttgaaaaaagtgaattaatacattgggtaaggcaagcaccaggacaaggactagaatggataggatgggtaaaaacagtaacaggagcagtaaattttggaagtagtgattttagacaaagagtaagtctaacaagagatagagatttatttacagcgcatatggatataagaggactaacacaaggagatacagcaacatatttttgtgcaagacaaaaattttatgcaggaggacaaggatggtattttgatttatggggaagaggaacattaatagtagtaagtagt

SEQ ID NO: 48935 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaaaaagtgaattaatacattgggtaagacaagcaccaggacaaggactagaatggataggatgggtaaaaacagtaacaggagcagtaaattttggaagtagtgattttagacaaagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacacatatagtagtaagtagt

SEQ ID NO: 48936 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaaggacagaattaatacattgggtaagacaagcaccaggacaaggattagaatggataggatgggtaaaaatagtaagtggagcagtaaattttggaagtccaaattttagacaaagagtaagtttaacaagagatagagatttatttacagcacatatggatataagaggattaacacaaggagatacagcaacatatttttgtgcaagacaaaaatttgaaagaggaggacaaggatggatatttgatttatggggaagaggaacattaatagcagtaagtagt

SEQ ID NO: 48937 - RNA, 375 nt, synthetic construct
  misc_feature 1..375: note = derived and/or modified sequence opt6 from anti-HIV-1_HeavyChain
  source 1..375: mol_type = other RNA
caaagtcatttagaacaaagtggaagtgcaatgaaaaaaccaggagcaagtgtaagagtaagttgttggacaagtgaagatatatttgatacaacagaattaatatattgggtaagacaagcaccaggacaaggattagaatggataggatgggtaaaaatagtaagtggaacagtaaattttgcaagtagtgattttagacatagagtaagtttaacaagagatagagatttaagtacagcacatatggatataagaggattaacacaagatgatacagcaacatatttttgtgcaagacaaaaatttgcaagaggagatcaaggatggttttttgatttatggggaagaggaacattaatagtagtaagtagt

SEQ ID NO: 48938 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagcggagtaaaaaaaccaggagcaagtgtaagagtaagttgttggacaagtgaagatatatttgaaagaacagaattaatacattgggtaagacaagcaccaggacaaggattagaatggataggatgggtaaaaatagtaagtggagcagtaaattttggaagtccaaattttagacaaagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 48939 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaagaagtgaattaatacattgggtaagacaagcaccaggacaaggattagaatggataggatgggtaaaaacagtaacaggagcagtaaattttggaagtccaaattttagacaaagagtaagtttaacaagagatagagatttatttacagcacatatggatataagaggactaacagaaggagatacagcaacatatttttgtgcaagacaaaaattttatgcaggaggacaaggatggtattttgatttatggggaagaggaacattaatagtagtaagtagt

SEQ ID NO: 48940 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaattaggagcaagtgtaagagtaagttgttggacaagtgaagatatatttgaaagaacagaattaatacattgggtaagacaagcaccaggacaaggattagaatggataggatgggtaaaagcagtaagtggagcagcaaattatggaagtttagattttagacatagagtaagtttaacaagagatagagatttatttacagcacatatggatataagaggattaacacaagatgatacagcaacatatttttgtgcaagacaaaaatttgcaagaggagatcaaggatggttttttgatttatggggaagaggaacattaatagtagtaagtagt

SEQ ID NO: 48941 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaaaaagtgaattaatacattgggtaagacaagcaccaggacaaggattagaatggataggatgggtaaaaacagtaagtggagcagtaaattttggaagtccaaattttagacatagagtaagcttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagt

SEQ ID NO: 48942 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaattaggagcaagtgtaagagtaagttgttggacaagtgaagatatatttgaaagaacagaattaatacattgggtaagacaagcaccaggacaaggattagaatggataggatgggtaaaagcagtaagcggagcagtaaattttggaagtccaaattttaggcatagagtaagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagcagt

SEQ ID NO: 48943 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagcggggtaaaaaaaccaggagcaagcgtaagagtaagttgttggacaagtgaagatatatttgaaagaacagaattaatacattgggtaagacaagcaccaggacaaggattagaatggataggatgggtaaaaatagtaagtggagcagtaaattttggaagcccaaattttagacaaagagtaagtttaacaagagatagagatttatttacagcacatatggatataagaggattaacacaaggagatacagcaacatatttatgtgcaagacaaaaatttgaaagaggaggacaaggatggatatttgatttatggggaagaggaacattaatagcagtaagtagt

SEQ ID NO: 48944 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtgaaaaaaccaggagcaagtgtaagagtaagttgttggagtagtgaagatatatttgaaagaacagaattaatacattgggtaagacaagcaccaggacaaggattagaatggataggatgggtaaaaacagtaagtggagcagtaaattttggaagtccaaattttagacatagagtaagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagc

SEQ ID NO: 48945 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggaacagtaaattttggaagtttaaattttagacaaagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 48946 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtgcaagtggagtaaaaagaccaggagcaagtgtaagagtaagttgttggacaagtgaagatatatttgaaagaagtgaactaatatattgggtaagacaagcaccaggacaaggattagaatggataggatgggtaaaaacagtaagtggagcagtaaattttggaagtacagattttagagaaagagtaagtttaacaagagatagagatctatttacagcacatatggatataagaggattaacacaaggagatacagcaacatatttttgtgcaagacaaaaatttgcaagaggagatcaaggatggttctttgatttatggggaagaggaacattaatagtagtaagtagt

SEQ ID NO: 48947 - RNA, 375 nt, synthetic construct
  misc_feature 1..375: note = derived and/or modified sequence opt6 from anti-HIV-1_HeavyChain
  source 1..375: mol_type = other RNA
caagtacatctagaacaaagtggaagtggagtaaaaaaaccaggagcaagcgtaagagtatcatgttggacaagtgaagatatatttgaaagaagtgaattaatacattgggtaagacaagcaccaggacaaggattagaatggataggatgggtaaaaacagtaacaggagcagtaaattttggaagtccaaattttagacatagagtaagtttaacaagagatagagatttatttacagcacatatggatataagaggattaacacaaggagatacagcaacatatttttgtgcaagacaaaaatattatgcaggaggacaaggatggtattttgatttatggggaagaggaacattaatagtagtaagtagt

SEQ ID NO: 48948 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaaaaagtgaattaatacattgggtaagacaagcaccaggacaaggattagaatggataggatgggtaaaaacagtaacaggagcagtaaattttggaagcagtgattttagacaaagagtaagtttaacaagagatagagatttatttacagcacatatggatatatgtggattaacacaaggagatacagcaacatatttttgtgcaagacaaaaattttatgcaggaggacaaggatggtattttgatttatggggaagaggaacattaatagtagtaagtagt

SEQ ID NO: 48949 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccagaagcatcagtaagagtaagttgttggacaagtgaagatatatttgaaaaaagtgaattaatacattgggtaagacaagcaccaggacaaggattagaatggataggatgggtaaaaacagtgacaggagcagtaaattttggaagtagtgattttagacaaagagtaagtctaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 48950 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagtccaaattttagacaaagagtaagcttaacaagagatagagatttatttacagcacatatggatataagaggattaacacaaggagatacagcaacatatttttgtgcaagacaaaaatttgaaagaggaggacaaggatggatatttgatttatggggaagaggaacattaatagcagtaagtagt

SEQ ID NO: 48951 - RNA, 375 nt, synthetic construct
  misc_feature 1..375: note = derived and/or modified sequence opt6 from anti-HIV-1_HeavyChain
  source 1..375: mol_type = other RNA
caagcacatctagaacaaagtgcaagtggagtaaaaagaccaggagcaagtgtaagagtaagttgttggacaagtgaagatatatttgaaagaacagaactaatatattgggtaagacaagcaccaggacaaggattagaatggataggatgggtaaaaacagtaagtggagcagtaaattttggaagtcaagattttagagatagatttagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagt

SEQ ID NO: 48952 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagcggagtaaaaaaaccaggagcaagtgtaagagtaagttgttggacaagtgaagatatatttgaaaaaagtgaattaatacattgggtaagacaagcaccaggacaaggattagaatggataggatgggtaaaaatagtaagtggagcagtaaattttggaagtccaaattttagacaaagagtaagtttaacaagagatagagatttatttacagcacatatggatataagaggattaacacaaggagatacagcaacatatttttgtgcaagacaaaaatttgaaagaggaggacaaggatggatatttgatttatggggaagaggaacattaatagcagtaagtagt

SEQ ID NO: 48953 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagtccaaattttagacatagagtaagtttaacaagagatagagatccatttacagcacatatggatataagaggattaacacaaggagatacagcaacatatttttgtgcaagacaaaaatttgaaagaggaggacaaggatggtattttgatttatggggaagaggaacattaatagtagtaagtagt

SEQ ID NO: 48954 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagcgtaagagtaagttgttggacaagtgaagatatatttgaaaaaagtggactaatacattgggtaagacaagcaccaggacaaggattagaatggataggatgggtaaaaacagtaacaggagcagtaaattttggaagtagtgattttagacaaagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 48955 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagctgttggacaagtgaagatatatttgaaaaaagtgaattaatacattgggtaagacaagcaccaggacaaggattagaatggataggatgggtaaaagcagtaagtggaacagtaaattatggaagtttagattttagacatagagtaagtttaacaagagatagagatttatttacagcacatatggatataagaggattaacacaagatgatacagcaacatatttttgtgcaagacaaaaatttgcaagaggagatcaaggatggttttttgatttatggggaagaggaacattaatagtagtaagcagt

SEQ ID NO: 48956 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagcgtaagagtaagttgttggacaagtgaagatatatttgaaggaagtgaattaatacattgggtaagacaagcaccaggacaaggattagaatggataggatgggtaaaaacagtaacaggagcagtaaattttggaagtgcatattttagacatagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 48957 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagctgttggagtagtgaagatatatttgaaagaacagaactaatacattgggtaagacaagcaccaggacaaggattagaatggataggatgggtaaaaacagtaacaggagcagtaaattttggaagtttagattttagacatagaataagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 48958 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggagtagtgaagatatatttgaaagaacagaattaatacattgggtaaggcaagcaccaggacaaggattagaatggataggatgggtaaaagcagtaagtggagcagtaaattatggaagtttagattttagacatagagtaagtttaacaagagatagagatttaagtacagcacatatggatataagaggattaacacaagatgatacagcaacacatttttgtgcaagacaaaaatttgcaagaggagatcaaggatggttttttgatttatggggaagaggaacattaatagtagtaagtagt

SEQ ID NO: 48959 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaggaacagaattaatacattgggtaagacaagcaccaggacaaggattagaatggataggatgggtaaaaatagtaagtggagcagtaaattttggaagtccaaattttagacaaagagtaagtttaacaagagatagagatttatttacagcacatatggatataagaggattaacacaaggagatacagcaacatatttttgtgcaagacaaaaatttgaaagaggaggacaaggatggatatttgatttatggggaagaggaacattaatagcagtaagtagt

SEQ ID NO: 48960 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagctgttggacaagtgaagatatatttgaaagaacagaattaatacattgggtaagacaagcaccaggacaaggattagaatggataggatgggtaaaaacagtaacaggagcagtaaattttggaagtccaaattttagacaaagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 48961 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtgagagtaagttgttggacaagtgaagatatatttgaaggaagtgaattaatacattgggtaagacaagcaccaggacaaggattagaatggataggatgggtaaaaacagtaacaggagcagtaaattttggaagtccaaattttagacatagagtaagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagt

SEQ ID NO: 48962 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcatcagtaagagtaagctgttggacaagtgaagatatatttgaaagaacagaattaatacattgggtaagacaagcaccaggacaaggattagaatggataggatgggtaaaaacagtaagtggagcagtaaattttggaagtccaaattttagacatagagtaagtttaacaagagatagagatttatttacagcacatatggatataagaggattaacacaaggagatacagcaacatatttttgtgcaagacaaaaatttgcaagaggagatcaaggatggttttttgatttatggggaagaggaacattaatagtagtatcaagt

SEQ ID NO: 48963 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaaggaatatttgaaagaacagaattaatacattgggtaagacaagcaccaggacaaggattagaatggataggatgggtaaaaatagtaagtggagcagtaaattttggaagtccaaattttagacaaagagtaagtctaacaagagatagagatttatttgcagcacatatggatataagaggattaacacaaggagatacagcaacatatttttgtgcaagacaaaaatttgaaagaggaggacaaggatggatatttgatttatggggaagaggaacattaatagcagtaagtagt

SEQ ID NO: 48964 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaattaggagcaagtgtaagagtaagctgttggacaagtgaagatatatttgaaagagcagaattaatacattgggtaaggcaagcaccaggacaaggattagaatggataggatgggtaaaagcagtaagtggagcagtaaattatggaagtctagattttagacatagagtaagtttaacaagagatagagatttatttacagcacatatggatataagaggattaacacaagatgatacagcaatatatttttgtgcaagacaaaaattttatgcaggaggacaaggatggtattttgatttatggggaagaggaacattaatagtagtaagtagt

SEQ ID NO: 48965 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaattaggagcaagtgtaagagtaagttgttggacaagtgaagatatatttgaaagaacagaattaatacattgggtaagacaagcaccaggacaaggattagaatggataggatgggtaaaagcagtaagtggagcagtaaattatggaagtccaaattttagacaaagagtaagtttaacaagagatagagatttatttacagcacatatggatataagaggattaacacaaggagatacagcaacatatttttgtgcaagacaaaaatttgaaagaggaggacaaggatggatatttgatttatggggaagaggaacgttaatagcagtaagtagc

SEQ ID NO: 48966 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaattatggaagtttaaattttagaagcagaataagtttaacaagagatagagatttatttacagcacatatggatataagaggattaacagaaggagatacagcaacatatttttgtgcaagacaaaaattttatgcaggaggacaaggatggtattttgatttatggggaagaggaacattaatagtagtaagtagt

SEQ ID NO: 48967 - RNA, 375 nt, synthetic construct
  misc_feature 1..375: note = derived and/or modified sequence opt6 from anti-HIV-1_HeavyChain
  source 1..375: mol_type = other RNA
caagcacatctagaacaaagcggaagtggagtaaaaaaaccaggagcaagtgtaagagtaagttgttggacaagtgaagatatatttgaaaaaagtgaattaatacattgggtaagacaagcaccaggacaaggattagaatggataggatgggtaaaaacagtaagcggagcagtaaattttggaagcccaaattttagacaaagagtaagtttaacaagggatagagatttatttacagcacatatggatataagaggattaacacaaggagatacagcaacatatttttgtgcaagacaaaaatttgaaagaggaggacaaggatggatatttgatttatggggaagaggaacattaatagcagtaagtagt

SEQ ID NO: 48968 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagcggagtaaaaaaattaggagcaagtgtaagagtaagttgttggacaagtgaagatatatttgaaagaacagaactaatacattgggtgagacaagcaccaggacaaggattagaatggataagatgggtaaaagcagtaagtggagcagtaaattatggaagtttagattttagacatagagtaagtttaacaagagatagagatttaagtacagcacatatggatataagaggattaacacaagatgatacagcaacatatttttgtgcaagacaaaaatttgcaagaggagatcaaggatggttttttgatttatggggaagaggaacattaatagtagtaagtagt

SEQ ID NO: 48969 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaattaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagtagtgattttagacaaagagtatcattaacaagagatagagatttatttacagcacaaatggatataagaggattaacacaaggagatacagcaacatatttttgtgcaagacaaaaattttatgcaggaggacaaggatggtattttgatttatggggaagaggaacattaatagtagtaagtagt

SEQ ID NO: 48970 - RNA, 372 nt, synthetic construct
  misc_feature 1..372: note = derived and/or modified sequence opt6 from anti-HIV-1_HeavyChain
  source 1..372: mol_type = other RNA
caagcacatttagaacaaagtggaagtggagtaaaaaaaccaggagcaagtgtaagagtaagttgttggacgagtgaagatatatttgaaaaatcagaattaatacattgggtaagacaagcaccaggtcaaggattagaatggataggatgggtaaaaacagtaacaggagcagtaaattttgcacatcaaatatcagatagagtatcattaacaagagatagagatttatttacagcgcatatggatataagaggattaacacaaggagatacagcaacatatttttgtgcaagacaaaaattttatgcaggaggacaaggatggtattttgatttatggggaagaggaacattaatagtagtaagttca

SEQ ID NO: 48971 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagcgaagatatatttgaaagaacagaattaatacattgggtaagacaagcaccaggacaaggattagaatggataggatgggtaaaagtagtaagtggagcagtaaattttggaagtccaaattttagacaaagagtaagtttaacaagagatagagatttatttacagcacatatggatataagaggattaacacaaggagatacagcaacatatttttgtgcaagacaaaaatttgaaagaggaggacaaggatggatatttgatttatggggaagaggaacattaatagcagtaagtagt

SEQ ID NO: 48972 - RNA, 375 nt, synthetic construct
  misc_feature 1..375: note = derived and/or modified sequence opt6 from anti-HIV-1_HeavyChain
  source 1..375: mol_type = other RNA
caagtacatttagaacaaagtggatcaggagtaaaaaaaccaggagcaagtgtaagagtaagttgttggacaagtgaagatatatttgaaaaaagtgaactaatacattgggtaagacaagcaccaggacaaggattagaatggataggatgggtaaaaacagtaacaggagcagtaaattttggaagcagtgattttagacaaagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 48973 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagcggaagtggagtaaaaaaaccaggagcaagtgtaagagtaagttgttggagtagcgaagatatatttgaaagaacagaattaatacattgggtaagacaagcaccaggacaaggattagaatggataggatgggtaaaaacagtaacaggagcagtaaattttggaagtttagattttagacatagaataagtttaacaagagatagagatttatttacagcacatatggatataagaggattaacacaaggagatacagcaacatatttttgtgcaagacaaaaatttgaaagaggaggacaaggatggatatttgatttatggggaagaggaacattaatagcagtaagtagt

SEQ ID NO: 48974 - RNA, 375 nt, synthetic construct
  misc_feature 1..375: note = derived and/or modified sequence opt6 from anti-HIV-1_HeavyChain
  source 1..375: mol_type = other RNA
caaagtcatttagaacaatcaggatcagcaatgaaaaaaccaggagcatcagtaagagtatcatgctggacatcagaagatatatttgacacaacagaattaatatactgggtaagacaagcaccaggacaaggactagaatggataggatgggtaaaaatagtaagcggaacagtaaattttgcatcactagatttcagaaacagaatatcactatcaagagatagagatttatcaacagcatacatggacataagaggactaacacaagatgacacagcaacatatttttgcgcaagacaaaaatttgcaagaggagatcaaggatggttttttgatttatggggaagaggaacactaatagtagtaagctca

SEQ ID NO: 48975 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagcgaagatatatttgaaagaacagaattaatacattgggtaagacaagcaccaggacaaggattagaatggataggatgggtaaaaacagtaacaggagcagtaaattttggaagcccaaattttagacatagggtaagtttaacaagagatagagatttatttacagcacatatggatataagaggattaacacaaggagatacagcaacatatttatgtgcaagacaaaaatttgaaagaggaggacaaggatggtattttgatttatggggaagaggaacattaatagtagtaagtagt

SEQ ID NO: 48976 - RNA, 372 nt, synthetic construct
  misc_feature 1..372: note = derived and/or modified sequence opt6 from anti-HIV-1_HeavyChain
  source 1..372: mol_type = other RNA
agacatacatgggaacaaagtggaagtggagtaaaaaaaccaggagcaagtgtaagagtaagttgttggacaagtgaagatatatttaaaagtgaattaatacattgggtaagacaagcaccaggacaaggattagaatggataggatgggtaaaaacagtaacaggagcagtaaattttggatcaagtgattttaggcaaagagtatcattaacaagagatagagatttatttacagcacatatggatataagaggactaacacaaggagatacagcaacatatttttgtgcaagacaaaaattttatgcaggaggacaaggatggtattttgatttatggggaagaggaacattaatagtagtaagttca

SEQ ID NO: 48977 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagcgtaagagtaagttgttggacaagtgaagatatatttgaaagaacagaattaatacattgggtaagacaagcaccaggacaaggattagaatggataggatgggtaaaaacagtaacaggagcagtaaattttggaagtccaaattttagacatagagtaagtttaacaagagatagagatttatttacagcacatatggatataagaggattaacagaaggagatacagcaacatatttttgtgcaagacaaaaattttatgcaggaggacaaggatggtattttgatttatggggaagaggaacattaatagtagtaagtagt

SEQ ID NO: 48978 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagcggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagtgcatattttagacatagagtaagtttaacaagagatagagatttatttacagcacatatggatataagaggattaacacaaggagatacagcaacgtatttttgtgcaagacaaaaattttataaaggaggacaaggatggtattttgatttatggggaagaggaacattaatagtagtaagtagt

SEQ ID NO: 48979 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaccaggagtaaaaaaattaggagcaagtgtaagagtaagttgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagtttaacaagagatagagatttatttacagcacatatggatataagaggattaacacaagatgatacagcaacatatttttgtgcaagacaaaaatttgcaagaggagatcaaggatggttttttgatttatggggaagaggaacattaatagtagtaagtagt

SEQ ID NO: 48980 - RNA, 375 nt, synthetic construct
  misc_feature 1..375: note = derived and/or modified sequence opt6 from anti-HIV-1_HeavyChain
  source 1..375: mol_type = other RNA
agagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaatagtaagtggagcagtaaattttggaagtccaaattttagacaaagagtaagtttaacaagggatagagatttatttacagcacatatggatataagaggattaacacaaggagatacagcaacatatttttgtgcaagacaaaaatttgaaagaggaggacaaggatggatatttgatttatggggaagaggaacattaatagcagtaagtagt

SEQ ID NO: 48981 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaattaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagtagtgattttagacaaagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 48982 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggagtagtgaagatatatttgaaagaacagaattaatacattgggtaagacaagcaccaggacaaggattagaatggataggatgggtaaaagcagtaagtggagcagtaaattatggaagtttagattttagacatagagtaagtttaacaagagatagagatttatttacagcacatatggatataagaggattaacacaagatgatacagcaatatatttttgtgcaagacaaaaatttgcaagaggagatcaaggatggttttttgatttatggggaagaggaacattaatagtagtaagtagt

SEQ ID NO: 48983 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaagtaggagcaagtgtaagagtaagttgttggacaagtgaagatatatttgaaagaacagaattaatacattgggtaagacaagcaccaggacaaggattagaatggataggatgggtaaaagcagtaagtggagcagtaaattatggaagtctagattttagacatagagtaagtttaacaagagatagagatctatttacagcacatatggatataagaggattaacacaagatgatacagcaatatatttttgtgcaagacaaaaatttgcaagaggagatcaaggatggttttttgatttatggggaagaggaacattaatagtagtaagtagt

SEQ ID NO: 48984 - RNA, 375 nt, synthetic construct
  misc_feature 1..375: note = derived and/or modified sequence opt6 from anti-HIV-1_HeavyChain
  source 1..375: mol_type = other RNA
caagtacaattagtacaaagtggagcagaattaaaaaaaccaggaagtagtgtaagagtaagttgttggacaagtgaagatatatttgaaggaagtgaattaatacattgggtaagacaagcaccaggacaaggattagaatggataggatgggtaaaaacagtaacaggagcagtaaattttggaagtgcatattttagacatagagtaagtttaacaagagatagagatttatttacagcacatatggatataagaggactaacacaaggagatacagcaacatatttttgtgcaagacaaaaattttataaaggaggacaaggatggtactttgatttatggggaagaggaacattaatagtagtaagtagt

SEQ ID NO: 48985 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagcggaagtggagtaaaaaaaccaggagtaagtgtaagagtaagttgttggacaagtgaagatatatttgaaagaacagaattaatacattgggtaagacaagcaccaggacaaggattagaatggataggatgggtaaaaatagtaagtggagcagtaaattttggaagtccaaattttagacaaagagtaagtttaacaagagatagagatttatttacagcacatatggatataagaggattaacacaaggagatacagcaacatatttttgtgcaagacaaaaatttgaaagaggaggacaaggatggatatttgatttatggggaagaggaacattaatagcagtaagtagt

SEQ ID NO: 48986 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaattaggagcaagtgtaagagtaagttgttggacaagtgaagatatatttgaaagaacagaattaatacattgggtaagacaagcaccaggacaaggattagaatggataggatgggtaaaagtagtaagtggagcagtaaattatggaagtttagattttagacatagagtaagtttaacaagagatagagatttatttacagcacatatggatataagaggattaacacaagatgatacagcaacatatttttgtgcaagacaaaaatttgcaagaggagatcaaggatggttttttgatttatggggaagaggaacattaatagtagtaagcagt

SEQ ID NO: 48987 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaattaggagcaagtgtaagagtaagttgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagtttaacaagagatagagatttatttacagcacatatggatataagaggattaacacaagatgatacagcagcatatttttgtgcaagacaaaaatttgcaagaggagatcaaggatggttttttgatttatggggaagaggaacattaatagtagtaagtagt

SEQ ID NO: 48988 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaagaaaaccaggagcaagtgtaagagtaagttgttggacaagtgaagatatatttgaaaaatcagaattaatacattgggtaagacaagcaccaggacaaggattagaatggataggatgggtaaaaacagtaacaggagcagtaaattttggaagtagtgattttagacaaagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 48989 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggaacagtaaattttggaagtttaaattttagacaaagagtaagtttaacaagagatagagatttatttacagcacatatggatataagaggattaacacaaggagatacagcaacatatttttgtgcaagacaaaaattttataaaggaggacaaggatggtattttgatctatggggaagaggaacattaatagtagtaagtagt

SEQ ID NO: 48990 - RNA, 375 nt, synthetic construct
  misc_feature 1..375: note = derived and/or modified sequence opt6 from anti-HIV-1_HeavyChain
  source 1..375: mol_type = other RNA
caaagccatttagaacaaagtggaagtgcaatgaaaaaaccaggagcaagcgtaagagtaagttgttggacaagtgaagatatatttgaaagaacagaattaatacattgggtaagacaagcaccaggacaaggattagaatggataggatgggtaaaagcagtaagtggagcagtaaattatggaagcttagattttagacatagagtaagtttaacaagagatagagatttatttacagcacatatggatataagaggactaacacaagatgatacagcaacatatttttgtgcaagacaaaaatttgcaagaggagatcaaggatggttttttgatttatggggaagaggaacattaatagtagtaagtagt

SEQ ID NO: 48991 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggagtagtgaagatatatttgaaagaacagaattaatacattgggtaagacaagcaccaggacaaggattagaatggataggatgggtaaaaacagtaacaggagcagtaaattttggaagtttagattttagacatagagtaagtttaacaagagatagagatttatttacagcacatatggatataagaggattaacacaaggagatacagcaacatatttttgtgcaagacaaaaatttgcaagaggagatcaaggatggttttttgatttatggggaagaggaacattaatagtagtaagtagt

SEQ ID NO: 48992 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaagaccaggagcaagtgtaagagtaagttgttggacaagtgaagatatatttgaaacaacagaattaatacattgggtaagacaagcaccaggacaaggattagaatggataggatgggtaaaaacagtaagtggagcagtaaattttggaagtttaaattttagacatagagtaagtttaacaagagatagagatttatttacagcacatatggatataagaggattaacacaaggagatacagcaacatatttttgtgcaagacaaaaattttataaaggaggacaaggatggtattttgacttatggggaagaggaacattaatagtagtaagtagt

SEQ ID NO: 48993 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtgcaagtggagtaagaagaccaggagcaagtgtaagagtaagttgttggacaagtgaagatatatttgaaagaagtgaattaatatattgggtaagacaagcaccaggaagaggattagaatggataggatggataaaattagtaagtggagcagtaaattttggaagtgtagattttagagatagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 48994 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggagtagcgaagatatatttgaaagaacagaattaatacattgggtaagacaagcaccaggacaaggactagaatggataggatgggtaaaaatagtaagtggagcagtaaattttggaagtccaaattttagacaaagagtaagtttaacaagagatagagatttatttacagcacatatggatataagaggattaacacaaggagatacagcaacatatttttgtgcaagacaaaaatttgaaagaggaggacaaggatggatatttgatttatggggaagaggaacattaatagcagtaagtagt

SEQ ID NO: 48995 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaattaggagcaagtgtaagagtaagttgttggacaagtgaagatatatttgaaagaacagaattaatacattgggtaagacaagcaccaggacaaggattagaatggataggatgggtaaaaacagtaagtggagcagtaaattttggaagtccaaattttagacatagagtaagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagt

SEQ ID NO: 48996 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaatcaggatcaggagtaaaaagaccaggagcatcagtaagagtatcatgttggacatcagaagatatatttgaaaaatcagaattaatacattgggtaagacaagcaccaggacaaggattagaatggataggatgggtaaaaacagtaacaggagcagtaaattttggaagtagtgattttagacaaagagtatcattaacaagagatagagatttatttacagcacatatgggaataagaggattaacacaaggagatacagcaacatatttttgtgcaagacaaaaattttatgcaggaggacaaggatggtattttgatctatggggaagaggaacattaatagtagtaagctca

SEQ ID NO: 48997 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagtttaacaagagatagagatctatttacagcacatatggatataagaggattaacacaagacgatacagcaatatatttttgtgcaagacaaaaatttgcaagaggagatcaaggatggttttttgatttatggggaagaggaacattaatagtagtaagtagt

SEQ ID NO: 48998 - RNA, 375 nt, synthetic construct
  misc_feature 1..375: note = derived and/or modified sequence opt6 from anti-HIV-1_HeavyChain
  source 1..375: mol_type = other RNA
caaagtcatttagaacaaagtggaagtgcaatgaaaaaattaggagcaagtgtaagagtaccatgttggacaagtgaagatatatttgaaagaacagaattaatacattgggtaagacaagcaccaggacaaggattagaatggataggatgggtaaaagcagtaagcggagcagtaaattatggaagtttagattttagacatagagtaagtttaacaagagatagagatttatttacagcacatatggatataagaggattaacacaagatgatacagcaacatatttttgcgcaagacaaaaatttgcaagaggagatcaaggatggttttttgatttatggggaagaggaacattaatagtagtaagtagt

SEQ ID NO: 48999 - RNA, 375 nt, synthetic construct
  misc_feature 1..375: note = derived and/or modified sequence opt6 from anti-HIV-1_HeavyChain
  source 1..375: mol_type = other RNA
caagtacatttagaacaaagtggaagtggagtaaaaaaaccaggagcaagcgtaagagtaagttgttggacaagtgaagatatatttgaaagaacagaattaatacattgggtaagacaagcaccaggacaaggattagaatggataggatgggtaaaaatagtaagtggagcagtaaattttggaagtccaaattttagacaaagagtaagtttaacaagagatagagatttatttacagcacatatggatataagaggattaacacaaggagatacagcaacatatttttgtgcaagacaaaaatttgaaagaggaggacaaggatggatatttgatttatggggaagaggaacattaatagcagtaagtagt

SEQ ID NO: 49000 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagtttaacaagagatagagatttatttacagcacatatggatataagaggattaacacaagatgatacagcaacatatttttgtgcaagacaaaaatttgcaagaggagatcaaggatggttttttgatttatggggaagaggaacattaatagtagtaagtagt

SEQ ID NO: 49001 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtgcaagtggagtaagaagaccaggagcaagtgtaagggtaagttgttggacaagtgaagatatatttgaaagaagtgaattaatatattgggtaagacaagcaccaggaagaggattagaatggataggatgggtaaaaacagtaagtggagcagtaaattttggaagtccaaattttaggcatagagtaagtttaacaagagatagggatttatttacagcacatatggatataagaggattaacacaaggagatacagcaacatatttttgtgcaagacaaaaatttgaaagaggaggacaaggatggtattttgatttatggggaagaggaacattaatagtagtaagtagt

SEQ ID NO: 49002 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagtccaaattttagacaaagagtaagtttaacaagagatagagatttatttacagcacatatggatataagaggattaacacaaggagatacagcaacatatttttgtgcaagacaaaaatttgaaagaggagggcaaggatggtattttgatttatggggaagaggaacattaatagtagtatcaagc

SEQ ID NO: 49003 - RNA, 375 nt, synthetic construct
  misc_feature 1..375: note = derived and/or modified sequence opt6 from anti-HIV-1_HeavyChain
  source 1..375: mol_type = other RNA
caaagtcatttagaacaaagtggaagtgcaatgaaaaaaccaggagcaagtgtaagagtaagttgttggacaagtgaagatatatttgaaagaacagaattaatatattgggtaagacaagcaccaggaagaggattagaatggataggatgggtaaaaacagtaagtggaacagtaaattttggaagtagtgattttagaaatagaataagtttaacaagagatagagatttaagtacagcacatatggatataagaggattaacacaagatgatacagcaacatatttttgtgcaagacaaaaattttatgcaggaggacaaggatggtattttgatttatggggaagaggaacattaatagtagtaagcagt

SEQ ID NO: 49004 - RNA, 375 nt, synthetic construct
  misc_feature 1..375: note = derived and/or modified sequence opt6 from anti-HIV-1_HeavyChain
  source 1..375: mol_type = other RNA
caagtacaattagaacaatcaggaagtggagtaaaaaaaccaggagcatcagtaagagtatcatgttggacaagtgaagatatatttgaaaaaagcgaattaatacattgggtaagacaagcaccaggacaaggattagaatggataggatgggtaaaaacagtaacaggagcagtaaattttggaagtagtgattttagacaaagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacactaatagtagtaagtagt

SEQ ID NO: 49005 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggaagaggattagaatggataggatgggtaaaagcagtaagtggagcagtaaattatggaagcttagattttagacatagagtaagtttaacaagagatagagatttatttacagcacatatggatataagaggattaacacaagatgatacagcaacatatttttgtgcaagacaaaaatttgcaagaggagatcaaggatggttttttgatttatggggaagaggaacattaatagtagtaagtagt

SEQ ID NO: 49006 - RNA, 375 nt, synthetic construct
  misc_feature 1..375: note = derived and/or modified sequence opt6 from anti-HIV-1_HeavyChain
  source 1..375: mol_type = other RNA
caaagtcatttagaacaaagtggaagtgcaatgaaaaaaccaggagcaagtgtaagagtaagctgttggacaagtgaagatatatttgaaagaacagaattaatacattgggtaagacaagcaccaggacaaggattagaatggataggatgggtaaaaacagtaacaggagcagtgaattttggaagtccaaattttagacatagagtaagcttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtatcaagt

SEQ ID NO: 49007 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtgcaagtggagtaaaaagaccaggagcaagtgtaagagtaagttgttggacaagtgaagatatatttgaaagaagtgaattaatatattgggtaagacaagcaccaggacaaggattagaatggacaggatgggtaaaaacagtaagtggggcagtaaattttggaagtacagattttagagaaagagtaagtttaacaagagatagagatttatttacagcacatatggatataagaggattaacacaaggagatacagcaacatatttttgtgcaagacaaaaatttgcaagaggagatcaaggatggttttttgatttatggggaagaggaacattaatagtagtaagtagt

SEQ ID NO: 49008 - RNA, 375 nt, synthetic construct
  misc_feature 1..375: note = derived and/or modified sequence opt6 from anti-HIV-1_HeavyChain
  source 1..375: mol_type = other RNA
caagtacatttagaacaaagtggaagtggagtaaaaaaattgggagcaagtgtaagagtaagttgttggacaagtgaagatatatttgaaagaacagaattaatacattgggtaagacaagcaccaggaagaggactagaatggataggatgggtaaaagcagtaagtggagcagtaaattatggaagtttagattttagacatagagtaagtttaacaagagatagagatttatttacagcacatatggatataagaggattaacacaagatgatacagcaacatatttttgtgcaagacaaaaatttgcaagaggagatcaaggatggttttttgatttatggggaagaggaacattaatagtagtaagtagc

SEQ ID NO: 49009 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagcggagtaaaaaaaccaggagcaagtgtaagagtaagttgttggacaagtgaagatatatttgaaagaagtgaattaatacattgggtaagacaagcaccaggacaaggattagaatggataggatgggtaaaaacagtaacaggagcagtaaattttggaagtccaaattttagacatagagtaagtttaacaagagatagagatttatttacagcacatatggatataagaggattaacacaaggagatacagcaacatatttttgtgcaagacaaaaatattatgcaggaggacaaggatggtattttgatttatggggaagaggaacattaatagtagtaagtagt

SEQ ID NO: 49010 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagtccaaattttagacatagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 49011 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagctgttggacaagtgaagatatatttgaaaaaagtgaattaatacattgggtaagacaagcaccaggacaaggattagaatggataggatgggtaaaaacagtaacaggagcagtaaattttggaagtagtgattttagacaaagagtgagtttaacaagagatagagacttatttacagcacatatggatataagaggattaacacaaggaggaacagcaacatatttttgtgcaagacaaaaattttatgcaggaggacaaggatggtattttgatttatggggaagaggaacattaatagtagtaagtagt

SEQ ID NO: 49012 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagcgaagatatatttgaaagaacagaattaatacattgggtaagacaagcaccaggacaaggattagaatggataggatgggtaaaaacagtaagtggagcagtaaattttggaagtccaaattttagacatagagtaagtttaacaagagatagagatttatttacagcacatatggatatatgtggattaacacaaggagatacagcaacatatttttgtgcaagacaaaaatttgaaagaggaggacaaggatggtattttgatttatggggaagaggaacattaatagtagtaagcagt

SEQ ID NO: 49013 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaagaaaagtaggagcaagtgtaagagtaagttgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagcttaacaagagatagagatttatttacagcacatatggatataagaggattaacacaagatgatacagcaatatatttttgtgcaagacaaaaatttgcaagaggagatcaaggatggttttttgatttatggggaaggggaacattaatagtagtaagtagt

SEQ ID NO: 49014 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagggtaagttgttggacaagtgaagatatatttgaaagaacagaattaatacattgggtaagacaagcaccaggacaaggattagaatggataggatgggtaaaaacagtaacaggagcagtaaattttggaagtccaaattttagacatagagtaagtttaacaagagatagagatttatttacagcacatatggatataagaggattaacacaaggagatacagcaacatatttttgtgcaagacaaaaatattatgcaggaggacaaggatggtattttgatttatggggaagaggaacattaatagtagtaagtagt

SEQ ID NO: 49015 - RNA, 375 nt, synthetic construct
  misc_feature 1..375: note = derived and/or modified sequence opt6 from anti-HIV-1_HeavyChain
  source 1..375: mol_type = other RNA
caagtacaattagtacaaagtggagcagaagtaaaaaaaccaggagcaagtgtaagagtaagttgttggacaagtgaagatatatttgaaagaacagaattaatacattgggtaagacaagcaccaggacaaggattagaatggataggatgggtaaaaacagtgacaggagcagtaaattttggaagtccaaattttagacatagagtaagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagt

SEQ ID NO: 49016 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaaaaagtgaattaatacattgggtaagacaagcaccaggacaaggattagaatggataggatgggtaaaaacagtaacaggagcagtaaattttggattaagtgattttagacaaagagtaagtttaacaagagatagaggattatttacagcacatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 49017 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggaacaagcgtgagagtaagttgttggacaagtgaagatatatttgaaagaacagaattaatacattgggtaagacaagcaccagggcaaggattagaatggataggatgggtaaaaacagtaacaggagcagtaaattttggaagtccaaattttaggcaaagggtaagtttaacaagagatagagatttatttacagcacatatggatataagaggattaacacaaggagatacagcaacatatttttgtgcaagacaaaaatttgaaagaggaggacaaggatggatatttgatttatggggaagaggaacattaatagcagtaagtagt

SEQ ID NO: 49018 - RNA, 375 nt, synthetic construct
  misc_feature 1..375: note = derived and/or modified sequence opt6 from anti-HIV-1_HeavyChain
  source 1..375: mol_type = other RNA
caaagtcatttagaacaaagtggaagtgcaatgaaaaaaccaggagcaagtgtaagagtaagttgttggacaagtgaagatatatttgatacaacagaattaatatattgggtaagacaagcaccaggacaaggattagaatggataggatgggtaaaaatagtaagtggaacagtaaattttgcgagtttagattttagaaatagaataagtttaagtagagatagagatttaagtacagcacatatggatataagaggattaacacaagatgatacagcaacatatttttgtgcaagacaaaaatttgaaagaggaggacaaggatggtattttgatttatggggaagaggaacattaatagtagtaagtagt

SEQ ID NO: 49019 - RNA, 375 nt, synthetic construct
  misc_feature 1..375: note = derived and/or modified sequence opt6 from anti-HIV-1_HeavyChain
  source 1..375: mol_type = other RNA
caagtacaactagtacaaagtggagcagaagtaaaaaaaccaggagcaagtgtaagagtaagttgttggacaagcgaagatatatttgaaggaagtgaattaatacattgggtaagacaagcaccaggacaaggattagaatggataggatgggtaaaaacagtaacaggagcagtaaattttggaagtgcatattttagacatagagtaagtttaacaagagatagagatttatttacagcacatatggatataagaggattaacacaaggagatacagcaacatatttttgtgcaagacaaaaattttataaaggaggacaaggatggtattttgatttatggggaagaggaacattaatagtagtaagtagt

SEQ ID NO: 49020 - RNA, 375 nt, synthetic construct
  misc_feature 1..375: note = derived and/or modified sequence opt6 from anti-HIV-1_HeavyChain
  source 1..375: mol_type = other RNA
caaagtcatttagaacaaagtggaagtgcaatgaaaaaaccaggagcaagtgtaagagtaagttgttggacaagtgaagatatatttgatacaacagaattaatatattgggtaagacaagcaccaggacaaggattagaatggataggatgggtaaaaatagtaagtggaacagtaaattttgcaagtagtgattttagaaatagaataagtttaagtagagatagagatttaagtacagcacatatggatataagaggattaacacaagatgatacagcaacatatttttgtgcaagacaaaaatttgaaagaggaggacaaggatggatatttgatttatggggaagaggaacattaatagcagtaagtagt

SEQ ID NO: 49021 - RNA, 375 nt, synthetic construct
  misc_feature 1..375: note = derived and/or modified sequence opt6 from anti-HIV-1_HeavyChain
  source 1..375: mol_type = other RNA
caagtacaattagtacaatcaggaacagaagtaaaaaaaccaggagcatcagtaagagtatcatgtaaagcatcaggatatacatttgaaaaaagtgaattaatacattgggtaagacaagcaccaggacaaggattagaatggataggatgggtaaaaacagtaacaggagcagtaaattttggatcaagtgattttagacaaagagtatcattaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagttca

SEQ ID NO: 49022 - RNA, 375 nt, synthetic construct
  misc_feature 1..375: note = derived and/or modified sequence opt6 from anti-HIV-1_HeavyChain
  source 1..375: mol_type = other RNA
caaagtcatttagaacaatcaggaagtgcaatgaaaaaaccaggagcaagtgtaagagtaagttgttggacaagtgaagatatatttgaaagaacagaattaatatattgggtaagacaagcaccaggaagaggattagaatggataggatgggtaaaaacagtaagtggaacagtaaattttggaagtagtgattttagaaatagaataagtttaacaagagatagagatttaagtacagcacatatggatataagaggattaacacaagatgatacagcaacatatttttgtgcaagacaaaaatttgaaagaggaggacaaggatggatatttgatttatggggaagaggaacattaatagcagtaagtagt

SEQ ID NO: 49023 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggagtagtgaagatatatttgaaagaacagaattaatacattgggtaagacaagcaccaggacaaggactagaatggataggatgggtaaaagcagtaagtggagcagtaaattatggaagtttagattttaggcatagagtaagtttaacaagagatagagatttaagtacagcacatatggatataagaggattaacgcaagatgatacagcaacatatttttgtgcaagacaaaaatttgcaagaggagatcaaggatggttttttgatttatggggaagaggaacattaatagtagtaagtagt

SEQ ID NO: 49024 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaaaaagtgaattaatacattgggtaagacaagcaccaggacaaggattagaatggataggatgggtaaaaacagtaacaggagcagtaaattttggaagtagtgattttagacaaagagtaagtttaacaagagatagagatttatttacagcacatatggatataagaggattaacacaagatgatacggcaatatatttttgtgcaagacaaaaatttgcaagaggagatcaaggatggttttttgatttatggggaagaggaacattaatagtagtaagtagt

SEQ ID NO: 49025 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaatcaggaagtggagtaaaaaaaccaggagcaagtgtaagagtatcatgttggacaagtgaagatatatttgaaagaacagaattaatacattgggtaagacaagcaccaggacaaggattagaatggataggatgggtaaaaacagtaacaggagcagtaaattttggaagtttagattttagacatagaataagtttaacaagagatagagatttatttacagcacatatggatataagaggactaacacaaggagatacagcaacatatttttgtgcaagacaaaaattttatgcaggaggacaaggatggtattttgatttatggggaagaggaacattaatagtagtgagtagt

SEQ ID NO: 49026 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaaaaagcgaattagtacattgggtaagacaagcaccaggacaaggattagaatggataggatgggtaaaaacagtaacaggagcagtaaattttggaagtagtgattttagacaaagagtaagtttaacaagagatagagatttatttacagcacatatggatataagaggattaacacaaggagatacagcaacatatttttgtgcaagacaaaaatttgaaagaggaggacaaggatggatatttgatttatggggaagaggaacattaatagcagtatcaagc

SEQ ID NO: 49027 - RNA, 375 nt, synthetic construct
  misc_feature 1..375: note = derived and/or modified sequence opt6 from anti-HIV-1_HeavyChain
  source 1..375: mol_type = other RNA
caagcacatctagaacaaagtggaagcggagtaaaaaaattaggagcaagtgtaagagtaagttgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagtttaacaagagatagagatctatttacagcacatatggatataagaggattaacacaaggagatacagcaacatatttttgtgcaagacaaaaatttgcaagaggagatcaaggatggttttttgatttatggggaagaggaacattaatagtagtaagtagt

SEQ ID NO: 49028 - RNA, 375 nt, synthetic construct
  misc_feature 1..375: note = derived and/or modified sequence opt6 from anti-HIV-1_HeavyChain
  source 1..375: mol_type = other RNA
caagcacatagagaacaaagtggaagtggagtaaaaaaaccaggagcaagtgtaagagtaagttgttggacaagcgaagatatatttgaaagaacagaattaatacattgggtaagacaagcaccaggacaaggattagaatggataggatgggtaaaaacagtaacaggagcagtgaattttggaagtagtgattttagacaaagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 49029 - RNA, 372 nt, synthetic construct
  misc_feature 1..372: note = derived and/or modified sequence opt6 from anti-HIV-1_HeavyChain
  source 1..372: mol_type = other RNA
caagcacatttagaacaaagtggaagtggagtaaaaaaaccaggagcaagtgtaagagtaagttgtttagcaagcgaagatatatttaaaacagaattaatacattgggtaagacaagcaccaggacaaggattagaatggataggatgggtaaaaatagtaagtggagcagtaaattttggatcaccaaattttagacaaagagtatcattaacaagagatagagatttatttacagcacatatggatataagaggattaacacaaggagatacggcaacatatttttgtgcaagacaaaaatttgaaagaggaggacaaggatggatatttgatttatggggaagaggaacactaatagcagtaagttcg

SEQ ID NO: 49030 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaagtaggagcaagtgtaagagtaagttgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagtttaacaagagatagagatttatttacagcacatatggatataagaggattaacacaagatgatacagcaatatatttttgtgcaagacaaaaatttgaaagaggaggacaaggatggatatttgatttatggggaagaggaacattaatagcagtaagtagt

SEQ ID NO: 49031 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaaaaagtgaattaatacattgggtaagacaagcaccaggacaaggattagaatggataggatgggtaaaaacagtaacaggagcagtaaattttggaagtagtgattttagacaaagagtaagtttaacaagagatagagatctatttacagcacatatggatataagaggattaacacaaggagatacagcaacatatttttgtgcaaggcaaaaatttgcaagaggagatcaagggtggttttttgatttatggggaagaggaacattaatagtagtaagtagt

SEQ ID NO: 49032 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtgcaagtggagtaaaaagaccaggagcaagtgtaagagtaagttgttggacaagtgaagatatatttgaaagaagtgaattaatatattgggtaagacaagcaccaggacaaggattagaatggataggatgggtaaaaacagtaacaggagcagtaaattttggaagtagtgattttagacaaagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 49033 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagcggaagtggagtaaaaaaattaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagtccaaattttagacatagagtaagtttaacaagagatagagatttatttacagcacatatggatataagaggattaacacaaggagatacagcaacatatttttgtgcgagacaaaaatattatgcaggaggacaaggatggtattttgatttatggggaagaggaacattaatagtagtaagtagt

SEQ ID NO: 49034 - RNA, 375 nt, synthetic construct
  misc_feature 1..375: note = derived and/or modified sequence opt6 from anti-HIV-1_HeavyChain
  source 1..375: mol_type = other RNA
caagtacaattagtacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaatagtaagtggagcagtaaattttggaagtccaaattttagacaaagagtaagtttaacaagagatagagatttatttacagcacatatggatataagaggattaacacaaggagatacagcaacatatttttgtgcaagacaaaaatttgaaagaggagggcaaggatggatatttgatttatggggaagaggaacattaatagcagtaagcagt

SEQ ID NO: 49035 - RNA, 375 nt, synthetic construct
  misc_feature 1..375: note = derived and/or modified sequence opt6 from anti-HIV-1_HeavyChain
  source 1..375: mol_type = other RNA
agacatacatgggaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaatagtaagtggagcagtaaattttggaagtccaaattttagacaaagagtaagcttaacaagagatagagatttatttacagcacatatggatataagaggattaacacaaggagatacagcaacatatttttgtgcaagacaaaaatttgaaagaggaggacaaggatggatatttgatttatggggaagaggaacattaatagcagtaagtagt

SEQ ID NO: 49036 - RNA, 372 nt, synthetic construct
  misc_feature 1..372: note = derived and/or modified sequence opt6 from anti-HIV-1_HeavyChain
  source 1..372: mol_type = other RNA
agacatacatgggaacaaagtggaagtggagtaaaaaaaccaggagcaagtgtaagagtaagttgttggacaagcgaagatatatttgaaagaacagaattaatacattgggtaagacaagcaccaggacaaggattagaatggataggatgggtaaaaacagtaacaggagcagtaaatttagcaccaaattttagacatagagtaagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagt

SEQ ID NO: 49037 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaggaagtgaattaatacattgggtaagacaagcaccaggacaaggattagaatggataggatgggtaaaaacagtaacaggagcagtaaattttggaagtagtgattttagacaaagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 49038 - RNA, 375 nt, synthetic construct
  misc_feature 1..375: note = derived and/or modified sequence opt6 from anti-HIV-1_HeavyChain
  source 1..375: mol_type = other RNA
caaagtcatttagaacaaagtggaagcgcaatgaaaaaaccaggagcaagtgtaagagtaagttgttggacaagtgaagatatatttgatacaacagaattgatatattgggtaagacaagcaccaggacaaggattagaatggataggatgggtaaaaatagtaagtggaacagtaaattttgcaagtagtgattttagaaatagaataagtttaagtagagatagagatttaagtacagcacatatggatataagaggattaacacaaggagatacagcaacatatttttgtgcaagacaaaaatattatgcaggaggacaaggatggtattttgatttatggggaagaggaacattaatagtagtaagtagt

SEQ ID NO: 49039 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaattaggagcaagtgtaagagtaagttgttggacaagtgaagatatatttgaaagaacagaattaatacattgggtaagacaagcaccaggacaaggattagaatggataggatgggtaaaaatagtaagtggagcagtaaattttggaagtccaaattttaggcaaagagtaagcctaacaagagatagagatttatttacagcacatatggatataagaggattaacacaaggagatacagcaacatatttttgtgcaagacaaaaatttgaaagaggaggacaaggatggatatttgatttatggggaagaggaacattaatagcagtaagtagt

SEQ ID NO: 49040 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagcgtaagagtaagttgttggacaagtgaagatatatttgaaaaaagcgaattaatacattgggtaagacaagcaccaggacaaggattagaatggataggatgggtaaaaacagtaacaggagcagtaaattttggaagtagtgattttagacaaagagtaagtttaacaagagatagagatttatttacagcacatatggatataagaggattaacacaaggagatacagcaacatatttttgtgcaagacaaaaattttataaaggaggacaaggatggtattttgatttatggggaagaggaacattaatagtagtaagtagt

SEQ ID NO: 49041 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagtccaaattttagacatagagtaagtttaacaagagatagagatttatttacagcacatatggatataagaggattaacacaaggagatacagcaacatatttttgtgcaagacaaaaatttgcaagaggagatcaaggatggttttttgatttatggggaagaggaacattaatagtagtaagtagt

SEQ ID NO: 49042 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggatcaggagtaaaaaaattaggagcaagtgtaagagtaagttgttggacaagtgaagacatatttgaaagaacagaattaatacattgggtaagacaagcaccaggaagaggattagaatggataggatgggtaaaagcagtaagtggagcagtaaattatggaagtttagattttagacatagagtaagtttgacaagagatagagatttatttacagcacatatggatataagaggattaacacaaggagatacagcaacatatttttgtgcaagacaaaaatttgaaaggggaggacaaggatggtattttgatttatggggaagaggaacattaatagtagtaagtagt

SEQ ID NO: 49043 - RNA, 375 nt, synthetic construct
  misc_feature 1..375: note = derived and/or modified sequence opt6 from anti-HIV-1_HeavyChain
  source 1..375: mol_type = other RNA
caagcaagaccaggaacaagtggaagtggagtaaaaaaaccaggagcaagtgtaagagtaagttgttggagcagtgaagatatattcgaaagaacagaattaatacattgggtaagacaagcaccaggacaaggattagaatggataggatgggtaaaaacagtaacaggagcagtaaattttggaagtttagattttagacaaagagtaagtttaacaagagatagagatttatttacagcacatatggatataagaggattaacacaaggagatacagcaacatatttttgtgcaagacaaaaatttgaaagaggaggacaaggatggatatttgatttatggggaagaggaacattaatagcagtaagtagt

SEQ ID NO: 49044 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagtccaaattttagacatagagtaagtttaacaagagatagagatttatttacagcacatatggatataagaggattaacagaaggagatacagcaacatatttttgtgcaagacaaaaatttgaaagaggaggacaaggatggatatttgatttatggggaagaggaacattaatagcagtaagtagt

SEQ ID NO: 49045 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagcgtaagagtaagctgttggacaagtgaagatatatttgaaagaacagaattaatacattgggtaagacaagcaccaggacaaggattagaatggataggatgggtaaaagcaataagtggagcagtaaattatggaagtttagattttagacatagagtaagtttaacaagagatagagatttatttacagcacatatggatataagaggattaacacaagatgatacagcaacatatttttgtgcaagacaaaaatttgcaagaggagatcaaggatggttttttgatttatggggaagaggaacattaatagtagtaagttca

SEQ ID NO: 49046 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaaaaagtgaattaatacattgggtaagacaagcaccaggacaaggattagaatggataggatgggtaaaaacagtaacaggagcagtaaatagtggaagtccaaattttagacatagagtaagtttaacaagagatagagatttatttacagcacatatggatataagaggattaacacaaggagatacagcaacatatttttgtgcaagacaaaaatttgaaagaggagggcaaggatggtattttgatttatggggaagaggaacattaatagtagtaagtagt

SEQ ID NO: 49047 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaagagcagaattaatacattgggtaagacaagcaccaggacaaggattagaatggataggatgggtaaaaacagtaagtggggcagtaaattttggaagtttaaattttagacatagagtaagtttaacaagagatagagatttatttacagcacatatggatataagaggattaacacaaggagatacagcaacatatttttgtgcaagacaaaaatttgcaagaggagatcaaggatggttttttgatttatggggaagaggaacattaatagtagtaagtagt

SEQ ID NO: 49048 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaattaggagcaagtgtaagagtaagttgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagtttaacaagagatagagatttaagtacagcacatatggatataagaggattaacacaagatgatacagcaacatatttttgtgcaagacaaaaatttgcaagaggagatcaaggatggttttttgatttatggggaagaggaacattagtaacagtaagtagt

SEQ ID NO: 49049 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagtttaaattttagacatagagtaagtctaacaagagatagagatttatttacagcacatatggatataagaggattaacacaaggagatacagcaacatatttttgtgcaagacaaaaatttgaaagagggggacaaggatggtattttgacttatggggaagaggaacattaatagtagtaagtagt

SEQ ID NO: 49050 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagcggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagtccaaattttagacatagagtaagtttaacaagagatagagatttaagtacagcacatatggatataagaggattaacacaagatgatacagcaacatatttttgtgcaagacaaaaatttgcaagaggagatcaaggatggttttttgatttatggggaagaggaacattaatagtagtaagtagt

SEQ ID NO: 49051 - RNA, 375 nt, synthetic construct
  misc_feature 1..375: note = derived and/or modified sequence opt6 from anti-HIV-1_HeavyChain
  source 1..375: mol_type = other RNA
caaagtcatttagaacaaagtggaagtgcaatgaaaaaaccaggagcaagtgtaagagtaagttgttggacaagtgaagatatatttgatacaacagaattaatatattgggtaagacaagcaccaggacaaggattagaatggataggatgggtaaaaacagtaacaggagcagtaaattttggaagtccaaattttagacatagagtgagtctaacaagagatagagatttatttacagcacatatggatataagaggattaacacaaggagatacagcaacatatttttgtgcaagacaaaaatattatgcaggaggacaaggatggtattttgatttatggggaagaggaacattaatagtagtaagcagt

SEQ ID NO: 49052 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagcgaagatatatttgaaagaacagaattaatacattgggtaagacaagcaccaggacaaggattagaatggataggatgggtaaaaacagcaagtggagcagtaaattttggaagtccaaattttagacatagagtaagtttaacaagagatagagatttatttacagcacatatggatataagagggttaacacaaggagatacagcaacatatttttgtgcaagacaaaaatttgaaagaggaggacaaggatggtattttgatttatggggaagaggaacattaatagtagtaagtagt

SEQ ID NO: 49053 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaattaggagcaagtgtaagagtaagttgttggacatcagaagatatatttgaaagaacagaattaatacattgggtaagacaagcaccaggacaaggattagaatggataggatgggtaaaagcagtaagtggagcagtaaattatggaagcttagattttagacatagggtaagcttaacaagagatagagatttatttacagcacatatggacataagaggattaacacaagatgatacagcaacatatttttgtgcaagacaaaaatttgaaagaggaggacaaggatggtattttgatttatggggaagaggaacattaatagtagtaagtagt

SEQ ID NO: 49054 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtgcaagtggagtaaaaagaccaggagcaagtgtaagagtaagttgttggacaagtgaagatatatttgaaagaagtgaattaatatattgggtaagacaagcaccaggacaaggactagaatggataggatgggtaaaaacagtaagtggagcagtaaattttggaagtacagattttagagaaagagtaagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagt

SEQ ID NO: 49055 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagcggagtaaaaaaattaggagcaagcgtaagagtaagctgttggacaagtgaagatatatttgaaagaacagaattaatacattgggtaagacaagcaccaggacaaggattagaatggataggatgggtaaaagcagtaagtggagtagtaaattatggaagtttagattttagacatagagtaagtttaacaagagatagagatttaagtacagcacatatggatataagaggattaacacaagatgatacagcaacatatttttgtgcaaggcaaaaatttgcaagaggagatcaaggatggttttttgatttatggggaagaggaacattaatagtagtaagtagt

SEQ ID NO: 49056 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaagtaggagcaagtgtaagagtaagttgttggacaagtgaagatatatttgaaagaacagaattaatacattgggtaagacaagcaccaggacaaggactagaatggataggatgggtaaaaacagtaagcggagcagtaaattttggaagtccaaattttagacatagagtaagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagt

SEQ ID NO: 49057 - RNA, 375 nt, synthetic construct
  misc_feature 1..375: note = derived and/or modified sequence opt6 from anti-HIV-1_HeavyChain
  source 1..375: mol_type = other RNA
caagcatatttagaacaaagtggaagtataatgaaaaaaccaggagcaagtgtaagagtaagttgttggacaagtgaagatatatttgatagaacagaattaatacattgggtaagacaagcaccaggacaaggattagaatggataggatgggtaaaaacagtaacaggagcagtaaattttggaagtagtgattttagacaaagagtaagcttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 49058 - RNA, 375 nt, synthetic construct
  misc_feature 1..375: note = derived and/or modified sequence opt6 from anti-HIV-1_HeavyChain
  source 1..375: mol_type = other RNA
caagcacatctagaacaatcaggaagtggagtaaaaaaaccaggagcaagtgtaagagtaagttgttggacatcagaagatatatttgaaaaaagtgaattaatacattgggtaagattagcaccaggacaaggattagaatggataggatgggtaaaaacagtaacaggagcagtaaattttggaagtagtgattttagacaaagagtaagtttaacaagagatagagatttatttacagcacatatggatataagaggattaacacaaggagatacagcaacatatttttgtgcaagacaaaaattttatgcgggaggacaaggatggtattttgatttatggggaagaggaacattaatagtagtaagtagc

SEQ ID NO: 49059 - RNA, 375 nt, synthetic construct
  misc_feature 1..375: note = derived and/or modified sequence opt6 from anti-HIV-1_HeavyChain
  source 1..375: mol_type = other RNA
gaagcacatttagaacaaagtggaagtggagtaaaaaaaccaggagcaagtgtaagagtaagttgttggacaagtgaagatatatttgaaagaacagaattaacacattgggtaagacaagcaccaggacaaggattagaatggataggatgggtaaaaacagtaacaggagcagtaaattttggaagtccaaattttagacaaagagtaagtttaacaagagatagagatttatttacagcacatatggatataagaggattaacacaaggagatacagcaacatatttttgtgcaagacaaaaatttgaaagaggaggacaaggatggatatttgatttatggggaagaggaacattaatagcagtaagtagt

SEQ ID NO: 49060 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatatgaaagaacagaattaatacattgggtaagacaagcaccaggacaaggattagaatggataggatgggtaaaagcagtaagtggagcagtaaattatggaagcttagattttagacatagagtaagtttaacaagagatagagatttatttacagcacatatggatataagaggattaacacaagatgatacagcaatatatttttgtgcaagacaaaaatttgcaagaggagatcaaggatggttttttgatttatggggaagaggaacattaatagtagtaagtagt

SEQ ID NO: 49061 - RNA, 375 nt, synthetic construct
  misc_feature 1..375: note = derived and/or modified sequence opt6 from anti-HIV-1_HeavyChain
  source 1..375: mol_type = other RNA
caagtacatttagaacaaagtggaagtggagtaaaaaaaccaggagcaagtgtaagagtaagttgttggacaagtgaagatatatttgaaagaacagaattaatacattgggtaagacaagcgccaggacaaggattagaatggataggatgggtaaaaacagtaacaggagcagtaaattttggaagtccaaattttagacatagagtaagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagcagt

SEQ ID NO: 49062 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaagtaggagcaagtgtaagagtaagttgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagtctaacaagagatagagatttaagtacagcacatatggatataagaggattaacacaagatgatacagcaacatatttttgtgcaagacaaaaatttgcaagaggagatcaaggatggttttttgatttatggggaagaggaacattaatagtagtaagcagt

SEQ ID NO: 49063 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaagtggagcagtaaattttggaccaccaaattttagacatagagtaagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagt

SEQ ID NO: 49064 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaattaggagcaagtgtaagagtaagttgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagtttaacaagagatagagatttaagtacagcacatatggatataagaggactaacacaagatgatacagcaacatatttttgtgcaagacaaaaatttgaaagaggaggacaaggatggatatttgatttatggggaagaggaacattaatagcagtaagtagt

SEQ ID NO: 49065 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaagaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagcagtgattttagacaaagagtaagtttaacaagagacagagatttatttacagcacatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 49066 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtgaaaaaattaggagcaagtgtaagagtaagttgttggacaagtgaagatatatttgaaagaacagaattaatacattgggtaagacaagcaccaggaagaggattagaatggataggatgggtaaaagcagtaagtggagcagtaaattatggaagtccaaattttagacatagagtaagcttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagt

SEQ ID NO: 49067 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggactagaatggataggatgggtaaaaacagtaagtggagcagtaaattttggaagtccaaattttagacatagagtaagtttaacaagagatagagatttatttacagcacatatggatataagaggactaacacaaggagatacagcaacatatttttgtgcaagacaaaaatttgaaagaggaggacaaggatggtattttgatttatggggaagaggggcattaatagtagtaagtagt

SEQ ID NO: 49068 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaaaaagtgaattaatacattgggtaagacaagcaccaggacaaggattagaatggataggatgggtaaaaacagtaacaggagcagtaaattttggaagtgcatattttagacatagagtaagtttaacaagagatagagatttatttacagcacatatggatataagaggattaacacaaggagatacagcaacatatttttgtgcaagacaaaaattttataaaggaggacaaggatggtattttgacttatggggaagaggaacattaatagtagtaagcagt

SEQ ID NO: 49069 - RNA, 375 nt, synthetic construct
  misc_feature 1..375: note = derived and/or modified sequence opt6 from anti-HIV-1_HeavyChain
  source 1..375: mol_type = other RNA
caaagtcatctagaacaaagtggaagtgcaatgaaaaaaccaggagcaagtgtaagagtaagttgttggacaagtgaagatatatttgaaagaacagaattaatatattgggtaagacaagcaccaggaagaggattagaatggataggatgggtaaaaacagtaagtggaacagtaaattttggaagcttagattttagacatagagtaagtttaacaagagatagagatttaagtacagcacatatggatataagaggattaacacaagatgatacagcaacatatttttgtgcaagacaaaaatttgcaagaggagatcaaggatggttttttgatttatggggaagaggaacattaatagtagtaagtagt

SEQ ID NO: 49070 - RNA, 375 nt, synthetic construct
  misc_feature 1..375: note = derived and/or modified sequence opt6 from anti-HIV-1_HeavyChain
  source 1..375: mol_type = other RNA
caaagtcatttagaacaatcaggatcagcaatgaaaaaaccaggagcatcagtaagagtatcatgctggacatcagaagatatatttgacacaacagaattaatatactgggtaagacaagcaccaggacaaggactagaatggataggatgggtaaaaatagtaagcggaacagtaaattttgcatcaagtgatttcagaaacagaatatcattatcaagagatagagatttatcaacagcacatatggacataagaggactaacacaagatgacacagcaacatatttttgtgcaagacaaaaattttatgcaggaggacaaggatggtattttgatttatggggaagaggaacactaatagtagtaagcagt

SEQ ID NO: 49071 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaattaggagcaagtgttagagtaagttgttggacaagtgaagatatatttgaaagaacagaattaatacattgggtaagacaagcaccaggacaaggattagaatggataggatgggtaaaagcagtaacaggagcagtaaattttggaagtagtgattttagacaaagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 49072 - RNA, 375 nt, synthetic construct
  misc_feature 1..375: note = derived and/or modified sequence opt6 from anti-HIV-1_HeavyChain
  source 1..375: mol_type = other RNA
caaagtcatttagaacaaagtggaagtgcaatgaaaaaaccaggagcaagtgtaagagtaagttgttggacaagtgaagatatatttgaaagaacagaattaatatattgggtaagacaagcaccaggaagaggattagaatggataggatgggtaaaaacagtaagtggagcagtaaattttggaagtagtgattttagacaaagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 49073 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagtccaaattttagacatagagtaagtttaacaagagatagagatttatttacagcgcatatggatataagaggattaacacaaggagatgcagcaacatatttttgtgcaagacaaaaatttgaaagaggaggacaaggatggtattttgatttatggggaagaggaacattaatagtagtaagtagt

SEQ ID NO: 49074 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagcggagtaaaaaaattaggagcaagtgtaagagtaagttgttggacaagtgaagatatatttgaaagaacagaattaatacattgggtaagacaagcaccaggaagaggattagaatggataggatgggtaaaagcagtaagtggagcagtaaattatggaagtttagattttagacatagagtaagtttaacaagagatagagatttatttacagcacatatggatataagaggattaacgcaagatgatacagcaacatatttttgtgcaagacaaaaattttatgcaggaggacaaggatggtattttgatttatggggaagaggaacattaatagtagtaagcagc

SEQ ID NO: 49075 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagcggagtaaaaaaaccaggagcaagtgtaagagtaagttgttggacaagtgaagatatatttgaaagaacagaattaatacattgggtaagacaagcgccaggacaaggattagaatggataggatgggtaaaaatagtaagtggagcagtaaattttggaagtccaaattttagacaaagagtaagtttaacaagagatagagatttatttgcagcacatatggatataagaggattaacacaaggagatacagcaacatatttttgtgcaagacaaaaatttgaaagaggaggacaaggatggatatttgatttatggggaagaggaacattaatagcagtaagtagt

SEQ ID NO: 49076 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaagaacagaactaatacattgggtaagacaagcaccaggacaaggattagaatggataggatgggtaaaaacagtaacaggagcagtaaattttggaagcccaaattttagacatagagtaagtttaacaagagatagagatttatttacagcacatatggatataagaggattagcacaaggagatacagcaacatatttttgtgcaagacaaaaatttgaaagaggaggacaaggatggtattttgatttatggggaagaggaacattaatagtagtaagtagt

SEQ ID NO: 49077 - RNA, 375 nt, synthetic construct
  misc_feature 1..375: note = derived and/or modified sequence opt6 from anti-HIV-1_HeavyChain
  source 1..375: mol_type = other RNA
caaagtcatttagaacaaagtggaagtgcaatgaaaaaaccaggagcaagtgtaagagtaagttgttggacaagtgaagatatatttgatacaacagaattaatatattgggtaaggcaagcaccaggacaaggattagaatggataggatgggtaaaaatagtaagtggaacagtaaattttgcaagtagtgattttagaaatagaataagtttaagtagagatagagatttaagtacagcacatatggatataagaggactaacacaagatgatacagcaacatatttttgtgcaagacaaaaatttgaaagaggaggacaaggatggtattttgatttatggggaagaggaacattaatagtagtaagtagt

SEQ ID NO: 49078 - RNA, 375 nt, synthetic construct
  misc_feature 1..375: note = derived and/or modified sequence opt6 from anti-HIV-1_HeavyChain
  source 1..375: mol_type = other RNA
caaagtcatttagaacaaagtggaagtgcaatgaaaaaaccaggagcaagtgtaagagtaagttgttggacaagtgaagatatatttgatacaacagaattaatatattgggtaagacaagcaccaggacaaggattagaatggataggatgggtaaaaatagtaagtggaacagtaaattttgcaagtttagattttagaaatagagtaagtctaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 49079 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaatagtaagtggagcagtaaattttggaagtccaaattttagacatagagtaagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagc

SEQ ID NO: 49080 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaatcaggaagtggagtaaaaaaaccaggagcaagtgtaagagtaagctgttggacaagtgaagatatatttgaaaaaagtgaattaatacattgggtaagaagagcaccaggacaaggattagaatggataggatgggtaaaaacagtaacaggagcagtaaactttggaagtagtgattttagacaaagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 49081 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaattaggagcaagtgtaagagtaagttgttggacaagtgaagatatatttgaaagaacagaattaatacattgggtaagacaagcaccaggacaaggattagaatggataggatgggtaaaagcagtaagtggagcagtaaattatggaagtttagattttagacaaagagtaagtttaacaagagatagagatttatttacagcacatatggatataagaggattaacacaaggagatacagcaacatatttttgtgcaagacaaaaatttgaaagaggagggcaaggatggatatttgatttatggggaagaggaacattaatagcagtaagtagt

SEQ ID NO: 49082 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcatcagtaagggtaagttgttggagtagtgaagatatatttgaaagaacagaattaatacattgggtaagacaagcaccaggacaaggattagaatggataggatgggtaaaaacagtaacaggagcagtaaattttggaagtctagattttagacatagaataagtttaacaagagatagagatttatttacagcacatatggatataagaggattaacacaaggagatacagcaacatatttttgtgcaagacaaaaattttataaaggaggacaaggatggtattttgatttatggggaagaggaacattaatagtagtaagtagt

SEQ ID NO: 49083 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggaacaagtgtaagagtatcatgttggacaagtgaagatatatttgaaaaaagtgaattaatacattgggtaagacaagcaccaggacaaggattagaatggataggatgggtaaaaacagtaacaggagcagtaaattttggaagtagtgattttagacaaagagtaagtttaacaagggatagagatttatttacagcacatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 49084 - RNA, 375 nt, synthetic construct
  misc_feature 1..375: note = derived and/or modified sequence opt6 from anti-HIV-1_HeavyChain
  source 1..375: mol_type = other RNA
caaagtcatttagaacaaagtggaagtgcaatgaaaaaaccaggagcaagtgtaagagtaagttgttggacaagtgaagatatatttgatacaacagaattaatatattgggtaagacaagcaccaggacaaggattagaatggataggatgggtaaaaatagtaagtggaacagtaaattttgcaagtctagattttagaaatagaataagtctaagtagagatagagatttaagtacagcacatatggatataagaggattaacacaagatgatacagcaacatatttttgtgcaagacaaaaattttatgcaggaggacaaggatggtattttgatttatggggaagaggaacattaatagtagtaagtagt

SEQ ID NO: 49085 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaattaggagcaagtgtaagagtaagttgttggacaagcgaagatatatttgaaagaacaggattaatacattgggtaagacaagcaccaggacaaggattagaatggataggatgggtaaaagcagtaagtggagcagtaaattatggaagtttagattttagacatagagtaagtttaacaagagatagagatttatttacagcacatatggatataagaggattaacacaagatgatacagcaacatatttttgtgcaagacaaaaatttgcaagaggagatcaaggatggttttttgatttatggggaagaggaacattaatagtagtaagtagt

SEQ ID NO: 49086 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagcggaagtggagtaaaaaaaccaggaacaagtgtaagagtaagttgttggacaagtgaagatgtatttgaaagaacagaattaatacattgggtaagacaagcaccaggacaaggattagaatggataggatgggtaaaaacagtaataggagcagtgaattttggaagtccaaattttagacatagagtaagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagt

SEQ ID NO: 49087 - RNA, 372 nt, synthetic construct
  misc_feature 1..372: note = derived and/or modified sequence opt6 from anti-HIV-1_HeavyChain
  source 1..372: mol_type = other RNA
caagcacatttagaacaaagtggagcaggagtaaaaaaaccaggagcaagtgtaagagtgagttgttggacaagtgaagatatatttaaaacagaattaatacattgggtaagacaagcaccaggacaaggattagaatggataggatgggtaaaaatagtaagtggagcagtaaattttggaagtccaaattttagacaaagagttagtttaacaagagatagagatttatttacagcacatatggatataagaggattaacacaaggagatacagcaacatatttttgtgcaagacaaaaatttgaaagaggaggacaaggatggatatttgatttatggggaagaggaacattaatagcagtaagttca

SEQ ID NO: 49088 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagcgtaagagtaagttgttggacaagtgaagatatatttgaaagaacagaattaatacattgggtaagacaagcaccaggacaaggattagaatggataggatgggtaaaaacagtaagtggagcagtaaattttggaagtccagattttagacatagagtaagtttaacaagagatagagatttatttacagcacatatggatataagaggattaacacaaggagatacagcaacatatttttgtgcaagacaaaaatttgcaagaggagatcaaggatggttttttgatttatggggaagaggaacattaatagtagtaagtagt

SEQ ID NO: 49089 - RNA, 375 nt, synthetic construct
  misc_feature 1..375: note = derived and/or modified sequence opt6 from anti-HIV-1_HeavyChain
  source 1..375: mol_type = other RNA
caagcacatctagaacaaagcggaagtggagtaaaaagaccaggagcaagtgtaagagtaagttgttggacaagcgaagatatatttgaaacaacagaattaatacattgggtaagacaagcaccaggacaaggattagaatggataggatgggtaaaaacagtaagtggagcagtaaattttggaagtttaaattttagacatagaataagtttaacaagagatagagatttatttacagcacatatggatataagaggattaacacaaggagatacagcaacatatttttgtgcaagacaaaaatttgcaagaggagatcaaggatggttttttgatttatggggaagaggaacattaatagtagtaagtagt

SEQ ID NO: 49090 - RNA, 375 nt, synthetic construct
  misc_feature 1..375: note = derived and/or modified sequence opt6 from anti-HIV-1_HeavyChain
  source 1..375: mol_type = other RNA
caggcacatttagaacaaagcggaagtggagtaaaaaaattaggagcaagtgtaagagtaagctgttggacaagcgaagatatatttgaaagaacagaattaatacattgggtaagacaagcaccaggacaaggactagaatggataggatgggtaaaagcagtaagtggagcagtaaattatggaagtttagattttagacatagagtaagtttaacaagagatagagatttaagtacagcacatatggatataagaggattaacacaagatgatacagcaatatatttttgtgcaagacaaaaatttgcaagaggagatcaaggatggttttttgatttatggggaagaggaacattaatagtagtaagtagt

SEQ ID NO: 49091 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaattaggagcaagcgtaagagtaagttgttggacaagtgaagatatatttgaaagaacagaattaatacattgggtaagacaagcaccaggacaaggattagaatggacaggatgggtaaaagcagtaagtggagcagtaaattatggaagtttagattttagacatagagtaagtttaacaagggatagagatttaagtacagcacatatggatataagaggattaacacaagatgatacagcaacatatttttgtgcaagacaaaaatttgcaagaggagatcaaggatggttttttgatttatggggaagaggaacattaatagtagtaagtagt

SEQ ID NO: 49092 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaattaggagcaagtgtaagagtaagttgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagcttaacaagagatagagatttatttacagcacatatggatataagaggaccaacacaagatgatacagcaacatatttttgtgcaagacaaaaatttgcaagaggagatcaaggatggttttttgatttatggggaagaggaacattaatagtagtaagtagt

SEQ ID NO: 49093 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaattaggagcaagtgtaagagtaagttgttggacaagtgaagatatatttgaaaggacagaattaatacattgggtaagacaagcaccaggacaaggattagaatggataggatgggtaaaagcagtaagtggagcagtaaattatggaagtttagattttagacatagagtaagtttaacaagagatagagatttaagtacagcacatatggatataagaggattaacacaaggagatacagcaacatatttttgtgcaagacaaaaatttgaaagaggaggacaaggatggtattttgatttatggggaagaggaacattaatagtagtaagtagt

SEQ ID NO: 49094 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggagtagtgaagatatatttgaaagaacagaattaatacattgggtaagacaagcaccaggacaaggattagaatggataggatgggtaaaaacagtaacaggagcagtaaattttggaagtccaaattttagacatagagtaagtctaacaagagatagagatttatttacagcacatatggatataagaggattaacacaaggagatacagcaacatatttttgtgcaagacaaaaatttgaaagaggaggacaaggatggtattttgatttatggggaagaggaacattaatagtggtaagtagt

SEQ ID NO: 49095 - RNA, 375 nt, synthetic construct
  misc_feature 1..375: note = derived and/or modified sequence opt6 from anti-HIV-1_HeavyChain
  source 1..375: mol_type = other RNA
agacatacatggaatgaaagcggaagtggagtaaaaaaaccaggagcaagtgtaagagtaagttgttggacaagtgaagatatatttgaaagaacagaattaatacattgggtaagacaagcaccaggacaaggattggaatggataggatgggtaaaaacagtaacaggaacagtaaattttggaagtttaaattttagacaaagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 49096 - RNA, 375 nt, synthetic construct
  misc_feature 1..375: note = derived and/or modified sequence opt6 from anti-HIV-1_HeavyChain
  source 1..375: mol_type = other RNA
caagcacatctagaacaaagtggagcaggagtaaaaagaccaggagcaagtgtaagagtaagttgttggacaagtgaagatatatttgaaacaacagaattaatacattgggtaagacaagcaccaggacaaggattagaatggataggatgggtaaaaacagtaagtggagcagtaaattttggaagtccaaattttagacatagagtaagtttaacaagagatagagatttatttacagcacatatggatataagaggattaacacaaggagatacagcaacatatttttgtgcaagacaaaaatttgaaagaggaggacaaggatggtattttgatctatggggaagaggaacattaatagtagtaagtagt

SEQ ID NO: 49097 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagcggaagtggagtaaaaaaaccaggagcaagcgtaagagtaagttgttggacaagtgaagatatatttgaaagaacagaattaatacattgggtaagacaagcaccaggacaaggattagaatggataggatgggtaaaagcagtaagtggagcagtaaattttggaagtccaaattttagacatagagtaagtttaacaagagatagagatctatttacagcacatatggatataagaggattaacacaaggagatacagcaacatatttttgtgcaagacaaaaatttgaaagaggaggacaaggatggtattttgatttatggggaagaggaacattaatagtagtaagcagt

SEQ ID NO: 49098 - RNA, 375 nt, synthetic construct
  misc_feature 1..375: note = derived and/or modified sequence opt6 from anti-HIV-1_HeavyChain
  source 1..375: mol_type = other RNA
caagcacatttaggaacaatattaggattagaaagtaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcaagtatactagcaccaaatttcagacatagagtaagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagttca

SEQ ID NO: 49099 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagcggaagtggagtaaaaaaaccaggagcaagtgtaagagtaagttgttggacaagcgaagatatatttgaaagaacagaattaatacattgggtaagacaagcaccaggacaaggattagaatggataggatgggtaaaaacagtaacaggagcagtaaattttggaagtccaaattttagacatagagtaagtttaacaagagatagagcattatttacagcacatatggatataagaggattaacacaaggagatacagcaacatatttttgtgcaagacaaaaatttgcaagaggagatcaaggatggttttttgatttatggggaagaggaacattaatagtagtaagtagt

SEQ ID NO: 49100 - RNA, 375 nt, synthetic construct
  misc_feature 1..375: note = derived and/or modified sequence opt6 from anti-HIV-1_HeavyChain
  source 1..375: mol_type = other RNA
agagtacatttagaacaaagcggaagtggagtaaaaaaaccaggagcaagtgtaagagtaagttgttggacaagtgaagatatatttgaaagaacagaattaatacattgggtaagacaagcaccaggacaaggactagaatggataggatgggtaaaaacagtaacgggagcagtaaattttggaagtccaaattttagacatagagtaagtttaacaagagacagagatttatttacagcacatatggatataagaggattaacacaaggagatacagcaacatatttttgtgcaagacaaaaatttgaaagaggaggacaaggatggtattttgatttatggggaagaggaacattaatagtagtatcaagt

SEQ ID NO: 49101 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggagcaggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagtccaaattttagacaaagagtaagtttaacaagagatagagatttaagtacagcacatatggatataagaggattaacacaagatgatacagcaacatatttttgtgcaagacaaaaatttgcaagaggagatcaaggatggttttttgatttatggggaagaggaacattaatagtagtaagtagt

SEQ ID NO: 49102 - RNA, 375 nt, synthetic construct
  misc_feature 1..375: note = derived and/or modified sequence opt6 from anti-HIV-1_HeavyChain
  source 1..375: mol_type = other RNA
caagtacaattagtacaaagcggagcagaagtaaaaagaccaggagcaagtgtaaaagtaagttgttggacaagtgaagatatatttgaaagaacagaattaatacattgggtaagacaagcaccaggacaaggattagaatggataggatgggtaaaaacagtaagtggagcagtaaattttggaagtccaaattttagacatagagtaagtttaacaagagatagagatctatttacagcacatatggatataagaggattaacacaaggagatacagcaacatatttttgtgcaagacaaaaatttgaaagaggaggacaaggatggtattttgatttatggggaagaggaacattaatagtagtaagcagt

SEQ ID NO: 49103 - RNA, 375 nt, synthetic construct
  misc_feature 1..375: note = derived and/or modified sequence opt6 from anti-HIV-1_HeavyChain
  source 1..375: mol_type = other RNA
agacatgatttagaacaaagtggaagcggagtgaaaaaaccaggagcaagtgtaagagtaagttgttggacaagtgaagatatatttgaaagaacagaattaatacattgggtaagacaagcaccaggacaaggattagaatggataggatgggtaaaaatagtaagtggagcagtaaattttggaagtccaaattttagacaaagagtaagtttaacaagagatagagatttatttacagcacatatggatataagaggattaacacaaggagatacagcaacatatttttgtgcaagacaaaaatttgaaagaggaggacaaggatggatatttgatttatggggaagaggaacattaatagcagtaagtagt

SEQ ID NO: 49104 - RNA, 375 nt, synthetic construct
  misc_feature 1..375: note = derived and/or modified sequence opt6 from anti-HIV-1_HeavyChain
  source 1..375: mol_type = other RNA
agacatacatgggaacaagtatggagtggagtaaaaaaaccaggagcaagtgtaagagtaagttgttggacatcagaagatatatttgaaaaaagtgaattaatacattgggtaagacaagcaccaggacaaggattagaatggataggatgggtaaaaacagtaacaggagcagtaaattttggaagtagtgattttagacaaagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 49105 - RNA, 375 nt, synthetic construct
  misc_feature 1..375: note = derived and/or modified sequence opt6 from anti-HIV-1_HeavyChain
  source 1..375: mol_type = other RNA
agacatacatggaataaaagtggaagtggagtaaaaaaaccaggagcaagtgtaagagtaagttgttggacaagtgaagatatatttgaaaggacagaattaatacattgggtaagacaagcaccaggacaaggattagaatggataggatgggtaaaagcagtaagtggagcagtaaattatggaagtttagattttagacatagagtaagtttaacaagagatagagatttaagtacagcacatatggatataagaggattaacgcaagatgatacagcaacatatttttgtgcaagacaaaaatttgcaagaggagatcaaggatggttttttgatttatggggaagaggaacattaatagtagtaagtagt

SEQ ID NO: 49106 - RNA, 375 nt, synthetic construct
  misc_feature 1..375: note = derived and/or modified sequence opt6 from anti-HIV-1_HeavyChain
  source 1..375: mol_type = other RNA
agacatacatgggaacaaagtggaagtggagtaaaaaaaccaggagcaagtgtaagggtaagttgttggacaagcgaagatatatttgaaaaaagtgaattaatacattgggtaagacaagcaccaggacaaggattagaatggataggatgggtaaaaacagtaacgggagcagtaaattttggaagtagtgattttagacaaagagtaagcttaacaagagatagagatttatttacagcacatatggatataagaggattaacacaaggagatacagcaacatatttttgtgcaagacaaaaatttgaaagaggaggacaaggatggatatttgatttatggggaagaggaacattaatagcagtaagtagt

SEQ ID NO: 49107 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaggccaggagcaagtgtaagagtaagttgttggacaagtgaagatatatttgaaacaacagaattaatacattgggtaagacaagcaccaggacaaggattagaatggataggatgggtaaaagcagtaagtggagcagtaaattatggaagtttagattttagacatagagtaagtttaacaagagatagagatttaagtacagcacatatggatataagaggattaacacaagatgatacagcaacatatttttgtgcaagacaaaaatttgcaagaggagatcaaggatggttttttgatttatggggaagaggaacattaatagtagtaagtagt

SEQ ID NO: 49108 - RNA, 375 nt, synthetic construct
  misc_feature 1..375: note = derived and/or modified sequence opt6 from anti-HIV-1_HeavyChain
  source 1..375: mol_type = other RNA
agacatgatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagtccaaattttagacatagagtaagtttaacaagagatagagatctatttacagcacatatggatataagaggattaacacaaggagatacagcaacatatttttgtgcaagacaaaaatttgaaagaggaggacaaggatggtattttgatttatggggaagaggaacattaatagtagtaagtagt

SEQ ID NO: 49109 - RNA, 375 nt, synthetic construct
  misc_feature 1..375: note = derived and/or modified sequence opt6 from anti-HIV-1_HeavyChain
  source 1..375: mol_type = other RNA
agacatacatgggaacaaagtggaagtggagtaaaaaaattaggagcaagtgtaagagtaagttgttggacaagtgaagatatatttgaaagaacagaactaatacattgggtaagacaagcaccaggacaaggattagaatggataggatgggtaaaagcagtaagtggagcagtaaattatggaagtttagactttagacatagagtaagtttaacaagagatagagatttaagtacagcacatatggatataagaggattaacacaagatgatacagcaacatatttttgtgcaagacaaaaatttgcaagaggagatcaaggatggttttttgatttatggggaaggggaacattaatagtagtaagtagt

SEQ ID NO: 49110 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggatcaggagtaaaaaaaccaggagcaagtgtaagagtaagttgtctagcaagtgaagatatatttgaaaaaagtgaattaatacattgggtaagacaagcaccaggacaaggattagaatggataggatgggtaaaaacagtaacaggagcagtaaattttggaagtagtgattttagacaaagagtaagtttaacaagagatagagatttatttacagcacatatggatataagaggattaacacaaggagatacagcaacatatttttgtgcaagacaaaaattttatgcaggaggacaaggatggtattttgatctatggggaagaggaacactaatagtagtaagtagt

SEQ ID NO: 49111 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggagcaggagtaaaaaaaccaggagcaagcgtaagagtaagttgttggacaagtgaagatatatttgaaaaaagtgaattaatacattgggtaagacaagcaccaggacaaggattagaatggataggatgggtaaaaacagtaacaggagcagtaaattttggatcaagtgattttagacaaagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 49112 - RNA, 375 nt, synthetic construct
  misc_feature 1..375: note = derived and/or modified sequence opt6 from anti-HIV-1_HeavyChain
  source 1..375: mol_type = other RNA
agacatacatgggaacaatcaggatcaggagtaaaaaaaccaggagcatcagtaagagtatcatgttggacatcagaagatatatttgaaaaaagcgaattaatacattgggtaagacaagcaccaggacaaggactagaatggataggatgggtaaaaacagtaacaggagcagtaaattttggatcaagtgattttaggcaaagagtatcattaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagttca

SEQ ID NO: 49113 - RNA, 375 nt, synthetic construct
  misc_feature 1..375: note = derived and/or modified sequence opt6 from anti-HIV-1_HeavyChain
  source 1..375: mol_type = other RNA
agacatacatgggaacaaagtggaagcggagtaaaaaaaccaggggcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagtccaaattttagacatagagtaagcttaacaagagatagagatttatttacagcacatatggatataaggggattaacacatggagatacagcaacatatttttgtgcaagacaaaaatttgaaagaggaggacaaggatggtattttgatttatggggaagaggaacattaatagtagtaagtagt

SEQ ID NO: 49114 - RNA, 375 nt, synthetic construct
  misc_feature 1..375: note = derived and/or modified sequence opt6 from anti-HIV-1_HeavyChain
  source 1..375: mol_type = other RNA
aggcatacatgggaacaaagtggaagtggagtaaaaaaattaggagcaagtgtaagagtaagttgttggacaagtgaagatatatttgaaagaacagaattaatacattgggtgagacaagcaccaggacaaggattagaatggataggatgggtaaaagcagtaagtggagcagtaaattatggaagtttagattttagacatagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 49115 - RNA, 375 nt, synthetic construct
  misc_feature 1..375: note = derived and/or modified sequence opt6 from anti-HIV-1_HeavyChain
  source 1..375: mol_type = other RNA
caagcacatctagaacaaagtggagcaggagtaaaaaaattaggagcaagtgtaagagtaagttgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagtttaacaagagatagagatttatttacagcacatatggatataagaggattaacacaagatgatacagcaacatatttttgtgcaagacaaaaatttgcaagaggagatcaaggatggttttttgatttatggggaagaggaacattaatagtagtaagcagt

SEQ ID NO: 49116 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagcggagtaaaaaaaccaggagcaagtgtagaagtaagttgttggacaagtgaagatatatttgaaagaacagaattaatacattgggtaagacaagcaccaggacaaggattagaatggataggatgggtaaaaacagtaagtggagcagtaaattttggaagtccaaattttagacatagagtaagtttaacaagagatagagatttatttacagcacatatggatataagaggattaacacaaggagatacagcaacatatttttgtgcgagacaaaaatttgcaagaggagatcaaggatggttttttgatttatggggaagaggaacattaatagtagtgagtagt

SEQ ID NO: 49117 - RNA, 372 nt, synthetic construct
  misc_feature 1..372: note = derived and/or modified sequence opt6 from anti-HIV-1_HeavyChain
  source 1..372: mol_type = other RNA
caagcacatttagaacaaagtggagcaggagtaaaaaaattaggagcaagtgtaagagtaagttgttggacaagtgaagatatatttaaaacagaattaatacattgggtaagacaagcaccaggacaaggattagaatggataggatgggtaaaagcagtaagtggggcagtaaattatggatcactagattttagacatagagtatcattaacaagagatagagatttatcaacagcacatatggatataagaggattaacacaagatgatacagcaacatatttttgtgcaagacaaaaatttgcaagaggagatcaaggatggttttttgatttatggggaagaggaacattaatagtagtaagttca

SEQ ID NO: 49118 - RNA, 375 nt, synthetic construct
  misc_feature 1..375: note = derived and/or modified sequence opt6 from anti-HIV-1_HeavyChain
  source 1..375: mol_type = other RNA
agacatacatgggaacaatcaggaagtggagtaaaaaaaccaggagcaagcgtaagagtaagttgttggacaagtgaagatatatttgaaagaacagaattaatacattgggtaagacaagcaccaggacaaggattagaatggataggatgggtaaaaacagtaacaggagcagtaaattttggaagtccaaattttagacatagagtaagtttaacaagagatagagatttatttacagcgcatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 49119 - RNA, 375 nt, synthetic construct
  misc_feature 1..375: note = derived and/or modified sequence opt6 from anti-HIV-1_HeavyChain
  source 1..375: mol_type = other RNA
agacatacatgggaaagaatatggagtggagtaaaaaaaccaggagcaagtgtaagagtaagttgttggacaagtgaagatatatttgaaagaacagaattaatacattgggtaagacaagcaccaggacaaggattagaatggataggatgggtaaaaatagtaagtggagcagtaaattttggaagtccaaattttagacaaagagtaagtttaacaagagatagagatttatttacagcacatatggatataagaggattaacacaaggagatacagcaacatatttttgtgcaagacaaaaatttgaaagaggaggacaaggatggatatttgatttatggggaagaggaacattaatagcagtaagcagt

SEQ ID NO: 49120 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaattaggagcaagtgtaagagtaagttgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagtttaacaagagatagagatttaagtacagcacatatggatataagaagattaacacaagatgatacagcaacatatttttgtgcaagacaaaaatttgcaaggggagatcaaggatggttttttgatttatggggaagaggaacattaatagtagtaagtagt

SEQ ID NO: 49121 - RNA, 375 nt, synthetic construct
  misc_feature 1..375: note = derived and/or modified sequence opt6 from anti-HIV-1_HeavyChain
  source 1..375: mol_type = other RNA
agacatacagtagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagtccaaattttagacatagagtaagtttaacaagagatagagatttatttacagcacatatggatataagaggactaacacaaggggatacagcaacatatttttgtgcgagacaaaaatttgaaagaggagggcaaggatggtattttgatttatggggaagaggaacattaatagtagtaagtagt

SEQ ID NO: 49122 - RNA, 375 nt, synthetic construct
  misc_feature 1..375: note = derived and/or modified sequence opt6 from anti-HIV-1_HeavyChain
  source 1..375: mol_type = other RNA
caagcacatctagaacaaagtggaagtggagtgaaaaaaccaggagcaagtgtaagagtaagttgttggacaagtgaagatatatttgaaaaaagtgaattaatacattgggtaagacaagcaccaggacaaggattagaatggataggatgggtaaaaacagtaacaggagcagtaaattttggaagtagtgattttagacaaagagtaagtttaacaccagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 49123 - RNA, 375 nt, synthetic construct
  misc_feature 1..375: note = derived and/or modified sequence opt6 from anti-HIV-1_HeavyChain
  source 1..375: mol_type = other RNA
agacatacagtagaacaaagtggaagtggagtaaaaaaagtaggagcaagtgtaagagtaagttgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagtttaacaagagatagagatttatttacagcacatatggatataagaggattaacacaagatgatacagcaatatatttttgtgcaagacaaaaatttgcaagaggagatcaaggatggttttttgatttatggggaagaggaacattaatagtagtaagtagt

SEQ ID NO: 49124 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttgggcaagcgaagatatatttgaaagaacagaattaatacattgggtaagacaagcaccaggacaaggattagaatggataggatgggtaaaaacagtaagtggagcagtaaattttggaagtccaaattttagacatagagtaagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagt

SEQ ID NO: 49125 - RNA, 375 nt, synthetic construct
  misc_feature 1..375: note = derived and/or modified sequence opt6 from anti-HIV-1_HeavyChain
  source 1..375: mol_type = other RNA
agacatacatgggaacaagtatggagtggagtaaaaaaaccaggagcaagtgtaagagtaagttgttggacaagtgaagatatatttgaaaggacagaattaatacattgggtaagacaagcaccaggacaaggattagaatggataggatgggtaaaaacagtaacaggagcagtaaattttggaagtccaaattttagacatagagtaagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagt

SEQ ID NO: 49126 - RNA, 375 nt, synthetic construct
  misc_feature 1..375: note = derived and/or modified sequence opt6 from anti-HIV-1_HeavyChain
  source 1..375: mol_type = other RNA
agacatacatggagacaaagtggaagtggagtaaaaaaattaggagcaagcgtaagagtgagttgttggacaagtgaagatatatttgaaagaacagaattaatacattgggtaagacaagcaccaggacaaggattagaatggataggatgggtaaaagcagtaagcggagtagtaaattatggaagtttagattttagacatagagtaagtttaacaagagatagagatttaagtacagcacatatggatataagaggattaacacaagatgatacagcaacatatttttgtgcaagacaaaaatttgcaagaggagatcaaggatggttttttgatttatggggaagaggaacattaatagtagtaagtagt

SEQ ID NO: 49127 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtatcatgttggacaagtggagatatatttgaaagaacagaattaatacattgggtaagacaagcaccaggacaaggattagaatggataggatgggtaaaaatagtaagtggagcagtaaattttggaagtccaaattttagacaaagagtaagtttaacaagagatagagatttatttacagcacatatggatataagaggattaacacaaggagatacagcaacatatttttgtgcaagacaaaaatttgaaagaggaggacaaggatggatatttgatctatggggaagaggaacattaatagcagtaagtagt

SEQ ID NO: 49128 - RNA, 375 nt, synthetic construct
  misc_feature 1..375: note = derived and/or modified sequence opt6 from anti-HIV-1_HeavyChain
  source 1..375: mol_type = other RNA
agacatacagtggaacaaagtggaagtggagtaaaaaaaccaggagcgagtgtaagagtaagttgttggacaagtgaagatatatttgaaaaaagtgaattaatacattgggtaagacaagcaccaggacaaggattagaatggataggatgggtaaaaacagtaacaggagcagtaaattttggaagtagtgattttagacaaagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 49129 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaagatgggcaagtgtaagagtaagttgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagcttaacaagagatagagatttatttacagcacatatggatataagaggattaacacaagatgatacagcaacatatttttgtgcaagacaaaaatttgcaagaggagatcaaggatggttttttgatttatggggaagaggaacattaatagtagtaagtagt

SEQ ID NO: 49130 - RNA, 375 nt, synthetic construct
  misc_feature 1..375: note = derived and/or modified sequence opt6 from anti-HIV-1_HeavyChain
  source 1..375: mol_type = other RNA
agacatacagtagaacaaagtggaagtggagtaaaaagaccaggagcaagtgtaagagtaagttgttggacaagtgaagatatatttgaaacaacagaattaatacattgggtaagacaagcaccaggacaaggattagaatggataggatgggtaaaaacagtaacaggagcagtaaattttggaagtagtgattttagacaaagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 49131 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggggtaaaaaaattaggagcaagcgtaagagtaagttgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagtttaacaagagatagaggattatttacagcacatatggatataagaggattaacacaagatgatacagcaacatatttttgtgcaagacaaaaatttgcaagaggagatcaaggatggttttttgatttatggggaagaggaacattaatagtagtaagtagt

SEQ ID NO: 49132 - RNA, 375 nt, synthetic construct
  misc_feature 1..375: note = derived and/or modified sequence opt6 from anti-HIV-1_HeavyChain
  source 1..375: mol_type = other RNA
caagtacatttagaacaaagtggaagtggagtaaaaaaaccaggagcaagtgtaagagtaagttgttggacaagtgaagatatatttgaaaaaagtgaattaatacattgggtaagacaagcaccaggacaaggattagaatggataggatgggtaaaaacagtaacaggagcagcaaattttggaagtagtgattttagacaaagagtaagtttaacaccagatagagatttatttacagcacatatggatataagaggattaacacaaggagatacagcaacatatttttgtgcaagacaaaaattttataaaggaggacaaggatggtattttgatttatggggaagaggaacattaatagtagtaagtagt

SEQ ID NO: 49133 - RNA, 375 nt, synthetic construct
  misc_feature 1..375: note = derived and/or modified sequence opt6 from anti-HIV-1_HeavyChain
  source 1..375: mol_type = other RNA
caggcacatttagaacaaagcggagcaggagtaaaaaaaccaggagcaagtgtaagagtaagttgttggacaagcgaagatatatttgatacaacagaattaatacattgggtaagacaagcaccaggacaaggattagaatggataggatgggtaaaaatagtaagtggagcagtaaattttggaagtccaaattttagacaaagagtaagcttaacaagagatagagatttatttacagcacatatggatataagaggattaacacaaggagatacagcaacatatttttgtgcaagacaaaaatttgaaagaggaggacaaggatggatatttgatttatggggaagaggaacactaatagcagtaagtagt

SEQ ID NO: 49134 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaattaggagcaagtgtaagagtaagttgttggacaagtagagatatatttgaaagaacagaattaatacattgggtaagacaagcaccaggacaaggattagaatggataggatgggtaaaagcagtaagtggagcagtaaattatggaagtttagattttagacatagagtaagtttaacaagagatagagatttaagtacagcgcatatggatataagaggattaacacaagatgatacagcaacatatttttgtgcaagacaaaaatttgcaagaggagatcaaggatggttttttgatttatggggaagaggaacattaatagtagtaagtagt

SEQ ID NO: 49135 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaattaggagcaagtgtaagagtaagttgtttagcaagtgaagatatatttgaaagaacagaactaatacattgggtaagacaagcaccaggacaaggattagaatggataggatgggtaaaagcagtaagtggagcagtaaattatggaagtttagattttagacatagagtaagcttaacaagagatagagatttaagtacagcacatatggatataagaggattaacacaagatgatacagcaacatatttttgtgcaagacaaaaatttgcaagaggagatcaaggatggttttttgatttatggggaagaggaacattaatagtagtaagtagt

SEQ ID NO: 49136 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagcggagtaaaaaaaccaggagcaagtgtaagagtaagttgttggccaagcgaagatatatttgaaagaacagaattaatacattgggtaagacaagcaccaggacaaggattagaatggataggatgggtaaaaacagtaacaggaacagtaaattttggaagtttaaattttagacaaagagtaagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagc

SEQ ID NO: 49137 - RNA, 375 nt, synthetic construct
  misc_feature 1..375: note = derived and/or modified sequence opt6 from anti-HIV-1_HeavyChain
  source 1..375: mol_type = other RNA
agagcacatctagaacaaagtggaagcgaatggaaaaaactaggagcaagtgtaagagtaagttgttggacaagtggagatatatttgaaaggacagaattaatacattgggtaagacaagcaccaggacaaggattagaatggataggatgggtaaaagcagtaagtggagcagtaaattatggaagcttagattttagacatagagtaagtttaacaagagatagagatttatttacagcacatatggatataagaggattaacacaagatgatacagcaacatatttttgtgcaagacaaaaatttgcaagaggagatcaaggatggttttttgatttatggggaagaggaacattaatagtagtaagtagt

SEQ ID NO: 49138 - RNA, 375 nt, synthetic construct
  misc_feature 1..375: note = derived and/or modified sequence opt6 from anti-HIV-1_HeavyChain
  source 1..375: mol_type = other RNA
agacatacagtagaacaaagtggaagtggagtaaaaaaattaggagcaagtgtaaatgtaagttgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagcttaacaagagatagagatttatttacagcacatatggatataagaggattaacacaagatgatacagcaacatatttttgtgcaagacaaaaatttgcaagaggagatcaaggatggttttttgatttatggggaagaggaacattaatagtagtaagtagt

SEQ ID NO: 49139 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtgaaaaaaccaggagcaagtgtaagagtatcatgttggacaagtgaagatatatttgaaaaaagtgaattaatacattgggtaagacaagcaccaggacaaggattagaatggataggatgggtaaaaccagtaacaggagcagtaaattttggaagtagtgattttagacaaagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 49140 - RNA, 375 nt, synthetic construct
  misc_feature 1..375: note = derived and/or modified sequence opt6 from anti-HIV-1_HeavyChain
  source 1..375: mol_type = other RNA
agacatacatggaataaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagtccaaattttagacatagagtaagtttaacaagagacagagatttattcacagcacatatggatataagaggattaacacaaggagatacagcaacatatttttgtgcaagacaaaaatttgaaagaggaggacaaggatggtattttgatttatggggaagaggaacattaatagtagtaagtagt

SEQ ID NO: 49141 - RNA, 375 nt, synthetic construct
  misc_feature 1..375: note = derived and/or modified sequence opt6 from anti-HIV-1_HeavyChain
  source 1..375: mol_type = other RNA
caagcacatagtgaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaatagtaagtggagcagtaaattttggaagtccaaattttagacaaagagtaagcctaacaagagatagagatttatttacagcacatatggatataagaggattaacacaaggagatacagcaacatatttttgtgcaagacaaaaatttgaaagaggaggacaaggatggatatttgatttatggggaagaggaacattaatagcagtaagtagc

SEQ ID NO: 49142 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggagcaggagtaaaaagaccaggagcaagtgtaagagtaagttgttggacaagtgaagatatatttgaaacaacagaattaatacattgggtaagacaagcaccaggacaaggattagaatggataggatgggtaaaaacagtaacaggagcagtaaattttggaagtccaaattttagacatagagtaagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagt

SEQ ID NO: 49143 - RNA, 375 nt, synthetic construct
  misc_feature 1..375: note = derived and/or modified sequence opt6 from anti-HIV-1_HeavyChain
  source 1..375: mol_type = other RNA
ggacatacatgggaacaaagcggagcaggagtaaaaaaattaggagcaagtgtaagagtaagttgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagtctaacaagagatagagatttatttacagcacatatggatataagaggattaacacaagatgatacagcaatatatttttgtgcaagacaaaaatttgcaagaggagatcaaggatggttttttgatttatggggaaggggaacattaatagtagtaagtagc

SEQ ID NO: 49144 - RNA, 375 nt, synthetic construct
  misc_feature 1..375: note = derived and/or modified sequence opt6 from anti-HIV-1_HeavyChain
  source 1..375: mol_type = other RNA
ggaacaccaggaagtgaaagtggaagtggagtaaaaaaattaggagcaagtgtaagagtaagttgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagtttaacaagagatagagatttaagtacagcacatatggatataagaggattaacacaagatgatacagcaacatatttttgtgcaagacaaaaatttgcaagaggagatcaaggatggttttttgatttatggggaagaggaacattaatagtagtaagtagt

SEQ ID NO: 49145 - RNA, 375 nt, synthetic construct
  misc_feature 1..375: note = derived and/or modified sequence opt6 from anti-HIV-1_HeavyChain
  source 1..375: mol_type = other RNA
ggaacaccaggaagtgaaagtggaagtggagtaaaaatgccaggagcaagtgtaagagtaagttgttggacaagtgaagatatatttgaaagaacagaactaatacattgggtaagacaagcaccaggacaaggattagaatggataggatgggtaaaaacagtaagtggagcagtaaattttggaagtccaaattttagacatagagtaagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagt

SEQ ID NO: 49146 - RNA, 375 nt, synthetic construct
  misc_feature 1..375: note = derived and/or modified sequence opt6 from anti-HIV-1_HeavyChain
  source 1..375: mol_type = other RNA
agacatacatgggaacaaagtggagcaggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaagtggagcagtaaattttggaagtccaaattttagacatagagtaagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagt

SEQ ID NO: 49147 - RNA, 375 nt, synthetic construct
  misc_feature 1..375: note = derived and/or modified sequence opt6 from anti-HIV-1_HeavyChain
  source 1..375: mol_type = other RNA
ggaacaccaggaaataaaagtggaagtggagtaaaaaaaccaggagcaagtgtaagagtaagttgttggacaagtgaagatatatttgaaaaaagtgaattaatacattgggtaagacaagcaccaggacaaggattagaatggataggatgggtaaaaacagtaacaggagcagtaaattttggaagtagtgattttagacaaagagtaagtttaacaagagatagagatttatttacagcacatatggatataaggggattaacacaaggagatacagcaacatatttttgtgcaagacaaaaattttatgcaggaggacaaggatggtattttgatttatggggaagaggaacattaatagtagtaagtagt

SEQ ID NO: 49148 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggagcaggagtaaaaaaaccaggagcaagtgtaagagtaagttgttggagtagtgaagatatatttgaaagaacagaattaatacattgggtaagacaagcaccaggacaaggattagaatggataggatgggtaaaaacagtaacaggagcagtaaattttggaagtccaaattttagacatagagtaagtttaacaagagatagagacttatttacagcacatatggatataagaggattaacacaaggagatacagcaacatatttttgtgcaagacaaaaatttgaaagaggaggacaaggatggtattttgatttatggggaagaggaacattaatagtagtaagtagt

SEQ ID NO: 49149 - RNA, 375 nt, synthetic construct
  misc_feature 1..375: note = derived and/or modified sequence opt6 from anti-HIV-1_HeavyChain
  source 1..375: mol_type = other RNA
ggaacaccaggaaataaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagtccaaattttagacatagagtaagtttaacaagagatagagatttatttacagcacatatggatataagaggattaacacaaggagatacagcaacatatttttgtgcaagacaaaaatttgaaagaggaggacaaggatggatatttgatttatggggaagaggaacattaatagcagtaagtagt

SEQ ID NO: 49150 - RNA, 375 nt, synthetic construct
  misc_feature 1..375: note = derived and/or modified sequence opt6 from anti-HIV-1_HeavyChain
  source 1..375: mol_type = other RNA
ggaacaccaggaaataaaagcggaagtggagtaaaaaaaccaggagcaagtgtaagggtaagctgttggagtagtgaagatatatttgaaagaacagaattaatacattgggtaagacaagcaccaggacaaggattagaatggataggatgggtaaaaacagtaacaggagcagtaaattttggaagtttagattttagacatagaataagtttaacaagagatagagatttatttacagcacatatggatataagaggattaacacaaggagatacagcaacatatttttgtgcaagacaaaaatttgaaagaggaggacaaggatggatatttgatttatggggaagaggaacattaatagcagtaagtagt

SEQ ID NO: 49151 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtgcaagtggagtaaaaagaccaggaggatgggtaagagtaagttgttggacaagtgaagatatatttgaaagaagtgaattaatatattgggtaagacaagcaccaggacaaggattagaatggataggatgggtaaaaacagtaacaggagcagtaaattttggaagtccaaattttagacatagagtaagtttaacaagagatagagatttatttacagcacatatggatataagaggattaacacaaggagatacagcaacatatttttgtgcaagacaaaaatttgaaaggggaggacaaggatggtattttgatttatggggaagaggaacattaatagtagtaagtagt

SEQ ID NO: 49152 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacaagtagtggagcagtaaattttggaagtccaaattttagaacaagagtaagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagt

SEQ ID NO: 49153 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggagcaggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaagtggagcagtaaattttggaagtccaaattttagacatagagtaagtttaacaagagatagagatttatttacagcacatatggatataagaggattaacacaaggagatacagcgacatatttttgtgcaagacaaaaatttgaaagaggaggacaaggatggtattttgatttatggggaagaggaacattaatagtagtaagtagt

SEQ ID NO: 49154 - RNA, 375 nt, synthetic construct
  misc_feature 1..375: note = derived and/or modified sequence opt6 from anti-HIV-1_HeavyChain
  source 1..375: mol_type = other RNA
agacatacatgggaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagtccaaattttagacatagagtaagtttaacaagagatagagatttatttacagcacatatggatataagaggattaacacaaggagatacagcaacatatttttgtgcaagacaaaaatttgaaagaggaggacaaggatggtattttgatctatggggaagaggaacattaatagtagtaagtagt

SEQ ID NO: 49155 - RNA, 375 nt, synthetic construct
  misc_feature 1..375: note = derived and/or modified sequence opt6 from anti-HIV-1_HeavyChain
  source 1..375: mol_type = other RNA
ggaacaacatggaataaaagtggaagtggagtaaaaaaaccaggagcaagtgtaagagtaagttgttggacaagtgaagatatatttgaaagaacagaattaatacattgggtaagacaagcaccaggacaaggactagaatggataggatgggtaaaaacagtaacaggagcagtaaattttggaagtccaaattttagacatagagtaagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagt

SEQ ID NO: 49156 - RNA, 375 nt, synthetic construct
  misc_feature 1..375: note = derived and/or modified sequence opt6 from anti-HIV-1_HeavyChain
  source 1..375: mol_type = other RNA
agacatacatggaatgaaagtggaagtggggtaaaaaaaccaggagcaagtgtaagagtaagttgttggacaagtgaagatatatttgaaaaaagtgaattaatacattgggtaagacaagcaccaggacaaggattagaatggataggatgggtaaaaacagtaacaggagcagtaaattttggaagtagtgattttagacaaagagtaagtttaacaagagatagagatttatttacagcacatatggatataagaggattaacacaaggagatacagcaacatatttttgtgcaagacaaaaattttatgcaggaggacaaggatggtattttgatctatggggaagaggaacattaatagtagtaagtagc

SEQ ID NO: 49157 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaattaggagcaagtgtaagagtaagttgttggacaagtggaaatatatttgaaagaacagaattaatacattgggtaagacaagcaccaggacaaggattagaatggataggatgggtaaaagcagtaagtggagcagtaaattatggaagtttagattttagacatagagtaagtttaacaagagatagagatttaagtacagcacatatggatataagaggattaacacaagatgatacagcaacatatttttgtgcaagacaaaaatttgcaagaggagatcaaggatggttttttgatttatggggaagaggaacattaatagtagtaagtagt

SEQ ID NO: 49158 - RNA, 378 nt, synthetic construct
  misc_feature 1..378: note = derived and/or modified sequence opt6 from anti-HIV-1_HeavyChain
  source 1..378: mol_type = other RNA
agatgtagtatggaacaaccaggatggagtgaaaaaccaggagcaagtgtaacattaagttgtaaaacagcagatgaagatgtatttgatgcagcatatatgcattgggtaagacaagcaccaggacaaacatttgaatggttaggatggatgaaaccagtaacaggagcagtaagttatgcaagaaaatttcaaggaagagtaagtttttatatgacaagagaattaggaatggcatatatggatttaagaaatttaagatttgatgatacagcagtatatttttgtgcaagaaaaacagcaggagatgtaagtggagataatagaggatatttttttgatttatggggaagaggaagtagagtaatagtaagtagt

SEQ ID NO: 49159 - RNA, 375 nt, synthetic construct
  misc_feature 1..375: note = derived and/or modified sequence opt6 from anti-HIV-1_HeavyChain
  source 1..375: mol_type = other RNA
agacatacaagtgaacaatcaggatcaggagtaaaaaaaccaggagcatcagtaagagtatcatgttggacatcagaagatatatttgaaagaagtgaattaatacattgggtaagacaagcaccaggacaaggactagaatggataggatgggtaaaaacagtaacaggagcagtaaatttcggatcaccaaattttagacatagagtatcattaacaagagatagagatttatttacagcacatatggatataagaggattaacacaaggagatacagcaacatatttttgtgcaagacaaaaatattatgcaggaggacaaggatggtattttgatttatggggaagaggaacattaatagtagtaagttca

SEQ ID NO: 49160 - RNA, 375 nt, synthetic construct
  misc_feature 1..375: note = derived and/or modified sequence opt6 from anti-HIV-1_HeavyChain
  source 1..375: mol_type = other RNA
aggcatacagtagaacaaagtggagcaggagtaaaaaaaccaggagcaagcgtaagagtaagttgttggacaagtgaagatatatttgaaagaacagaattaatacattgggtaagacaagcaccaggacaaggactagaatggataggatgggtaaaaacagtaagtggagcagtaaattttggaagtccaaattttagacatagagtaagcttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagt

SEQ ID NO: 49161 - RNA, 375 nt, synthetic construct
  misc_feature 1..375: note = derived and/or modified sequence opt6 from anti-HIV-1_HeavyChain
  source 1..375: mol_type = other RNA
ggaacaccatggaatgaaagtggaagtggagtaaaaaaaccaggagcaagtgtaagagtaagttgttggacaagtgaagatatatttgaaaaaagtgaattaatacattgggtaagacaagcaccaggacaaggattagaatggataggatgggtaaaaacagtaacaggagcagtaaattttggaagtccaaattttagacatagagtaagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagt

SEQ ID NO: 49162 - RNA, 375 nt, synthetic construct
  misc_feature 1..375: note = derived and/or modified sequence opt6 from anti-HIV-1_HeavyChain
  source 1..375: mol_type = other RNA
agacatgatttagaaccatcaggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagtttagattttagacatagaataagtttaacaagagatagagatttatttacagcacatatggatataagaggattaacacaaggagatacagcaacatatttttgtgcaagacaaaaatttgaatcaagatatacaggaggacaaggatggtattttgatttatggggaagaggaacacatatagta

SEQ ID NO: 49163 - RNA, 375 nt, synthetic construct
  misc_feature 1..375: note = derived and/or modified sequence opt6 from anti-HIV-1_HeavyChain
  source 1..375: mol_type = other RNA
agacatacagtagaacaaagtggaagtggagtaaaaaaattaggagcaagtgtaagagtaagttgtttagcaagtgaagatatatttgaaagaacagaattaatacattgggtaagacaagcgccaggacaaggattagaatggataggatgggtaaaagcagtaagtggagcagtaaattatggaagtttagattttagacatagagtaagtttaacaagagatagagatttaagtacagcgcatatggatataagaggattaacacaagatgatacagcaacatatttttgtgcaagacaaaaatttgcaagaggagatcaaggatggttttttgatttatggggaagaggaacattaatagtagtaagtagt

SEQ ID NO: 49164 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtgaaagtaaaaaaccaggagcaagtgtaagagtaagctgttggacaagtgaagatatatttgaaaaaagtgaactaatacattgggtaagacaagcaccaggacaaggattagaatggataggatgggtaaaaacagtaacaggagcagtaaattttggaagtagtgattttagacaaagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 49165 - RNA, 375 nt, synthetic construct
  misc_feature 1..375: note = derived and/or modified sequence opt6 from anti-HIV-1_HeavyChain
  source 1..375: mol_type = other RNA
ggaacaccaggaagtgaaagtgcaagtggagtaagaagaccaggagcaagtgtaagagtaagttgttggacaagtgaagatatatttgaaagaagtgaattaatatattgggtaagacaagcaccaggaagaggattagaatggataggatggataaaattagtaagtggagcagtaaattttggaagtgtagattttagagatagagtaagtttgacaagagatagagatttatttacagcacatatggatataagaggattaacacaaggagatacagcaacatatttttgtgcaagacaaaaatttgaaaggggagggcaaggatggtattttgatttatggggaagaggaacattaatagtagtaagtagt

SEQ ID NO: 49166 - RNA, 375 nt, synthetic construct
  misc_feature 1..375: note = derived and/or modified sequence opt6 from anti-HIV-1_HeavyChain
  source 1..375: mol_type = other RNA
caagtacatttagaacaaagtggaagtggagtaaaaaaaccaggagcaagtgtaagagtaagttgttggacaagtgaagatatatttgaaaaaagtgaactaatacaatgggtaagacaagcaccaggacaaggattagaatggataggatgggtaaaaacagtaacaggagcagtaaattttggaagtagtgattttagacaaagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 49167 - RNA, 375 nt, synthetic construct
  misc_feature 1..375: note = derived and/or modified sequence opt6 from anti-HIV-1_HeavyChain
  source 1..375: mol_type = other RNA
ggaacaccaggaagtgaaagtggaagtggagtaaaaaaagtaggagcaagtgtaagagtaagttgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagtttaacaagagatagagatttatttacagcaagaatggatataagaggattaacacaagatgatacagcaatatatttttgtgcaagacaaaaatttgcaagaggagatcaaggatggttttttgatttatggggaagaggaacattaatagtagtaagtagt

SEQ ID NO: 49168 - RNA, 375 nt, synthetic construct
  misc_feature 1..375: note = derived and/or modified sequence opt6 from anti-HIV-1_HeavyChain
  source 1..375: mol_type = other RNA
ggaacaccaggaagtgaaagtggaagcggagtaaaaaggccaggagcaagtgtaagagtaagttgttggacaagtgaagatatatttgaaacaacagaattaatacattgggtaagacaagcaccaggacaaggattagaatggataggatgggtaaaaacagtaagtggagcagtaaattttggaagtttaaattttagacatagagtaagtttaacaagagatagagatttaagtacagcacatatggatataagaggattaacacaagatgatacagcaacatatttttgtgcaagacaaaaatttgcaagaggagatcaaggatggttctttgatttatggggaagaggaacattaatagtagtaagtagt

SEQ ID NO: 49169 - RNA, 372 nt, synthetic construct
  misc_feature 1..372: note = derived and/or modified sequence opt6 from anti-HIV-1_HeavyChain
  source 1..372: mol_type = other RNA
agagcacatttagaacaaagtggagcaggagtaaaaaaaccaggaggatgggtaagagtaagttgttggacaagtgaagatatatttaaaacagaattaatacattgggtaagacaagcaccaggacaaggattagaatggataggatgggtaaaaacagtaacaggagcagtaaattttggatcaccaaattttagacatagagtaagtttaacacgagatagagatttatttacagcacatatggatataagaggattaacacaaggagatacagcaacatatttttgtgcaagacaaaaatttgaaagaggaggacaaggatggtattttgatttatggggaagaggaacattaatagtagtaagttca

SEQ ID NO: 49170 - RNA, 378 nt, synthetic construct
  misc_feature 1..378: note = derived and/or modified sequence opt6 from anti-HIV-1_HeavyChain
  source 1..378: mol_type = other RNA
caagtacaattaatgcaaagtggagcagaagtaaaaagaccaggagcaagtgtaaaaataagttgtacagcaagtggatttacattaacagatcattatatgcattgggtaagacaagcaccaggacaaacatttgaatggttaggatggatgaaaccagtaacaggagcagtaaattatgcaagaaaatttcaaggaagagtaagtttttatagaacaagagaattaggaatagcatatatggatttaagaaatttaagatttgatgatacagcagtatatttttgtgcaagaaaaacagcaggagatgtaagtggagataaaagaggatttttttttgatttatggggaagaggaagcagagtaatagtaagtagt

SEQ ID NO: 49171 - RNA, 378 nt, synthetic construct
  misc_feature 1..378: note = derived and/or modified sequence opt6 from anti-HIV-1_HeavyChain
  source 1..378: mol_type = other RNA
caagtacaattagtacaaagtggagcagaagtaaaaaaaccaggagcaagtgtaaaagtaagttgtaaagcaagtggatataattttacaggatattatttacattgggtaagacaagcaccaggacaaacatttgaatggttaggatggatgaaaccagtaacaggagcagtaagttatgcaagaaaatttcaaggaagagtaagtttttatatgacaagagaattaggaatggcatatatggatttaagaaatttaagatttgatgatacagcagtatatttttgtgcaagaaaaacagcaggagatgtaagcggagataatagaggatatttttttgatttatggggaaggggaagtagagtaatagtaagtagt

SEQ ID NO: 49172 - RNA, 375 nt, synthetic construct
  misc_feature 1..375: note = derived and/or modified sequence opt6 from anti-HIV-1_HeavyChain
  source 1..375: mol_type = other RNA
ggaacaccaggaagtaaaagtggaagtggagtaaaaaaaccaggggcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagcccaaattttagacatagagtaagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagt

SEQ ID NO: 49173 - RNA, 378 nt, synthetic construct
  misc_feature 1..378: note = derived and/or modified sequence opt6 from anti-HIV-1_HeavyChain
  source 1..378: mol_type = other RNA
caagtacaattagtacaatcaggagcggaattaaaaaaaccaggggcatcagtaaaagtatcatgcgaagcatcaggatatagctttacagatcaccatatacattgggtaagacaagcaccaggacaaggactagaatggctaggatggatgaacccaaataatggagatacagcatacgcacaaacattcttaggaagagtaacaatgacaagagatacatcaataaatacagcatacatggaattaagcagactaacaagcgatgacacagcagtatacttttgcgcaagaaaaacagcaggagatgtatcaggagataaaagaggatttttctttgacttatggggaagaggaagcagagtaatagtatcaagc

SEQ ID NO: 49174 - RNA, 378 nt, synthetic construct
  misc_feature 1..378: note = derived and/or modified sequence opt6 from anti-HIV-1_HeavyChain
  source 1..378: mol_type = other RNA
caagtatatatgagtagtagaggaggaatgaaaaaaccaggagcaagtatgacagtaagttgtaaaacagcagatgaagatatatttgatgcggcatatatgcattgggtaagacaagcaccaggacaaacatttgaatggttaggatggatgaaaccagtaacaggagcagtaaattatgcaagacaatttcaaggaagagtaagtttttataggacaagagaattaggaatagcatatatggatttaagagatttaaaatttgatgatacagcagtatatttttgtgcaagaaaaacaaaaggagatgtaagtggagatgatagaggatttttttttgatttatggggaagaggaacaagagtaatagtaagtagt

SEQ ID NO: 49175 - RNA, 378 nt, synthetic construct
  misc_feature 1..378: note = derived and/or modified sequence opt6 from anti-HIV-1_HeavyChain
  source 1..378: mol_type = other RNA
caagtacaattagtacaaagcggagcagaagtaaaaaaaccaggagcaagcgtaaaagtaagctgtaaagcaagcgggtacacattcacagcatattacatgcactggctaagacaagcaccaggacaaggactagaatggatgggatggataaatccacatagcggaggaacaaactttgcacaaaaatttcaaggaagagtaacaatgacaagagacacaagcataacaacagcatatatggaactatcaagattaagatcagacgatacagcaacatatttctgtgcaagacaaaaattcgcaagcagatactcaggagatcaaggaagctatttcgatctatggggaagaggaacactaatagtagtaagctca

SEQ ID NO: 49176 - RNA, 375 nt, synthetic construct
  misc_feature 1..375: note = derived and/or modified sequence opt6 from anti-HIV-1_HeavyChain
  source 1..375: mol_type = other RNA
agagcacatttagaacaaagtggagcaggagtaaaaaaattaggagcaagtgtaagagtaagttgttggacaagtgaagatatatttgaaagaacagaactaatacattgggtaagacaagcaccaggacaaggattagaatggataggatgggtaaaagcagtaagtggagcagtaaattatggaagtttagattttagacatagagtaagcttaacaagagatagagatctatttacagcacatatggatataagaggattaacacaagatgatacagcaacatatttttgtgcaagacaaaaatttgcaagaggagatcaaggatggttttttgatttatggggaagaggaacattaatagtagtaagcagt

SEQ ID NO: 49177 - RNA, 378 nt, synthetic construct
  misc_feature 1..378: note = derived and/or modified sequence opt6 from anti-HIV-1_HeavyChain
  source 1..378: mol_type = other RNA
caagtaagattagtacaaagtggagcagatgtaaaacaaccaggagcaagtgtaaaagtaagttgtaaagcaagtggatatacatttacagattattatatgcattgggtaagacaagcaccaggacaaacatttgaatggttaggatggatgaaaccagtaacaggagcagtaagttatgcaagaaaatttcaaggaagagtaagtttttatatgacaagagaattaggaatggcatatatggatttaagaaatttaagatttgatgatacagcagtatatttttgtgcaagaaaaacagcaggagatgtaagtggagataatagaggatatttttttgatttatggggaagaggaagtagagtaatagtaagtagt

SEQ ID NO: 49178 - RNA, 378 nt, synthetic construct
  misc_feature 1..378: note = derived and/or modified sequence opt6 from anti-HIV-1_HeavyChain
  source 1..378: mol_type = other RNA
caagcacatttaggaaataaatcaggatcaggagtaaaaaaaccaggagcatcagtaagagtatcatgttggacatcagaagatatatttgaaaaaagtgaactaatacattgggtaagacaagcaccaggacaaggattagaatggataggatgggtaaaaacagtaacaggagcagtaaattttggatcaagtgattttagacaaagagtatcattaacaagagatagagatttatttacagcacatatggatataagaggattaacacaaggagatacagcaacatatttttgtgcaagacaaaaattttatgcaggaggacaaggatggtattttgatctatggggaagaggaacattaatagtagtaagctca

SEQ ID NO: 49179 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaaagtggaggaggagtaaaaaaaccaggagcaagtgtaacattaagttgtaaaacagcagatgaagatgtatttgatgcagcatatatgcattgggtaagacaagcaccaggacaaacatttgaatggttaggatggatgaaaccagtaacaggagcagtaaattatgcaagaaaatttcaaggaagagtaagtttttatagaacaagagaattaggaatagcatatatggatttaagaaatttaagatttgatgatacagcagtatatttttgtacaagaaaaacagcaggagatgtaagtggagataaaagaggatttttttttgatttatggggaagaggaagtagagtaatagtaagtagt

SEQ ID NO: 49180 - RNA, 381 nt, synthetic construct
  misc_feature 1..381: note = derived and/or modified sequence opt6 from anti-HIV-1_HeavyChain
  source 1..381: mol_type = other RNA
caagtatatgtagaacaaccaggaggaggagtaaaaaaaccaggagcaagtgtaacattaagttgtaaaacagcagatgaagatgtatttgatgcaacatatatgcattgggtaagacaagcaccaggacaaacatttgaatggttaggatggatgaaaccagtaacaggagcagtaaattatgcaagaaaatttcaaggaagagtatcattttatagaacaagagaattaggaatagcatatatggatttaagaaatttaagatttgatgatacagcagtatatttttgtgcaagaaaaacagcaggagatgtaagtggagataaaagaggatttttttttgatttatggggaagaggaagtagagtaatagtaagtagt

SEQ ID NO: 49181 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggagtagaagtagaaaaaccaggagcaagtgtaacattaagttgtaaaacagcagatgaagatgtatttgatgcagcatatatgcattgggtaagacaagcaccaggacaaacatttgaatggttaggatggatgaaaccagtaacaggagcagtaagttatgcaagaaaatttcaaggaagagtaagtttttatatgacaagagaattaggaatggcatatatggatttaagaaatctaagatttgatgatacagcagtatatttttgtgcaagaaaaacagcaggagatgtaagtggagataatagaggatatttttttgatttatggggaagaggaagtagagtaatagtaagtagt

SEQ ID NO: 49182 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggagcaggagtaaaaaaaccaggagcaagtgtaacattaagttgtaaaacagcagatgaagatgtatttgatgcagcatatatgcattgggtaagacaagcaccaggacaaacatttgaatggttaggatggatgaaaccagtaacaggagcagtaagctatgcaagaaaatttcaaggaagagtaagtttttatatgacaagagaattaggaatggcatatatggatttaagaaatttaagatttgatgatacagcagtatatttttgtgcaagaaaaacagcaggagatgtaagtggagataatagaggatatttttttgatttatggggaagaggaagtagagtaatagtaagtagt

SEQ ID NO: 49183 - RNA, 381 nt, synthetic construct
  misc_feature 1..381: note = derived and/or modified sequence opt6 from anti-HIV-1_HeavyChain
  source 1..381: mol_type = other RNA
caagtacatatggaacaagcaggagcaggagtaaaaaaaccaggagcaagtgtaacattaagttgtaaaacagcagatgaagatgtatttgatgcagcatatatgcattgggtaagacaagcaccaggacaaacatttgaatggttaggatggatgaaaccagtaacaggagcagtaaattatgcaagaaaatttcaaggaagagtaagtttctatagaacaagagaattaggaatagcatatatggatttaagaaatttaagatttgatgatacagcagtatatttttgtgcaagaaaaacagcaggagatgtaagtggagataaaagaggatttttttttgatttatggggaagaggaagtagagtaatagtaagtagt

SEQ ID NO: 49184 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggagcagaagtaaaaaaaccaggagcaagtgtaacattaagttgtgaaacagcagatgaagatgtatttgatgcagcatatatgcattgggtaagacaagcaccaggacaaacatttgaatggttaggatggatgaaaccagtaacaggagcagtaaattatgcaaggaaatttcaagggagagtaagtttttatagaacaagagaactaggaatagcatatatggatttaagaaatttaagatttgatgatacagcagtatatttttgtgcaagaaaaacagcaggagatgtaagtggagataaaagaggatttttttttgatttatggggaagaggaagtagagtaatagtaagtagt

SEQ ID NO: 49185 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaaccaggaggaggagtaaaaaaaccgggagcaagtgtaacattaagttgtaaaacagcagatgaagatgtatttgatgcagcatatatgcattgggtaagacaagcaccaggacaaacatttgaatggttaggatggatgaaaccagtaacaggagcagtaaattatgcaagaaaatttcaaggaagagtaagtttttatagaacaagagaattaggaatagcatatatggatttaagaaatttaagatttgatgatacagcagtatatttttgtgcaagaaaaacagcaggagatgtaagtggagataaaagaggatttttttttgatttatggggaagaggaagtagagtaatagtaagtagt

SEQ ID NO: 49186 - RNA, 372 nt, synthetic construct
  misc_feature 1..372: note = derived and/or modified sequence opt6 from anti-HIV-1_HeavyChain
  source 1..372: mol_type = other RNA
gcaacaccatggaataaaagtggaagtggagtaaaaaaaccaggagcaagtgtgagagtaagttgttggacaagtgaagatatatttgaaagaacagaattaagtttagtaagacaagcaccaggacaaggattagaatggataggatggatgaaaacagtaacaggagcagtaaattttggaagtccaaattttagacatggagtaagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagt

SEQ ID NO: 49187 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggagcaggaatgaaaaaaccaggagcaagtatgacagcaagttgtaaaacagcagatgaagatatatttgatgcagcatatatgcattgggtaagacaagcaccaggacaaacatttgaatggttaggatggatgaaaccagtaacaggagcagtaaattatgcaaggcaatttcaaggaagagtaagtttttatagaacaagagaattaggaatagcatatatggatttaagagatttaaaatttgatgatacagcagtatatttttgtgcaagaaaaacaaaaggagatgtaagtggagatgatagaggatttttttttgatttatggggaagaggaacaagagtaatagtaagtagt

SEQ ID NO: 49188 - RNA, 378 nt, synthetic construct
  misc_feature 1..378: note = derived and/or modified sequence opt6 from anti-HIV-1_HeavyChain
  source 1..378: mol_type = other RNA
caagtacaattagtacaaagtggagcagaagtaaaaaaaccaggagcaagtgtaaaagtaagttgtaaagcaagtggatatacatttacaggatattatatgcattgggtaagacaagcaccaggacaaacatttgaatggttaggatggatgaaaccagtaacaggagcagtaaattatgcaagacaatttcaaggaagagtaagtttttatagaacaagagaattaggaatagcatatatggatttaagagatttaaaatttgatgatacagcagtatatttttgtgcaagaaaaacaaaagcagatgtaagtggagatgatagaggatttttttttgatttatggggaagaggaacaagagtaatagtaagtagt

SEQ ID NO: 49189 - RNA, 381 nt, synthetic construct
  misc_feature 1..381: note = derived and/or modified sequence opt6 from anti-HIV-1_HeavyChain
  source 1..381: mol_type = other RNA
agagtatatatggaacaagcaggagcaggagtaaaaaaaccaggagcaagtgtaacattaagttgtaaaacagcagatgaagatgtatttgatgcagcatatatgcattgggtaagacaagcaccaggacaaacatttgaatggttaggatggatgaaaccagtaacaggagcagtgagttatgcaagaaaatttcaaggaagagtaagttttacaatgacaagagaattaggaatggcatatatggatttaagaaatttaagatttgatgatacagcagtatatttttgtgcaagaaaaacagcaggagatgtaagtggagataatagaggatatttttttgatttatggggaagaggaagtagagtaatagtaagtagt

SEQ ID NO: 49190 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaaagtggaggaggagtaaaaaaaccaggaccaagtgtaacattaagttgtaaaacagcagatgaagatgtatttgatgcagcatatatgcattgggtaagacaagcaccaggacaaacatttgaatggctaggatggatgaaaccagtaacaggagcagtaaattatgcaagaaaatttcaaggaagagtaagtttttatagaacaagagaattaggaatagcatatatggatttaagaaatttaagatttgatgatacagcagtatatttttgtgcaagaaaaacagcaggagatgtaagtggagataaaagaggatttttttttgatttatggggaagaggaagtagagtaatagtaagtagt

SEQ ID NO: 49191 - RNA, 378 nt, synthetic construct
  misc_feature 1..378: note = derived and/or modified sequence opt6 from anti-HIV-1_HeavyChain
  source 1..378: mol_type = other RNA
caagtacaattagtacaaagtggagcagaagtaaaaaaaccaggagcgagtgtaaaagtaagttgtaaagcaagtggatatacatttacaggatattatatacattggatgagacaagcaccaggacaaggattagaatggatgggatggataaatccaaatagtggagcagtaagttatgcaagaaaatttcaaggaagagtaagttttttacatgatcaaggaataagaatggcatatatggatttaagaaatttaagatttgatgatacagcagtatatttttgtgcaagaaaaacagcaggagatgtaagtggagataatagaggatatttttttgatttatggggaagaggatcaagagtaatagtaagtagt

SEQ ID NO: 49192 - RNA, 381 nt, synthetic construct
  misc_feature 1..381: note = derived and/or modified sequence opt6 from anti-HIV-1_HeavyChain
  source 1..381: mol_type = other RNA
caagtacatatggaacaagcaggagtagaagtagaaaaaccaggagcaagcgtaacattaagttgtaaaacagcagatgaagatgtatttgatgcagcatatatgcattgggtaagacaagcaccaggacaaacatttgaatggttaggatggatgaaaccagtaacaggggcagtaaattatgcaagaaaatttcaaggaagagtaagtttttatagaacaagagaattaggaatagcatatatggatttaagaaatttaagatttgatgatacagcagtatacttttgtgcaagaaaaacagcaggagatgtaagtggagataaaagaggatttttttttgatttatggggaagaggaagtagagtaatagtaagtagt

SEQ ID NO: 49193 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggagcaggagtaaaaaaaccaggagcaagtgcaacattaagttgtaaaacagcagatgaagatgtatttgatgcagcatatatgcattgggtaagacaagcgccaggacaaacatttgaatggttaggatggatgaaaccagtaacaggagcagtaagttatgcaagaaaatttcaaggaagagtaagtttttatatgacaagagaattaggaatggcatatatggatctaagaaatttaagatttgatgatacagcagtatatttttgtgcaagaaaaacagcaggagatgtaagtggagataatagaggatatttttttgatttatggggaagaggaagcagagtaatagtaagtagt

SEQ ID NO: 49194 - RNA, 375 nt, synthetic construct
  misc_feature 1..375: note = derived and/or modified sequence opt6 from anti-HIV-1_HeavyChain
  source 1..375: mol_type = other RNA
ggacatgatttagaacaaagtggaagtggagtaaaaaaaccaggagcaagtgtaagagtaagttgttggacaagtgaagatatatttgaaaaaagtgaattaatacattgggtaagacaagcaccaggacaaggattagaatggataggatgggtaaaagcagtaagtggagcagtaaattatggaagtttagattttagacatagagtaagtttaacaagagatagagatttatttacagcacatatggatataagaggattaacacaagatgatacagcaatatatttttgtgcaagacaaaaatttgcaagaggagatcaaggatggttttttgatttatggggaagaggaacgttaatagtagtaagtagt

SEQ ID NO: 49195 - RNA, 378 nt, synthetic construct
  misc_feature 1..378: note = derived and/or modified sequence opt6 from anti-HIV-1_HeavyChain
  source 1..378: mol_type = other RNA
caagcacataggggaacaatatggggactagaagtaaaaaaaccaggaggatgggtaagagtaagctgttggacaagtgaagatatatttgaaagaacagaattaatacattgggtaagacaagcaccaggacaaggattagaatggataggatgggtaaaaacagtaacaggagcagtaaattttggaagtccaaattttagacatagagtaagtttaacaagagatagagatttatttacagcacatatggatataagaggattaacacaaggagatacagcaacatatttttgtgcaagacaaaaattcgaaagaggaggacaaggatggtattttgatttatggggaagaggaacattaatagtagtaagtagt

SEQ ID NO: 49196 - RNA, 381 nt, synthetic construct
  misc_feature 1..381: note = derived and/or modified sequence opt6 from anti-HIV-1_HeavyChain
  source 1..381: mol_type = other RNA
caagtacatatggaacaagcaggagcaggagtagaaaaaccaggagcaagcgtaacattaagctgtaaaacagcagatgaagatgtatttgatgcagcatatatgcattgggtaagacaagcaccaggacaaacatttgaatggttaggatggatgaaaccagtaacaggagcagtaagttatgcaagaaaatttcaaggaagagtaagcttttatatgacaagagaattaggaatggcatatatggatttaagaaatttaagatttgatgatacagcagtatatttttgtgcaagaaaaacagcaggagatgtaagcggagataatagaggatatttttttgatttatggggaagaggaagtagagtaatagtaagtagt

SEQ ID NO: 49197 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaaagtggaggaggagtaaaaaaaccaggagcaagtgtaacattaagttgtaaaacagcagatgaagatgtatttgatgcagcatatatgcattgggtaagacaagcaccaggacaaacatttgaatggttaggatggatgaaaccagtaacaggagcagtaagttatgcaagaaaatttcaaggaagagtaagtttttatatgacaagagaattaggaatggcatatatggatttaagaaatttaagatttgatgatacagcagtatatttttgtgcaagaaaaacagcaggagatgtaagtggagataatagaggatatttttttgatttatggggaagaggaagtagagtaatagtaagtagt

SEQ ID NO: 49198 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaaagtggaggaggagtaaaaaaaccaggagcaagtgtaacattaagttgtaaaacagcagatgaagatgtatttgatgcagcatatatgcattgggtaagacaagcaccaggacaaacatttgaatggctaggatggatgaaaccagtaacaggagcagtaaattatgcaagaaaatttcaaggaagagtaagcttttatagaacaagagaattaggaatagcatatatggatttaagaaatttaagatttgatgatacagcagtatatttttgtgcaagaaaaacagcaggagatgtaagtggagataaaagaggatttttttttgatttatggggaagaggaagtagagtaatagtaagtagt

SEQ ID NO: 49199 - RNA, 381 nt, synthetic construct
  misc_feature 1..381: note = derived and/or modified sequence opt6 from anti-HIV-1_HeavyChain
  source 1..381: mol_type = other RNA
gaagtatatatggaacaaagtggaggaggagtaaaaaaaccaggagcaagtgtaacattaagttgtaaaacagcaagtgaagatgtatttgatgcagcatatatgcattgggtaagacaagcaccaggacaaacatttgaatggttaggatggatgaaaccagtaacaggagcagtaaattatgcaagaaaatttcaaggaagagtaagtttttatagaacaagagaattaggaatagcatatatggatttaagaaatttaagatttgatgatacagcagtatatttttgtgcaagaaaaacagcaggagatgtaagtggagataaaagaggatttttttttgatttatggggaagaggaagtagagtaatagtaagtagt

SEQ ID NO: 49200 - RNA, 381 nt, synthetic construct
  misc_feature 1..381: note = derived and/or modified sequence opt6 from anti-HIV-1_HeavyChain
  source 1..381: mol_type = other RNA
caagtacaattagtacaaagtggagcagaagtaaaaaaaccaggagcaagtgtaacattaagttgtaaaacagcagatgaagatgtatttgatgcagcatatatgcattgggtaagacaagcaccaggacaaacatttgaatggttaggatggatgaaaccagtaacaggagcagtaagttatgcaagaaaatttcaaggaagagtaagtttttatatgacaagagaattaggaatggcatatatggatttaagaaatctaagatttgatgatacagcagtatatttttgtgcaagaaaaacagcaggagatgtaagtggagataatagaggatatttttttgatttatggggaagaggaagtagagtaatagtaagtagt

SEQ ID NO: 49201 - RNA, 381 nt, synthetic construct
  misc_feature 1..381: note = derived and/or modified sequence opt6 from anti-HIV-1_HeavyChain
  source 1..381: mol_type = other RNA
caagtatttatggaacaaagtggaggaggaatgaaaaaaccaggagcaagtatgacagtaagctgtaaaacagcagatgaagatgtatttgatgcagcatatatgcattgggtaagacaagcaccaggacaaacatttgaatggttaggatggatgaaaccagtaacaggagcagtaagttatgcaagaaaatttcaaggaagagtaagtttttatatgacaagagaattaggaatggcatatatggatttaagaaatttaagatttgatgatacagcagtatatttttgtgcaagaaaaacagcaggagatgtaagtggagataatagaggatatttttttgatttatggggaagaggaagtagagtaatagtaagtagt

SEQ ID NO: 49202 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggaggaggaatgaaaaaaccaggagcaagtatgacagtaagctgtaaaacagcagatgaagatatatttgatgcagcatatatgcattgggtaagacaagcaccaggacaaacatttgaatggttaggatggatgaaaccagtaacaggagcagtaaattatgcaagaagatttcaaggaagagtaagtttttatagaacaagagaattaggaatagcatatatggatttaagagatttaaaatttgatgatacagcagtatatttttgtgcaagaaaaacaaaaggagatgtaagtggagatgatagaggatttttttttgatttatggggaagaggaacaagagtaatagtaagtagt

SEQ ID NO: 49203 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggagcaggagtaaaaaaaccaggagcaagtgtaacattaagttgtaaagcagcggatgaagatgtatttgatgcagcatatatgcattgggtaagacaagcaccaggacaaacatttgaatggttaggatggatgaaaccagtaacaggagcagtaagttatgcaagaaaatttcaaggaagagtaagtttttatatgacaagagaattaggaatggcatatatggatttaagaaatttaagatttgatgatacagcagtatatttttgtgcaagaaaaacagcaggagatgtaagtggagataatagaggatatttttttgatttatggggaagaggaagtagagtaatagtaagtagt

SEQ ID NO: 49204 - RNA, 381 nt, synthetic construct
  misc_feature 1..381: note = derived and/or modified sequence opt6 from anti-HIV-1_HeavyChain
  source 1..381: mol_type = other RNA
caagtatttatggaacaagcaggagcaggaatgaaaaaaccaggagcaagtatgacagtaagttgtaaaacagcagatgaagatatatttgatgcagcatatatgcattgggtaagacaagcaccaggacaaacatttgaatggttaggatggatgaaaccagtaacaggagcagtaaattatgcaagacaatttcaaggaagagtaagtttttatagaacaagagaattaggaatagcatatatggatttaagagatctaaaatttgatgatacagcagtatatttttgtgcaagaaaaacaaaaggagatgtaagtggagatgatagaggatttttttttgatttatggggaagaggaacaagagtaatagtaagtagt

SEQ ID NO: 49205 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaaccaggaggagaagtaaaaaaaccaggagcaagtgtaacattaagttgtaaaacagcagatgaagatgtatttgatgcagcatatatgcattgggtaagacaagcaccaggacaaacatttgaatggttaggatggatgaaaccagtaacaggagcagtaaattatgcaagaaaatttcaaggaagagtaagtttttatatgacaagagaattaggaatggcatatatggatttaagaaatttaagatttgatgatacagcagtatatttttgtgcaagaaaaacagcaggagatgtaagtggagataatagaggatatttttttgatttatggggaagaggaagtagagtaatagtaagtagt

SEQ ID NO: 49206 - RNA, 381 nt, synthetic construct
  misc_feature 1..381: note = derived and/or modified sequence opt6 from anti-HIV-1_HeavyChain
  source 1..381: mol_type = other RNA
caagtacatatggaacaagcaggagcaggagtaaaaaaaccaggagcaagtgtaacattaagttgtaaaacagcagatgaagatgtatttgatgcagcatatatgcattgggtaagacaagcaccaggacaaacatttgaatggttaggatggatgaaaccagtaacaggagcagtaagttatgcaaggaaatttcaaggaagagtaagtttttatatgacaagagaattaggaatggcatatatggatttaagaaatttaagatttgatgatacagcagtatatttttgtgcaagaaaaacagcaggagatgtaagtggagataatagaggatatttttttgatttatggggaagaggaagcagagtaatagtaagtagt

SEQ ID NO: 49207 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggaggaggagtaaaaaaaccaggagcaagtgtaacattaagttgtaaaacagcagatgaagatgtatttgatgcagcatatatgcattgggtaagacaagcaccaggacaaacatttgaatggttaggatggatgaaaccagtaacaggagcagtaaattatgcaagaaaatttcaaggaagagtaagtttttatagaacaagagaattaggaatagcatatatggatttaagaaatttaagatttgatgatacagcagtatatttttgtgcaagaaaaacagcaggggatgtaagtggagataaaagaggatttttttttgatttatggggaagaggaccaagagtaatagtaagtagt

SEQ ID NO: 49208 - RNA, 381 nt, synthetic construct
  misc_feature 1..381: note = derived and/or modified sequence opt6 from anti-HIV-1_HeavyChain
  source 1..381: mol_type = other RNA
caagtacaattagtacaaagcggagcagaagtaaaaaaaccaggagcaagcgtaaaagtaagctgtaaagcaagcggacacacattcacaaactatgacataaactgggtaagacaagcaccaggacaaggactagaatggataggatgggtaaaaatagtaagcggaacagtaaacttcgcatcactagatttcagaaacagaatatcactatcaagagatagagatctatcaacagcatacatggacataagaggactaacacaagatgacacggcaacatacttttgcgcaagacaaaaatttgcatcaagatatagcggagaccaaggatcatactttgacttatggggaagaggaacattaatagtagtatcaagc

SEQ ID NO: 49209 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggaggaggaatgaaaaaaccaggagcaagtatgacagtaagttgtaaaacagcagatgaagatatatttgatgcagcatatatgcattgggtaagacaagcaccaggacaaacatttgaatggttaggatggatgaaaccagtaacaggagcagtaaattatgcaagacaatttcaaggaagagtaagtttttatagaacaagagaattaggaatagcatatacagatttaagagatttaaaatttgatgatacagcagtatatttttgtgcaagaaaaacaaaaggagatgtaagtggagatgatagaggatttttttttgatttatggggaagaggaacaagagtaatagtaagttca

SEQ ID NO: 49210 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggaggaggagtaaaaaaaccaggagcaagtgtaacactaagttgtaaaacagcagatgaagatgtatttgatgcagcatatatgcattgggtaagacaagcaccaggacaaacatttgaatggttaggatggatgaaaccagtaacaggagcagtaaattatgcaagacaatttcaaggaagagtaagtttttatagaacaagagaattaggaatagcatatatggatttaagagatttaaaatttgatgatacagcagtatatttttgtgcaagaaaaacaaaaggagatgtaagtggagatgatagaggatttttttttgatttatggggaagaggaacaagagtaatagtaagtagt

SEQ ID NO: 49211 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggaggaggagtaaaaaaaccaggagcaagcgtaacattaagttgtaaaacagcagatgaagatgtatttgatgcagcatatatgcattgggtaagacaagcaccaggacaaacatttgaatggccaggatggatgaaaccagtaacaggagcagtaaattatgcaagaaaatttcaaggaagagtaagtttttatagaacaagagaattaggaatagcatatatggatttaagaaatttaagatttgatgatacagcagtatatttttgtgcaagaaaaacagcaggagatgtaagtggagataaaagaggatttttttttgatttatggggaagaggaagtagagtaatagtaagcagt

SEQ ID NO: 49212 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggaggaggagtaaaaaaaccaggagcaagtgcaacattaagttgtaaaacagcagatgaagatgtatttgatgcagcatatatgcattgggtaagacaagcaccaggacaaacatttgaatggttaggatggatgaaaccagtaacaggagcagtaagttatgcaagaaaatttcaaggaagagtaagtttttatatgacaagagaattaggaatggcatatatggatttaagaaatttaagatttgatgatacagcagtatatttttgtgcaagaaaaacagcaggagatgtaagtggagataatagaggatatttttttgatttatggggaagaggaagtagagtaatagtaagtagt

SEQ ID NO: 49213 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggaggaggagtaaaaaaaccaggagcaagtgtaacattaagttgtaaaacagcagatgaagatgtatttgatgcagcatatatgagatgggtaagacaagcaccaggacaaacatttgaatggttaggatggatgaaaccagtaacaggagcagtaaattatgcaagaaaatttcaaggaagagtaagtttttatagaacaagagaattaggaatagcatatatggatttaagaaatttaagatttgatgatacagcagtatatttttgtgcaagaaaaacagcaggagatgtaagtggagataaaagaggatttttttttgatttatggggaagaggaagtagagtaatagtaagtagt

SEQ ID NO: 49214 - RNA, 381 nt, synthetic construct
  misc_feature 1..381: note = derived and/or modified sequence opt6 from anti-HIV-1_HeavyChain
  source 1..381: mol_type = other RNA
caagtacaactagtacaatcaggcgcagaagtaaaaaaaccaggagcatcagtaaaagtatcatgcagagcatcaggatatacatttggaaatcacgcaatatcatgggtaagacaagcaccaggacaaggattagaatggatgggatggataagaccaaaaacaggagcaagaaatcaagcaagacaattccaaccaagaatatcattaacaagagatagagcattatcaacagcatacttagacttaaactctctaacaagcgcagactcaggaacatacttttgcgcaagacaaacatttaaaccagacttttactttgcagatcaaggatggtcattcaatctatggggaagaggagcacactttatagtaagctca

SEQ ID NO: 49215 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggaggaggagtaaaaaaaccaggagcaagtgtaacattaagttgtaaaacagcagatgaagatgtatttgatgcagcatatatgcattgggtaagacaagcaccaggacaaacatttgaatggttaggatggatgaaaccagtaacaggagcagtaagttatgcaagaaaatttcaaggaagagtaagtttttatatgacaagagaattaggaatggcatatatggatttaagaaatttaagatttgatgatacagcagtatatttttgtgcaagaaaaacagcaggagatgtaagtggagataatagaggatatttttttgatttatggggaccaggatcaagagtaatagtaagtagt

SEQ ID NO: 49216 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggagcaggagtaaaaaaaccaggagcaagtgtaacattaagttgtaaaacagcagatgaagatgtatttgatgcagcatatatgcattgggtaagacaagcaccaggacaaacatttgaatggttaggatggatgaaaccagtaacaggagcagtaaattatgcaagaaaatttcaaggaagagtaagtttttatagaacaagagaattaggaatagcatatatggatttaagaaatttaagatttgatgatacagcagtatatttttgtgcaagaaaaacagcaggagatgtaagtggagataaaagaggatttttttttgatttatggggaagaggaagcagagtaatagtaagcagt

SEQ ID NO: 49217 - RNA, 381 nt, synthetic construct
  misc_feature 1..381: note = derived and/or modified sequence opt6 from anti-HIV-1_HeavyChain
  source 1..381: mol_type = other RNA
caagtacatatggaacaagcaggaggaggagtaaaaaaaccaggagcaagtgtaacattaagttgtaaaacagcagatgaagatgtatttgatgcagcatatatgcattgggtaagacaagcaccaggacaaacatttgaatggttaggatggatgaaaccagtaacaggagcagtaaattatgcaagaaaatttcaaggaagagtaagtttttatagaacaagagaattaggaatagcatatatggatttaagaaatttaagatttgatgatacagcagtatatttttgtgcaagaaaaacagcaggagatgtaagtggagataaaagaggatttttttttgatttatggggaagaggaagcagagtaatagtaagtagt

SEQ ID NO: 49218 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggagatggaatgaaaaaaccaggagcaagtatgacagtaagttgtaaaacagcagatgaagatatatttgatgcagcatatatgcattgggtaagacaagcaccaggacaaacatttgaatggttaggatggatgaaaccagtaacaggagcagtaaattatgcaagacaatttcaaggaagagtaagtttttatagaacaagagaattaggaatagcatatatggatttaagagatttaaaatttgatgatacagcagtatatttttgtgcaagaaaaacaaaaggagatgtaagtggagatgatagaggatttttttttgatttatggggaagaggaacaagagtaatagtaagtagt

SEQ ID NO: 49219 - RNA, 381 nt, synthetic construct
  misc_feature 1..381: note = derived and/or modified sequence opt6 from anti-HIV-1_HeavyChain
  source 1..381: mol_type = other RNA
caagtacaattagtacaaagtggagcagaagtaaaaaaaccaggagcaagcgtaacattaagttgtaaaacagcagatgaagatgtatttgatgcagcatatatgcattgggtaagacaagcacaaggacaaacatttgaatggttaggatggatgaaaccagtaacaggagcagtaaattatgcaagaaaatttcaaggaagagtaagtttttatagaacaagagaattaggaatagcatatatggatttaagaaatctaagatttgatgatacagcagtatatttttgtgcaagaaaaacagcaggagatgtaagtggagataaaagaggatttttttttgatttatggggaagaggaagtagagtaatagtaagtagt

SEQ ID NO: 49220 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggaggaggagtaaaaaaaccaggagcaagtgtaacattaagttgtaaaacagcagatgaagatgtatttgatgcagcatatatgcattgggtaagacaagcaccaggacaaacatttgaatggttaggatggatgaaaccagtaacaggagcagtaaattatgcaagaaaatttcaaggaagagtaagtttttatagaacaagagaattaggaatagcatatatggatttaagaaatttaagatttgatgatacagcagtatatttttgtgcaagaaaaacagcaggagatgtaagtggagataaaagaggatttttttttgatttatggggaagaggaagtcaagtaatagtaagtagt

SEQ ID NO: 49221 - RNA, 381 nt, synthetic construct
  misc_feature 1..381: note = derived and/or modified sequence opt6 from anti-HIV-1_HeavyChain
  source 1..381: mol_type = other RNA
caagtacaattagtacaaagtggagcagaagtaagaaaaccaggagcaagcgtaaaagtaagttgtaaagcaagtggatacacattcacaaactattacatgcactgggtaagacaagcaccaggacaaggactagaatggataggatgggtaaaaatagtaagcggaacagtaaactttgcatcactagatttcagaaacagaatatcactatcaagagatagagatctatcaacagcatacatggacataagaggactaacacaagatgacacagcaacatacttttgcgcaagacaaaaatttgcatcaagatatagcggagaccaaggatcatactttgacttatggggaagaggaacattaatagtagtatcaagc

SEQ ID NO: 49222 - RNA, 381 nt, synthetic construct
  misc_feature 1..381: note = derived and/or modified sequence opt6 from anti-HIV-1_HeavyChain
  source 1..381: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggaacagtaaattatgcaagaaaatttcaaggaagagtaagtttttatagaacaagagaattaggaatagcatatatggatttaagaaatttaagatttgatgatacagcagtatatttttgtgcaagaaaaacagcaggagatgtaagtggagataaaagaggatttttttttgatttatggggaagaggaagtagagtaatagtaagtagt

SEQ ID NO: 49223 - RNA, 381 nt, synthetic construct
  misc_feature 1..381: note = derived and/or modified sequence opt6 from anti-HIV-1_HeavyChain
  source 1..381: mol_type = other RNA
ttaatacatttagcacaaagtggagcagaagtaaaaaaaccaggagcaagtgtaacattaagttgtaaaacagcagatgaagatgtatttgatgcagcatatatgcattgggtaaggcaagcaccaggacaaacatttgaatggttaggatggatgaaaccagtaacaggagcagtaagttatgcaagaaaatttcaaggaagagtaagtttttatatgacgagagaattaggaatggcatatatggatttaagaaatttaagatttgatgatacagcagtatatttttgtgcaagaaaaacagcaggagatgtaagtggagataatagaggatatttttttgatttatggggaagaggaagcagagtaatagtaagttca

SEQ ID NO: 49224 - RNA, 381 nt, synthetic construct
  misc_feature 1..381: note = derived and/or modified sequence opt6 from anti-HIV-1_HeavyChain
  source 1..381: mol_type = other RNA
caagtacaattagtacaaagtggagcagaagtaaaaaaaccaggagcaagtatgacagtaagttgtaaaacagcagatgaagatatatttgatgcagcatatatgcattgggtaagacaagcaccaggacaaacatttgaatggttaggatggatgaaaccagtaacaggagcagtaaattatgcaagacaatttcaaggaagagtaagtttttatagaacaagagaattaggaatagcatatatggatttaagagatttaaaatttgatgatacagcagtatatttttgtgcaagaaaaacaaaaggagatgtaagtggagatgatagaggattcttttttgatttatggggaagaggaacaagagtaatagtaagtagt

SEQ ID NO: 49225 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaaggaagaggaggagtaaaaaaaccaggagcaagtgtaacattaagttgtaaaacagcagatgaagatgtatttgatgcagcatatatgcattgggtaagacaagcaccaggacaaacatttgaatggttaggatggatgaaaccagtaacaggagcagtaaattatgcaagaaaatttcaaggaagagtaagtttttacagaacaagagaattaggaatagcatatatggatttaagaaatttaagatttgatgatacagcagtatatttttgtgcaagaaaaacagcaggagatgtaagtggagataaaagaggatttttttttgatttatggggaagaggaagtagagtaatagtaagtagt

SEQ ID NO: 49226 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggaggaggaatgaaaaaaccaggagcaagtatgacagtaagttgtaaaacagcagatgaagatgtatttgatgcagcatatatgcattgggtaagacaagcaccaggacaaacatttgaatggttaggatggatgaaaccagtaacaggagcagtaaattatgcaagacaatttcaaggaagagtaagtttttatagaacaagagaattaggaatagcatatatggatttaagagatttaaaaagtgatgatacagcagtatatttttgtgcaagaaaaacagcaggagatgtaagtggagataaaagaggatttttttttgatttatggggaagaggaagtagagtaatagtaagtagt

SEQ ID NO: 49227 - RNA, 381 nt, synthetic construct
  misc_feature 1..381: note = derived and/or modified sequence opt6 from anti-HIV-1_HeavyChain
  source 1..381: mol_type = other RNA
caagtacaattagtacaaagcggagcagaagtaaaaaaaccaggatcaagcataaaagtaagctgtaaagcaagtggagacacaatatcaagatatgcaataaactgggtaagacaagcaccaggacaaggactagaatggataggatgggtaaaaacagtaacaggagcagtaaactttggatcactagatttcagacacagaatatcactaacaagagatagagatctatttacagcacacatgggaataagaggactaacacaaggagacacagcaacatacttttgcgcaagacaaaaatttgaatcaagatatacaggaggacaaggatggtactttgacttatggggaagaggaacacatatagtagtatcaagt

SEQ ID NO: 49228 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggaggaggagtaaaaaaaccaggagcaagcgtaacattaagttgtaaaacagcagatgaagatatatttgatgcagcatatatgcattgggtaagacaagcaccaggacaaacatttgaatggttaggatggatgaaaccagtaacaggagcagtaaattatgcaagaaaatttcaaggaagagtaagtttttatagaacaagagaattaggaatagcatatatggatttaagaaatttaagatttgatgatacagcagtatatttttgtgcaagaaaaacagcaggagatgtaagtggagataaaagaggatttttttttgatttatggggaagaggaagtagagtaatagtaagtagt

SEQ ID NO: 49229 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggaggaggagtaaaaaaaccaggagcaagtgtaacattaagttgtaaaacagcagatgaagatgtatttgatgcagcatatatgcattgggtaagacaagcaccaggacaaacatttgaatggctaggatggatgaaaccagtaacaggagcagtaaattatgcaagaaattttcaaggaagagtaagtttttatagaacaagagaattaggaatagcatatatggatttaagaaatttaagatttgatgatacagcagtatatttttgtgcaagacaaaaatttgaaagtagatatagtggagatcaaggaagttattttgatttatggggaagaggaacattaataatagtaagtagt

SEQ ID NO: 49230 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggaggaggagtaaaaagaccaggagcaagtgtaacattaagttgtaaaacagcagatgaagatgtatttgatgcagcatatatgcattgggtaagacaagcaccaggacaaacatttgaatggttaggatggatgaaaccagtaacaggagcagtaaattatgcaagaaaatttcaaggaagagtaagtttttatagaacaagagaattaggaatagcatatatggatttaagaaatttaagatttgatgatacagcagtatatttttgtgcaagaaaaacagcaggagatgtaagtggagataaaagaggatttttttttgatttatggggaagaggaagtagagtaatagtaagtagt

SEQ ID NO: 49231 - RNA, 381 nt, synthetic construct
  misc_feature 1..381: note = derived and/or modified sequence opt6 from anti-HIV-1_HeavyChain
  source 1..381: mol_type = other RNA
caagtgcaattagtacaaagtggagatgaagtaaaaaaaccaggagcaagtgtaacattaagttgtaaaacagcagatgaagatgtatttgatgcagcatatatgcattgggtaagacaagcaccaggacaaacatttgaatggttaggatggatgaaaccagtaacaggagcagtaaattatgcaagaaaatttcaaggaagagtaagtttttatagaacaagagaactaggaatagcatatatggatttaagaaatttaagatttgatgatacagcagtatatttttgtgcaagaaaaacagcaggagatgtaagtggagataaaagaggatttttttttgatttatggggaagaggaagtagagtaatagtaagtagt

SEQ ID NO: 49232 - RNA, 381 nt, synthetic construct
  misc_feature 1..381: note = derived and/or modified sequence opt6 from anti-HIV-1_HeavyChain
  source 1..381: mol_type = other RNA
caagtacaattagtacaatcaggagcaggagtaaaaaaaccaggaagctcagtaaaagtatcgtgcaaagcatcaggaggaacatttagctcatacgcaataaattggttaagacaagtaccaggacaaagaccagaatggatgggatggataagaccaaaaacaggagcgagaaatcaagcaagacaattccaaccaagaatatcactaacaagagatagagcactatcaacagcatacttagacttaaactcactaacaagcgcagactcaggaacatacttttgcgcaagacaaacatttaaaccagacttttactttgcagatcaaggatggtcattcaatctatggggaagaggagcacactttatagtaagctca

SEQ ID NO: 49233 - RNA, 381 nt, synthetic construct
  misc_feature 1..381: note = derived and/or modified sequence opt6 from anti-HIV-1_HeavyChain
  source 1..381: mol_type = other RNA
caagtatatatggaaagagcaggaggaggagtaaaaaaaccaggagcaagcgtaacattaagttgtgaaacagcagatgaagatgtatttgatgcagcatatatgcattgggtaagacaagcaccaggacaaacatttgaatggttaggatggatgaaaccagtaacaggagcagtaaattatgcaagaaaatttcaaggaagagtaagtttttatagaacaagagaattaggaatagcatatatggatttaagaaatttaagatttgatgatacagcagtatatttttgtgcaagaaaaacagcaggagatgtaagtggagataaaagaggatttttttttgatttatggggaagaggaagtagagtaatagtaagtagt

SEQ ID NO: 49234 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggagcaggaatgaaaaaaccaggagcaagtatgacagtaagttgtaaaacagcagatgaagatatatttgatgcagcatatatgcattgggtaagacaagcaccaggacaaacatttgaatggttaggatggatgaaaccagtaacaggagcagtaaattatgcaagacaatttcaaggaagagtaagctttttacaagatcaaggaataagaatagcatatatggatctaagagatctaaaatttgatgatacagcagtatatttttgtgcaagaaaaacaaaaggagatgtaagtggagatgatagaggatttttttttgatctatggggaagaggaacaagagtaatagtaagtagt

SEQ ID NO: 49235 - RNA, 381 nt, synthetic construct
  misc_feature 1..381: note = derived and/or modified sequence opt6 from anti-HIV-1_HeavyChain
  source 1..381: mol_type = other RNA
caagtatatatgggagcaggaagaggaggagtaaaaaaaccaggagcaagtgtaacattaagctgtaaaacagcagatgaagatgtatttgatgcagcatatatgcattgggtaagacaagcaccaggacaaacatttgaatggttaggatggatgaaaccagtaacaggagcagtaaattatgcaagaaaatttcaaggaagagtaagtttttatagaacaagagaattaggaatagcatatatggatttaagaaatttaagatttgatgatacagcagtatatttttgtgcaagaaaaacagcaggagatgtaagtggagataaaagaggatttttttttgatttatggggaagaggaagtagagtaatagtaagtagt

SEQ ID NO: 49236 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggagcaggagtaaaaaaaccaggagcaagtgtaacattaagttgtaaaacagcggatgaagatgtatttgatgcagcatatatgcattgggtaagacaagcaccaggacaaccatttgaatggttaggatggatgaaaccagtaacaggagcagtaagttatgcaagaaaatttcaaggaagagtaagcttttatatgacaagagaattaggaatggcatatatggatttaagaaatttaagatttgatgatacagcagtatatttttgtgcaagaaaaacagcaggagacgtaagcggagataatagaggatatttttttgatttatggggaagaggaagtagagtaatagtaagtagt

SEQ ID NO: 49237 - RNA, 381 nt, synthetic construct
  misc_feature 1..381: note = derived and/or modified sequence opt6 from anti-HIV-1_HeavyChain
  source 1..381: mol_type = other RNA
caagtacaactagtacaatcaggagcagaagtaaaaaaaccaggagcatcagtaaaaatatcatgcaaagcatcaggatatacatttataagacacggaatacattggttaagacaagtaccaggacaaagaccagaatggatgggatggataagaccaaaaacaggagcaagaaatcaagcaagacaattccaaccaagaatatcactagcaagagatagagcactatcaacagcatacttagacttaaactcactaacaagtgcagactcaggaacatacttttgcgcaagacaaacatttaaaccagacttttactttgcagatcaaggatggtcattcaatttatggggaagaggagcacactttatagtaagctca

SEQ ID NO: 49238 - RNA, 381 nt, synthetic construct
  misc_feature 1..381: note = derived and/or modified sequence opt6 from anti-HIV-1_HeavyChain
  source 1..381: mol_type = other RNA
caagtattactagtacaatcaggagcagaagtaaaaaaaccaggaagctcagtaaaagtatcatgcaaagcatcaggagatagcttaacaaaatacgcattctcatgggtaagacaagcaccaggacaaggaccagaatggatgggatggataagaccaaaaacaggagcaagaaatagagcaagacaattccaaccaagaatatcactaacaagagatagagcactatcaacagcatacttagacttaaactcactaacaagcgcagactcaggaacatacttttgcgcaagacaaacatttaaaccagacttttactttgcagatcaaggatggtcattcaatctatggggaagaggagcacactttatagtaagctca

SEQ ID NO: 49239 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggaggaggagtaaaaaaaccaggagcaagtgtaacattaagttgtaaaacagcagatgaagatgtatttgatgcagcatatatgcattgggtaagacaagcaagaggacaaacatttgaatggttaggatggatgaaaccagtaacaggagcagtaaattatgcaagaaaatttcaaggaagagtaagtttttatagaacaagagaattaggaatagcatatatggatttaagaaatttaagatttgatgatacagcagtatatttttgtgcaagaaaaacagcaggagatgtaagtggagataaaagaggatttttttttgatttatggggaagaggaagtagagtaatagtaagtagc

SEQ ID NO: 49240 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggaggaggagtaaaaaaaccaggagcaagtgtaacattaagttgtaaaacagcagatgaagatgtatttgatgcagcatatatgcattgggtaagacaagcaccaggacaaacatttgaatggttaggatggatgaaaccagtaacaggagcagtaaattatgcaagaaaatttcaaggaagagtaagtttttatagaacaagagaattaggaatagcatatatggatctaagaaatttaagatttgatgatacagcagtatatttttgtgcaagaaaaacagcaggagatgtaagtggagataatagaggatatttttttgatttatggggaagaggaagtagagtaatagtaagtagt

SEQ ID NO: 49241 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggaggaggagtaaaaaaaccaggagcaagtgtaacgttaagttgtaaaacagcagatgaagatgtatttgatgcagcatatatgcattgggtaagacaagcaccaggacaaacatttgaatggttaggatggatgaaaccagtaacaggagcagtaaattatgcaagaaaatttcaaggaagagtaagtttttatagaacaagagaattaggaatagcatatatggatttaagaaatttaagatttgatgatacagcagtatatttttgtgcaagaaaaacagcaggagatgtaagtggagataaaagaggatttttttttgatctatggggaccaggaagtagagtaatagtaagtagc

SEQ ID NO: 49242 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggaggaggaatgaaaaaaccaggagcaagtatgacagtaagttgtaaaacagcagatgaagatatatttgatgcagcgtatatgagatgggtaagacaagcaccaggacaaacatttgaatggttaggatggatgaaaccagtaacaggagcagtaaattatgcaagacaatttcaaggaagagtaagtttttatagaacaagagaattaggaatagcgtatatggatttaagagatttaaaatttgatgatacagcagtatatttttgtgcaagaaaaacaaaaggagatgtaagtggagatgatagaggatttttttttgatttatggggaagaggaacaagagtaatagtaagtagt

SEQ ID NO: 49243 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggaggaggagtaaaaaaaccaggagcaagtgtaacattaagttgtaaaacggcagatgaagatgtatttgatgcagcatatatgcattgggtaagacaagcaccaggacaaacatttgaatggttaggatggatgaaaccagtaacaggagcagtaagctatgcaagaaaatttcaaggaagagtaagtttttatatgacaagagaattaggaatggcatatttagatttaagaaatttaagatttgatgatacagcagtatatttttgtgcaagaaaaacagcaggagatgtaagtggagataatagaggatatttttttgatttatggggaagaggaagtagagtaatagtaagtagt

SEQ ID NO: 49244 - RNA, 381 nt, synthetic construct
  misc_feature 1..381: note = derived and/or modified sequence opt6 from anti-HIV-1_HeavyChain
  source 1..381: mol_type = other RNA
caagtacaattagtacaaagtggagcagaagtaaaaaaaccaggagcaagtgtaaaagtaagctgtaaagcaagcggatacacattcacaggatattacatgcactgggtaagacaagcaccaggacaaggactagaatggataggatgggtaaaaacagtaacaggagcagtaaactttggatcactagatttcagacacagaatatcactaacaagagatagagatttatttacagcacacatggacataagaggactaacacaaggagacacagcaacatacttttgtgcaagacaaaaatttgaatcaagatatacaggaggacaaggatggtattttgacttatggggaagaggaacacatatagtagtatcaagt

SEQ ID NO: 49245 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggaggaggagtaaaaaaaccaggagcaagtgtaacattaagttgtaaaacagcggatgaagatgtatttgatgcagcatatatgcattgggtaagacaagcaccaggacaaacatttgaatggttaggatggataaaaccagtaacaggagcagtaaattatgcaagaaaatttcaaggaagagtaagtttttatagaacaagagaattaggaatagcatatatggatttaagaaatttaagatttgatgatacagcagtatatttttgtgcaagaaaaacagcaggagatgtaagtggagataaaagaggatttttttttgatttatggggaagaggaagcagagtaatagtaagcagt

SEQ ID NO: 49246 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggaggaggaatgaaaaaaccaggagcaagtgtaacagtaagctgtaaaacagcagatgaagatatatttgatgcagcatatatgcattgggtaagacaagcaccaggacaaacatttgaatggttaggatggatgaaaccagtaacaggagcagtaaattatgcaagacaatttcaaggaagagtaagtttttatagaacaagagaattaggaatagcatatatggatttaagagatttaaaatttgatgatacagcagtgtatttttgtgcaagaaaaacaaaaggagatgtaagtggagatgatagaggatttttttttgatttatggggaagaggaacaagagtaatagtaagtagt

SEQ ID NO: 49247 - RNA, 381 nt, synthetic construct
  misc_feature 1..381: note = derived and/or modified sequence opt6 from anti-HIV-1_HeavyChain
  source 1..381: mol_type = other RNA
caagcacatttagaacaaagcggaagcggagtaaaaaaaccaggagcaagtgtaagagtaagctgttggtcaagtgaagacataagtaaagcagaattaatacattgggtaagacaagcgccaggacaaggactagaatggataggatgggtaaaaacagtaacaggagcagtaaattttggatcattagatttcagacatagaatatcattaacaagagatagagatttatttacagcacatatggacataagaggactaacacaaggagatacagcaacatatttttgtgcaagacaaaaatttgaatcaagatatacaggaggacaaggatggtattttgacttatggggaagaggaacacatatagtagtatcaagt

SEQ ID NO: 49248 - RNA, 381 nt, synthetic construct
  misc_feature 1..381: note = derived and/or modified sequence opt6 from anti-HIV-1_HeavyChain
  source 1..381: mol_type = other RNA
caagtatatatggaagcaggaagaggaggagtaaaaaaaccaggagcaagtgcaacattaagttgtaaaacagcagatgaagatgtatttgatgcagcatatatgcattgggtaagacaagcaccaggacaaacatttgaatggttaggatggatgaaaccagtaacaggagcagtaagttatgcaagaaaatttcaaggaagagtaagtttttatatgacaagagaattaggaatggcatatatggatttaagaaatttaagatttgatgatacagcagtatatttttgtgcgagaaaaacagcaggagatgtaagtggagataatagaggatatttttttgatttatggggaagaggaagtagagtaatagtaagtagt

SEQ ID NO: 49249 - RNA, 381 nt, synthetic construct
  misc_feature 1..381: note = derived and/or modified sequence opt6 from anti-HIV-1_HeavyChain
  source 1..381: mol_type = other RNA
agatgtatatggaggcaagcaggaggaggagtaaaaaaaccaggagcaagtgtaacactaagttgtaaaacagcagatgaagatgtatttgatgcagcatatatgcattgggtaagacaagcaccaggacaaacatttgaatggttaggatggatgaaaccagtaacaggagcagtaagttatgcaagaaaatttcaaggaagagtaagtttttatatgacaagagaattaggaatggcatatatggatttaagaaatttaagatttgatgatacagcagtatatttttgtgcaagaaaaacagcaggagatgtaagtggagataatagaggatatttttttgatttatggggaagaggaagcagagtaatagtaagtagt

SEQ ID NO: 49250 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggaggaggagtaaaaaaaccaggagcaagtgtaacactaagttgtaaaacagcagacgaagatgtatttgatgcagcatatatgcattgggtaagacaagcaccaggacaaacatttgaatggttaggatggataaaaccagtaacaggagcagtaagttatgcaagaaaatttcaaggaagagtaagtttttatatgacaagagaattaggaatggcatatatggatttaagaaatttaagatttgatgatacagcagtatatttttgtgcaagaaaaacagcaggagatgtaagtggagataatagaggatatttttttgatttatggggaagaggaagtagagtaatagtaagcagt

SEQ ID NO: 49251 - RNA, 384 nt, synthetic construct
  misc_feature 1..384: note = derived and/or modified sequence opt6 from anti-HIV-1_HeavyChain
  source 1..384: mol_type = other RNA
caaagccatctagaacaatcaggatcagcaatgaaaaaaccaggagcatcagtaaaaagctcatgctggacatcagaagatatatttgacacaacagaactaatatactgggtaagacaagcaccaggacaaggactagaatggataggatgggtaaaaatagtaagtggaacagtaaactttgcatcattagatttcagaaacagaatatcactatcaagagatagagatctatcaacagcatacatggacataagaggactaacacaagatgacacagcaacatacttttgcgcaagacaaaaatttgcatcaagatatagcggagaccaaggatcatactttgacttatggggaagaggaacattaatagtagtatcaagc

SEQ ID NO: 49252 - RNA, 381 nt, synthetic construct
  misc_feature 1..381: note = derived and/or modified sequence opt6 from anti-HIV-1_HeavyChain
  source 1..381: mol_type = other RNA
agatgtttatggagacaagcaggaggaggaatgaaaaaaccaggagcaagtatgacagtaagttgtaaaacagcagatgaagatgtatttgatgcagcatatatgcattgggtaagacaagcaccaggacaaacatttgaatggctaggatggatgaaaccagtaacaggagcagtaaattatgcaagaaaatttcaaggaagagtaagtttttatagaacaagagaattaggaatagcatatatggatttaagaaatttaagatttgatgatacagcagtatatttttgtgcaagaaaaacagcaggagatgtaagcggagataaaagaggatttttttttgatttatggggaagaggaagtagagtaatagtaagtagt

SEQ ID NO: 49253 - RNA, 381 nt, synthetic construct
  misc_feature 1..381: note = derived and/or modified sequence opt6 from anti-HIV-1_HeavyChain
  source 1..381: mol_type = other RNA
agatgtatatgggaaagagcaggaggaggaatgaaaaaaccaggagcaagtatgacagtaagttgtaaaacagcagatgaagatatatttgatgcagcatatatgcattgggtaagacaagcaccaggacaaacatttgaatggttaggatggatgaaaccagtaacaggagcagtaaattatgcaagacaatttcaaggaagagtaagtttttatagaacaagagaattaggaatagcatatatggatctaagagatttaaaatttgatgatacagcagtatatttttgtgcaagaaaaacaaaaggagatgtaagtggagatgatagaggatttttttttgatttatggggaagaggaacaagagtaatagtaagtagt

SEQ ID NO: 49254 - RNA, 381 nt, synthetic construct
  misc_feature 1..381: note = derived and/or modified sequence opt6 from anti-HIV-1_HeavyChain
  source 1..381: mol_type = other RNA
caagtacaattagaacaagcaggaggaggagtaaaaaaaccaggagcaagtgtaacattaagttgtaaaacagcagatgaagatgtatttgatgcagcatatatgcattgggtaagacaagcaccaggacaaacatttgaatggttaggatggatgaaaccagtaacaggagcagtaaattatgcaagaaaatttcaaggaagagtaagtttttatagaacaagagaattaggaatagcatatatggatttaagaaatttaagatttgatgatacagcagtatatttttgtgcaagaaaaacagcaggagatgtaagtggagataaaagaggatttttttttgatttatggggaagaggaagtagagtaatagtaagtagt

SEQ ID NO: 49255 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggaggaggaatgaaaaaaccaggagcaagtatgacagtaagttgtaaaacagcagatgaagatgtatttgatgcagcatatatgcattgggtaagacaagcaccaggacaaacatttgaatggttaggatggatgaaaccagtaacaggagcagtaaattatgcaagaaaattccaaggaagagtaagtttttatagaacaagagaattaggaatagcatatatggatttaagaaatttaagatttgatgatacagcagtatatttttgtgcaagaaaaacagcaggagatgtaagtggagataaaagaggatttttttttgatttatggggaagaggaagtagagtaatagtaagtagt

SEQ ID NO: 49256 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggaggaggagtaaaaaaaccaggagcaagtgtaacattaagttgtaaaacagcagatgaagatgtatttgatgcagcatatatgagatgggtaagacaagcaccaggacaaacatttgaatggttaggatggatgaaaccagtaacaggagcagtaagttatgcaagaaaatttcaaggaagagtaagtttttatatgacaagagaattaggaatggcatatatggatttaagaaatttaagatttgatgatacagcagtatatttttgtgcaagaaaaacagcaggagatgtaagtggagataatagaggatatttttttgatttatggggaagaggaagtagagtaatagtaagtagt

SEQ ID NO: 49257 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaaccaggaggaggagtaaaaaaaccaggagcaagtgtaacattaagttgtaaaacagcagatgaagatgtatttgatgcagcatatatgcattgggtaagacaagcaccaggacaaacatttgaatggttaggatggatgaaaccagtaacaggagcagtaagttatgcaagaaaatttcaaggaagagtaagtttttatatgacaagagaattaggaatggcatatatggatttaagaaatttaagatttgatgatacagcagtatatttttgtgcaagaaaaacagcaggagatgtaagcggagataatagaggatatttttttgatttatggggaagaggaagtagagtaatagtaagtagt

SEQ ID NO: 49258 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggaggagaagtaaaaaaaccaggagcaagtgtaacattaagttgtaaaacagcagatgaagatgtatttgatgcagcatatatgcattgggtaagacaagcaccaggacaaacatttgaatggttaggatggatgaaaccagtaacaggagcagtaagttatgcaagaaaatttcaaggaagagtaagtttttatatgacaagagaattaggaatggcatatatggatttaagaaatttaagatttgatgatacagcagtatatttttgtgcaagaaaaacagcaggagatgtaagtggagataatagaggatatttttttgatttatggggaagaggaagtagggtaatagtaagtagt

SEQ ID NO: 49259 - RNA, 381 nt, synthetic construct
  misc_feature 1..381: note = derived and/or modified sequence opt6 from anti-HIV-1_HeavyChain
  source 1..381: mol_type = other RNA
caagtacaactagtacaatcaggagcagaagtaaaaaaaccaggagcatcagtaagagtatcatgccaagcatcaggatatatatttacaggatactttgtaaattggttaagacaactaccaggacaaagaccagaatggatgggatggataagaccaaaatcaggagcaagaaatcaagcaagacaattccaaccaagaatatcactaacaagagatagagcattatcaacagcatacttagactcaaactcactaacaagcgcagactcaggaacatacttttgcgcaagacaaacatttaaaccagacttttactttgcagatcaaggatggtcattcaatctatggggaagaggagcacactttatagtaagctca

SEQ ID NO: 49260 - RNA, 381 nt, synthetic construct
  misc_feature 1..381: note = derived and/or modified sequence opt6 from anti-HIV-1_HeavyChain
  source 1..381: mol_type = other RNA
ggatgtatatggacacaagcaggaggaggagtaaaaaaaccgggagcaagtgtaacattaagttgtaaaacagcagatgaagatgtatttgatgcagcatatatgcattgggtaagacaagcaccaggacaaacatttgaatggttaggatggatgaaaccagtaacaggagcagtaagttatgcaagaaaatttcaaggaagagtaagtttttatatgacaagagaattaggaatggcatatatggatttaagaaatttaagatttgatgatacagcagtatatttttgtgcaagaaaaacagcaggagatgtaagtggagataatagaggatatttttttgatttatggggaagaggaagtagagtaatagtaagtagt

SEQ ID NO: 49261 - RNA, 381 nt, synthetic construct
  misc_feature 1..381: note = derived and/or modified sequence opt6 from anti-HIV-1_HeavyChain
  source 1..381: mol_type = other RNA
agatgtatatggagacaagcaggaggaggaatgaaaaaaccaggagcaagtatgacagtaagttgtaaaacagcagatgaagatatatttgatgcagcatatatgcattgggtaagacaagcaccaggacaaacatttgaatggctaggatggatgaaaccagtaacaggagcagtaaattatgcaagacaatttcaaggaagagtaagtttttatagaacaagagaactaggaatagcatatatggatttaagagatttaaaatttgatgatacagcagtgtatttttgtgcaagaaaaacaaaaggagatgtaagtggagatgatagaggatttttttttgatttatggggaagaggaacaagagtaatagtaagtagt

SEQ ID NO: 49262 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggaggaggagtaaaaaaaccaggagcaagcgtaacattaagttgtaaaacagcagatgaagatgtatttgatgcagcatatatgcattgggtaagacaagcaccaggacaaacatttgaatgggtaggatggatgaaaccagtaacaggagcagtaagttatgcaagaaaatttcaaggaagagtaagtttttatatgacaagagaattaggaatggcgtatatggatctaagaaatttaagatttgatgatacagcagtatatttttgtgcaagaaaaacagcaggagatgtaagtggagataatagaggatatttttttgatttatggggaagaggaagcagagtaatagtaagtagt

SEQ ID NO: 49263 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggaggaggagtaaaagaaccaggagcaagtgtaacactaagttgtaaaacagcagatgaagatgtatttgatgcagcatatatgcattgggtaagacaagcaccaggacaaacatttgaatggttaggatggatgaaaccagtaacaggagcagtaaattatgcaagaaaatttcaaggaagagtaagtttttatagaacaagagaattaggaatagcatatatggatctaagaaatttaagatttgatgatacagcagtatatttttgtgcaagaaaaacagcaggagatgtaagtggagataaaagaggatttttttttgatttatggggaagaggaagtagagtaatagtaagtagt

SEQ ID NO: 49264 - RNA, 381 nt, synthetic construct
  misc_feature 1..381: note = derived and/or modified sequence opt6 from anti-HIV-1_HeavyChain
  source 1..381: mol_type = other RNA
caagcacatttagaacaaagtggaagtggagtaaaaaaaccaggagcaagtgtaagagtaagctgttggagtagtgaagatatatttaaaacagaattaatacattgggtaagacaagcaccagggcaaggattagaatggataggatgggtaaaaacagtaacaggagcagtaaattttggaagtttagattttagacatagaataagtttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtatcaagt

SEQ ID NO: 49265 - RNA, 384 nt, synthetic construct
  misc_feature 1..384: note = derived and/or modified sequence opt6 from anti-HIV-1_HeavyChain
  source 1..384: mol_type = other RNA
caagctcatttagaacaaagtggaagtggagtaaaaaaaccaggagcaagtgtaagagtaagttgttggagtagtgaagatatatttgaaagaacagaactaatacattgggtaagacaagcaccaggacaaggattagaatggataggatggatgaaaacagtaacaggagcagtaaattttggaagcttagattttagacatagaataagtttaacaagggatagagatctatttacagcacatatggatataagaggattagcacaaggagatacagcaacatatttttgtgcaagacaaaaatttgaaagtagatatacaggaggacaaggatggtattttgatttatggggaagaggaacacatatagtagtaagtagt

SEQ ID NO: 49266 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagtttagattttagacatagaataagtttaacaagagatagagatctatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagc

SEQ ID NO: 49267 - RNA, 384 nt, synthetic construct
  misc_feature 1..384: note = derived and/or modified sequence opt6 from anti-HIV-1_HeavyChain
  source 1..384: mol_type = other RNA
caaagtcatttagaacaaagtggaagtgcaatgaaaaaaccaggagcaagcgtaagagtaagttgttggacaagtgaagatatatttgatacaacagaattaatatattgggtaagacaagcaccaggacaaggattagaatggataggatgggtaaaaatagtaagtggaacagtaaattttgcaagtttagattttagaaatagaataagcttaagtagagatagagatttaagtacagcatatatggatataagaggactaacacaagatgatacagcaacatatttttgtgcaagacaaaaatttgcaagtagatatagtggagatcaagggagttattttgatttatggggaagaggaacattaatagtagtaagtagt

SEQ ID NO: 49268 - RNA, 384 nt, synthetic construct
  misc_feature 1..384: note = derived and/or modified sequence opt6 from anti-HIV-1_HeavyChain
  source 1..384: mol_type = other RNA
agtcatacatggaataatagaggaagtgcaatgaaaaaaccaggagcaagtgtaagagtaagttgttggacaagtgaagatatatttgatacaacagaattaatatattgggtaagacaagcaccaggacaaggattagaatggataggatgggtaaaaatagtaagtggaacagtaaattttgcaagtttagattttagaaatagaataagcttaagtagagatagggatttaagtacagcatatatggatataagaggattaacacaagatgatacagcaacatatttttgtgcaagacaaaaatttgcaagtagatatagtggagatcaaggaagttattttgatttatggggaagaggaacattaatagtagtaagtagt

SEQ ID NO: 49269 - RNA, 381 nt, synthetic construct
  misc_feature 1..381: note = derived and/or modified sequence opt6 from anti-HIV-1_HeavyChain
  source 1..381: mol_type = other RNA
caatcacacttagaacaaagcggaagcgcaatgaaaaaaccaggagcaagcgtaagagtaagctgttggacaagcgaagacatattccataacgaactaatatactgggtaagacaagcaccaggacaaggattagaatggataggatgggtaaaaatagtaagcggaacagtaaactttgcatcattagatttcagaaacagaatatcactatcaagagatagagatctatcaacagcatacatggacataagaggactaacacaagatgacacagcaacatacttttgcgcaagacaaaaatttgcatcaagatatagcggagaccaaggatcatactttgacttatggggaagaggaacattaatagtagtatcaagt

SEQ ID NO: 49270 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagcggagtaaaaaaaccaggagcaagtgtaagagtaagttgttggacaagtgaagatatatttgaaagaacagaattaatacattgggtaagacaagcaccaggacaaggattagaatggataggatggatgaaaacagtaacaggagcagtaaattttggaagtttagattttagacatagaataagtttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagt

SEQ ID NO: 49271 - RNA, 381 nt, synthetic construct
  misc_feature 1..381: note = derived and/or modified sequence opt6 from anti-HIV-1_HeavyChain
  source 1..381: mol_type = other RNA
caagtatttatggaacaagcaggaggagaagtaaaaaaaccaggagcaagtatgacagtaagttgtaaaacagcagatgaagatgtatttgatgcagcatatatgcattgggtaagacaagcaccaggacaaacatttgaatggctaggatggatgaaaccagtaacaggagcagtaaattatgcaagacaatttcaaggaagagtaagtttttatagaacaagagaactaggaatagcatatatggatttaagagatttaaaatttgatgatacagcagtatatttttgtgcaagaaaaacaaaaggagatgtaagtggagatgatagaggatttttttttgatttatggggaagaggaacaagagtaatagtaagtagc

SEQ ID NO: 49272 - RNA, 381 nt, synthetic construct
  misc_feature 1..381: note = derived and/or modified sequence opt6 from anti-HIV-1_HeavyChain
  source 1..381: mol_type = other RNA
caagcacacttagaacaaagcggaagcggagtaaaaaaattaggagcaagtgtaagagtaagctgttggacaagtgaagacatattcgaagacgaactaatacactgggtaagacaagcaccaggacaaggactagaatggataggatgggtaaaaatagtaagtggaacagtaaactttgcatcactagatttcagaaacagaatatcactatcaagagatagagatctatcaacagcatacatggacataagaggactaacacaagatgacacagcaacatacttttgcgcaagacaaaaatttgcatcgagatatagcggagaccaaggatcatactttgacttatggggaagaggaacattaatagtagtatcaagc

SEQ ID NO: 49273 - RNA, 381 nt, synthetic construct
  misc_feature 1..381: note = derived and/or modified sequence opt6 from anti-HIV-1_HeavyChain
  source 1..381: mol_type = other RNA
caatcacacttagaacaaagcggaagcgcaatgaaaaaaccaggcgcaagcgtaagagtaagctgttggacaagcgaagacatactaaaagcagaactaatatactgggtaagacaagcaccaggaagaggactagaatggataggatgggtaaaaacagtaagcggaacagtaaactttggatcaagcgatttcagaaacagaatatcactaacaagagatagagatctatcaacagcacacatggacataagaggactaacacaagatgacacagcaacatacttttgcgcaagacaaaaatttgaatcactatatagcgatgaccaaggatcatactttgacttatgggggagaggaacattaataatagtatcaagt

SEQ ID NO: 49274 - RNA, 381 nt, synthetic construct
  misc_feature 1..381: note = derived and/or modified sequence opt6 from anti-HIV-1_HeavyChain
  source 1..381: mol_type = other RNA
caagtacaactagtacaatcaggagcagaagtaaaaaaaccaggagcatcggtaaaagtatcatgcaaagcatcaggatatagctttacagattactatatacattggttaagacaagtacaaggacaaagaccagaatggatgggatggataagaccaagaacaggagcaagaaatcaagcaagacaattccaaccaagaatatcactaacaagagatagagcattatcaacagcatacttagacttaaactcactaacaagcgcagactcaggaacatacttttgcgcaagacaaacatttaaaccagacttttactttgcagatcaaggatggtcattcaatctatggggaagaggagcacactttatagtaagctca

SEQ ID NO: 49275 - RNA, 381 nt, synthetic construct
  misc_feature 1..381: note = derived and/or modified sequence opt6 from anti-HIV-1_HeavyChain
  source 1..381: mol_type = other RNA
caagtatttatggaacaagcaggaggagaagtaaaaaaaccaggagcaagtatgacagtaagttgtaaaacagcagatgaagatgtatttgatgcagcatatatgcattgggtaagacaagcaccaggacaaacatttgaatggttaggatggatgaaaccagtaacaggagcagtaaattatgcaagaaaatttcaaggaagagtaagtttttatagaacaagagaattaggaatagcatatatggatttaagagatttaaaatttgatgatacagcagtatatttttgtgcaagaaaaacaaaaggagatgtaagtggagatgatagaggatttttttttgatttatggggaagaggaacaagagtaatagtaagtagt

SEQ ID NO: 49276 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggagcaggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagtttagattttagacatagaataagtttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagc

SEQ ID NO: 49277 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggagcaggagtaaaaaaaccaggagcaagtgtaagagtaagttgttggagcagtgaagatatatttgaaagaacagaactaatacattgggtaagacaagcaccaggacaaggattagaatggataggatgggtaaaaacagtaacaggagcagtaaattttggaagtttagattttagacatagaataagtttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagc

SEQ ID NO: 49278 - RNA, 384 nt, synthetic construct
  misc_feature 1..384: note = derived and/or modified sequence opt6 from anti-HIV-1_HeavyChain
  source 1..384: mol_type = other RNA
caaagtcatttagaacaaagtggaagtgcaatgaaaaaaccaggagcaagtgtaagagtaagttgttgggcatcagaagatatatttgatacaacagaattaatatattgggtaagacaagcaccaggacaaggattagaatggataggatgggtaaaaatagtaagtggaacagtaaattttgcaagtttagattttagaaatagaataagcttaagtagagatagagatttaagtacagcatatatggatataagaggattaacacaagatgatacagcaacatatttttgtgcaagacaaaaatttgcaagcagatatagtggagatcaaggatcatattttgatttatggggaagaggaacattaatagtagtaagtagt

SEQ ID NO: 49279 - RNA, 381 nt, synthetic construct
  misc_feature 1..381: note = derived and/or modified sequence opt6 from anti-HIV-1_HeavyChain
  source 1..381: mol_type = other RNA
agatgtagattagtacaaagtggagcagaagtaaaaaaaccaggagcaagtgtaagagtaagttgtcaagcaagtggatatacattttcagcatatggagtaaattgggtaagacaagcaccaggacaagaactagaatggataggatgggtaaaaacagtaacaggggcagtaaattttggaagtccaaattttagacatagaataagtttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagt

SEQ ID NO: 49280 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagtgtaagagtaagctgttggagtagtgaagatatatttgaaagaacagaattaatacattgggtatgtcaagcaccaggacaaggactagaatggataggatgggtaaaaacagtaacaggagcagtaaattttggaagtttagattttagacatagaataagtttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagt

SEQ ID NO: 49281 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagcggaagtggagtaaaaaaaccaggagcaagtgtaagagtaagttgttggagtagtgaagatatatttgaaagaacagaactaatacattgggtaagacaagcaccaggacaaggattagaatggataggatgggtaaaaatagtaacaggagcagtaaattttggaagtttagattttagacatagaataagtttaacaagagatagagatttatttacagcacatatggatataagaggattaacacaaggagatacagcaacatatttttgtgcaagacaaaaatttgaaagtagatatacaggaggacaaggatggtattttgatctatggggaagaggaacacatatagtagtaagtagt

SEQ ID NO: 49282 - RNA, 384 nt, synthetic construct
  misc_feature 1..384: note = derived and/or modified sequence opt6 from anti-HIV-1_HeavyChain
  source 1..384: mol_type = other RNA
caagtacaattagtacaaagcggattagaagtaaaaaaaccaggagcaagtgtaagagtaagttgttggacaagtgaagatatatttgatacaacagaattaatatattgggtaagacaagcaccaggacaaggactagaatggataggatgggtaaaaatagtaagtggaacagtaaattttgcaagtttagattttagaaatagaataagtttaagtagagacagagatttaagcacagcacatatggatataagaggattaacacaagatgatacagcaacatatttttgtgcaagacaaaaatttgcaagcagatatagtggagatcaaggaagttattttgatttatggggaagaggaacattaataatagtaagtagt

SEQ ID NO: 49283 - RNA, 384 nt, synthetic construct
  misc_feature 1..384: note = derived and/or modified sequence opt6 from anti-HIV-1_HeavyChain
  source 1..384: mol_type = other RNA
caaagtcatttagaacaaagtggaagtgcaatgaaaaaaccaggagcaagtgtaagagtaagttgttggacaagtgaagatatatttgatacaacagaattaatatattgggtaagacaagcaccaggacaaggattagaatggataggatgggtaaaaatagtaagtggaacagtaaattttgcaagtttagattttagaaatagaataagtttaagtagagatagagatttaagtacagcacatatggatataagaggattaagacaagatgatacagcaacatatttttgtgcaagacaaaaatttgaatcaagatatagtggagatcaaggaagttattttgatttatggggaagaggaacattaataatagtaagtagt

SEQ ID NO: 49284 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagtgtaagagtaagctgttggacaagtgaagatatatttgaaaaaagtgaattaatacattgggtaagacaagcaccaggacaaggattagaatggataggatgggtaaaaacagtaacaggagcagtaaattttggaagtagtgattttagacaaagagtaagtttaacaagagatagagatttatttacagcacatatggatataagaggattaacacaaggagatacagcaacatatttttgtgcaagacaaaaatttgcaagtagatatagtggagatcaaggaagttattttgatttatggggaagaggaacattaatagtagtaagtagt

SEQ ID NO: 49285 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagtccaaattttagacatagagtaagtttaacgagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagt

SEQ ID NO: 49286 - RNA, 384 nt, synthetic construct
  misc_feature 1..384: note = derived and/or modified sequence opt6 from anti-HIV-1_HeavyChain
  source 1..384: mol_type = other RNA
agacatacatgggaacaaagtggaagcggagtaaaaaaaccaggagcaagtgtaagagtaagctgttggacaagtgaagatatatttgaaaaaagtgaattaatacattgggtaagacaagcaccaggacaaggattagaatggataggatgggtaaaaacagtgacaggagcagtaaattttggaagtagtgattttagacaaagagtaagtttaacaagagatagagatctaagtacagcatatatggatataagaggattaacacaagatgatacagcaacatatttttgtgcaagacaaaaatttgcaagtagatatagtggagatcaaggaagttattttgatttatggggaagaggaacattaatagtagtaagtagt

SEQ ID NO: 49287 - RNA, 384 nt, synthetic construct
  misc_feature 1..384: note = derived and/or modified sequence opt6 from anti-HIV-1_HeavyChain
  source 1..384: mol_type = other RNA
caaagtcatttagaacaaagtggaagtgcaatgaaaaaaccaggagcaagtgtaagagtaagttgttggacaagtgaagatatatttgatacaacagaattaatatattgggtaagacaagcaccaggacaaggattagaatggataggatgggtaaaaatagtaagtggaacagtaaattttgcaagtttagattttagaaatagaataagtttaagtagagatagagatttaagtacagcatatatggatataagaggattaacacaagatgatacagcaacatatttttgtgcaagacaaaaatttgaaagtagatatacaggaggacaaggatggtattttgatttatggggaagaggaacacatatagtagtaagtagt

SEQ ID NO: 49288 - RNA, 384 nt, synthetic construct
  misc_feature 1..384: note = derived and/or modified sequence opt6 from anti-HIV-1_HeavyChain
  source 1..384: mol_type = other RNA
caagtacaattagtacaaagtggagcagaagtaaaaaaaccaggagcaagtgtaagagtaagttgttggacaagtgaagatatatttgatacaacagaattaatatattgggtaagacaagcaccaggacaaggattagaatggataggatgggtaaaaatagtaagcggaacagtaaattttgcaagtttagattttagaaatagaataagtttaagtagagatagagatttaagtacagcacatatggatataagaggattaacacaagatgatacagcaacatatttttgtgcaagacaaaaatttgaaagtagatatacaggaggacaaggatggtattttgatttatggggaagaggaacacatatagtagtaagtagt

SEQ ID NO: 49289 - RNA, 384 nt, synthetic construct
  misc_feature 1..384: note = derived and/or modified sequence opt6 from anti-HIV-1_HeavyChain
  source 1..384: mol_type = other RNA
caaagtcatttagaacaaagtggaagtgcaatgaaaaaaccaggagcaagtgtaagagtaagttgttggacaagtgaagatatatttgatacaacagaattaatatattgggtaagacaagcaccaggacaaggattagaatggataggatgggtaaaaatagtaagtggaacagtaaattttgcaagtttagattttagaaatagaataagcttaagtagagatagagatttaagtacagcatatatggatataagaggattaacacaaggagatacagcaacatatttttgtgcaagacaaaaatttgaaagtagatatacaggaggacaaggatggtattttgatttatggggaagaggaacacatatagtagtaagtagt

SEQ ID NO: 49290 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagcggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaagtggagcagtaaattttggaagtccagattttagacatagaataagtttaagtagagatagagatttaagtacagcacatatggatataagaggattaacacaagatgatacagcaacatatttttgtgcaagacaaaaatttgcaagtagatatagtggagatcaaggaagttattttgatttatggggaagaggaacattaataatagtaagtagt

SEQ ID NO: 49291 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagcggagtaaaaaaaccaggagcaagtgtaagagtaagttgttggacaagtgaagatatatttgaaagaacagaattaatacattgggtaagacaagcaccaggaagaggattagaatggataggatgggtaaaaacagtaagtggaacagtaaattttggaagtagtgattttagaaatagagtaagtttaacaagagatagagatttaagtacagcacatatggatataagaggattaacacaagatgatacagcaacatatttttgtgcaagacaaaaatttgaaagtttatatagtgatgatcaaggaagttattttgatttatggggaagaggaacattaataatagtaagtagt

SEQ ID NO: 49292 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagtgtaagagtaagttgttggacaagtgaagatatatttgaaaggacagaattaatacattgggtaagacaagcaccaggacaagggttagaatggataggatgggtaaaaacagtaacaggagcagtaaattttggaagtccaaattttagaaatagaataagtttaacaagagatagagatttaagtacagcacatatggatataagaggattaacacaagatgatacagcaacatatttttgtgcaagacaaaaatttgaaagcttatatagcgatgatcaaggaagttattttgatttatggggaagaggaacattaataatagtaagtagt

SEQ ID NO: 49293 - RNA, 384 nt, synthetic construct
  misc_feature 1..384: note = derived and/or modified sequence opt6 from anti-HIV-1_HeavyChain
  source 1..384: mol_type = other RNA
caaagtcatttagaacaaagtggaagtgcaatgaaaagaccaggagcaagtgtaagagtaagttgttggacaagtgaagatatatttgatacaacagaattaatatattgggtaagacaagcaccaggacaaggattagaatggataggatgggtaaaaatagtaagtggaacagtaaattttgcaagtttagattttagaaatagaataagtttaagcagagatagagatttaagtacagcatatatggatataagaggattaacacaagatgatacagcaacatatttttgtgcaagacaaaaatttgcaagtagatattcaggagatcaaggaagttattttgatttatggggaagaggaacattaatagtagtaagtagc

SEQ ID NO: 49294 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaattaggagcaagtgtaagagtaagttgttggacgagtgaagatatatttgaaagaacagaattaatacattgggtaagacaagcaccaggacaaggattagaatggataggatgggtaaaagcagtaagtggagcagtaaattacggaagtctagattttagaaatagaataagtttaagtagagatagagatttaagtacagcatatatggatataagaggattaacacaagatgatacagcaacatatttttgtgcaagacaaaaatttgcaagtagatatagtggagatcaaggaagttattttgatttatggggaagaggaacattaatagtagtaagcagt

SEQ ID NO: 49295 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagtgtaagagtaagttgttggacaagcgaagatatatttgaaagaacagaattaatacattgggtaagacaagcaccaggacaaggattagaatggataggatgggtaaaaacagtaacaggagcagtaaattttggaagtctagattttagacatagaataagtttaacaagagatagagatttttttacagcacatatggatataagaggattaacacaaggagatacagcaacatatttttgtgcaagacaaaaatttgaaagtagatatacaggaggacaaggatggtattttgatttatggggaagaggaacacatatagtagtaagtagt

SEQ ID NO: 49296 - RNA, 381 nt, synthetic construct
  misc_feature 1..381: note = derived and/or modified sequence opt6 from anti-HIV-1_HeavyChain
  source 1..381: mol_type = other RNA
caagcacatttagaacaaagtggaagtggagtaaaaaaaccaggagcaagtgtaagagtaagttgttggtcaagtgaagacatattcagaacagaattaatacattgggtaagacaagcaccaggacaaggattagaatggataggatgggtaaaaacagtaacaggagcagtaaattttggatcattagattttagacatagaatatcattaacaagagatagagatttatttacagcacatatggatataagaggattaacacaaggagatacagcaacatatttttgtgcaagacaaaaatttgaatcacgatatacaggaggacaaggatggtattttgacttatggggaagaggaacacatatagtagtatcaagt

SEQ ID NO: 49297 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagcggaagcggagtaaaaaaaccaggagcaagtgtaagagtaagctgttggacaagtgaagacatattcgaaagaacagaattaatacattgggtaagacaagcaccaggacaaggactagaatggataggatgggtaaaaacagtaacaggagcagtaaatttcggaagcccaaactttagacatagagtaagtttaacaagagacagagacttatttacagcacatatggatataagaggattaacacaaggagatacagcaacatacttctgtgcaagacaaaaatttgaaagcttatactcagacgatcaaggaagttatttcgatttatggggaaggggaacattaataatagtaagctca

SEQ ID NO: 49298 - RNA, 384 nt, synthetic construct
  misc_feature 1..384: note = derived and/or modified sequence opt6 from anti-HIV-1_HeavyChain
  source 1..384: mol_type = other RNA
caaagccatctagaacaatcaggatcagcaatgaaaaaaccaggagcatcagtaagagtatcatgctggacatcagaagatatatttgacacaacagaactaatatactgggtaagacaagcacccggacaaggactagaatggataggatgggtaaaaatagtaagcggaacagtaaactttgcctcactagatttcagaaacagaatatcactatcaagagatagagatctatcaacagcacacatggacataagaggactaacacaagatgacacagcaacatacttttgcgcaagacaaaaatttgcatcaagatatagcggagaccaaggatcatactttgacttatggggaagaggaacattaataatagtatcaagc

SEQ ID NO: 49299 - RNA, 384 nt, synthetic construct
  misc_feature 1..384: note = derived and/or modified sequence opt6 from anti-HIV-1_HeavyChain
  source 1..384: mol_type = other RNA
caaagccatctagaacaatcaggatcggcaatgaaaaaaccaggagcatcagtaagagtatcatgctggacatcagaagatatatttgacacaacagaactaatatactgggtaagacaagcaccaggacaaggattagaatggataggatgggtaaaaatagtaagcggaacagtaaactttgcatcaagcgatttcagaaacagaatatcactatcaagagatagagatctatcaacagcacacatggacataagaggactaacacaagatgacacagcaacatatttttgcgcaagacaaaaatttgcatcaagatatagcggagaccaaggatcatactttgacttatggggaagaggaacattaatagtagtatcaagc

SEQ ID NO: 49300 - RNA, 384 nt, synthetic construct
  misc_feature 1..384: note = derived and/or modified sequence opt6 from anti-HIV-1_HeavyChain
  source 1..384: mol_type = other RNA
caagcacatctagaacaatcgggatcaggagtaaaaaaaccaggagcatcagtaagagtatcatgctggacatcagaagatatatttgaaagaacagaactaatatactgggtaagacaagcaccaggaagaggactagaatggataggatgggtaaaaacagtaagcggaacagtaaactttggatcaagtgatttcagaaacaggatatcactaacaagagatagagatctatcaacagcacacatggacataagaggattaacacaagatgacacagcaacatacttttgcgcaagacaaaaatttgaatcactatatagtgatgaccaaggatcatactttgacttatggggaagaggaacattaataatagtatcaagc

SEQ ID NO: 49301 - RNA, 384 nt, synthetic construct
  misc_feature 1..384: note = derived and/or modified sequence opt6 from anti-HIV-1_HeavyChain
  source 1..384: mol_type = other RNA
caaagtcatttagaacaaagtggaagtgcaatgaaaaaaccaggagcaagtgtaagagtaagttgttggacaagtgaagatatatttgatacaacagaattaatacattgggtaagacaagcaccaggacaaggattagaatggataggatgggtaaaaacagtaacaggagcagtaaattttggaagtttagattttagacatagaataagtttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagt

SEQ ID NO: 49302 - RNA, 384 nt, synthetic construct
  misc_feature 1..384: note = derived and/or modified sequence opt6 from anti-HIV-1_HeavyChain
  source 1..384: mol_type = other RNA
caaagccatctagaacaatcaggatcagcaatgaaaaaaccaggagcatcagtaagagtatcatgctggacatcagaagatatatttggaacaaccgaactaatatactgggtaagacaagcaccaggacaaggactagaatggataggatgggtaaaaatagtaagcggaacagtaaactttgcatcattagatttcagaaacagaatatcactatcaagagatagagatctatcaacagcatacatggacataagaggactaacacaagatgacacagcaacatacttttgcgcaagacaaaaatttgcatcaagatatagcggagaccaaggatcatactttgacttatggggaagaggaacattaatagtagtatcgagt

SEQ ID NO: 49303 - RNA, 384 nt, synthetic construct
  misc_feature 1..384: note = derived and/or modified sequence opt6 from anti-HIV-1_HeavyChain
  source 1..384: mol_type = other RNA
caagtacaattagtacaaagtggaagtgcaatgaaaaaaccaggagcaagtgtaagagtaagttgttggacaagtgaagatatatttgatacaacagaattaatatattgggtaagacaagcaccaggacaaggattagaatggataggatgggtaaaaatagtaagtggaacagtaaattttgcaagtttagattttagaaatagaataagtttaagtagagatagagatttaagtacagcatatatggatataagaggattaacacaagatgatacagcaacatatttttgtgcaagacaaaaatttgcaagtagatatagtggagatcaaggaagttattttgatttatggggaagaggaacattaatagtagtaagttca

SEQ ID NO: 49304 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagtgtaagagtaagttgttggacaagtgaaggaatatttgaaagaacagaattaatacattgggtaagacaagcaccaggacaaggattagaatggataggatgggtaaaaacagtaacaggagcagtaaattttgggagtttagattttagacatagaataagtttaacaagagatagagatttatttacagcacatatggatataagaggattaacacaaggagatacggcgacatatttttgtgcaagacaaaaatttgaaagtagatatacaggaggacaaggatggtattttgatttatggggaagaggaacacatatagtagtaagtagt

SEQ ID NO: 49305 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagcgtaagagtaagttgttggacaagcgaagatatatttgaaagaacagaattaatacattgggcaagacaagcaccaggacaaggattagaatggataggatgggtaaaaacagtaacaggagcagtaaattttggaagtccaaattttagacatagagcaagtttaacaagagacagagatttatttacagcacatatggatataagaggattaacagaaggagatacagcgacatatttttgtgcaagacaaaaatttgcaagtagatatagtggagatcaaggaagctattttgatttatggggaagaggaacattaataatagtaagtagt

SEQ ID NO: 49306 - RNA, 384 nt, synthetic construct
  misc_feature 1..384: note = derived and/or modified sequence opt6 from anti-HIV-1_HeavyChain
  source 1..384: mol_type = other RNA
caaagtcatttagaacaaagtggaagtgcaatgaaaaaaccaggagcgagtgtaagagtaagttgttggacaagcgaagatatatttgatacagcagaattaatatattgggtaagacaagcaccaggacaaggattagaatggataggatgggtaaaaatagtaagtggaacagtaaattttgcaagtttagattttagaaatagaataagtttaagtagagacagagatttaagtacagcacatatggatataagaggattaagacaagatgatacagcaacatatttttgtgcaagacaaaaatttgaaagtagatatagtggagatcaaggaagttattttgatttatggggaagaggaacattaataatagtaagtagc

SEQ ID NO: 49307 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaattaggagcaagtgtaagagtaagttgttggacaagtgaagatatatttgaaagaacagaattaatacattgggtaagacaagcaccaggacaaggattagaatggatagaatgggtaaaagcagtaagtggagcagtaaattatggaagtttagattttagacatagagtaagtttaacaagagatagagatttatttacagcacatatggatataagaggattaacacaagatgatacagcaacatatttttgtgcaagacaaaaatttgaaagtagatatacaggaggacaaggatggtattttgatttatggggaagaggaacacatatagtagtaagtagt

SEQ ID NO: 49308 - RNA, 384 nt, synthetic construct
  misc_feature 1..384: note = derived and/or modified sequence opt6 from anti-HIV-1_HeavyChain
  source 1..384: mol_type = other RNA
caaagtcatttagaacaaagcggaagtgcaatgaaaaaaccaggagcaagtgtaagagtaagttgttggacaagtgaagatatatttgatacaacagaattaatatattgggtaagacaagcaccaggacaaggattagaatggataggatgggtaaaaatagtaagtggaacagtaaattttgcatcattagattttagaaatagaataagtttaagcagagatagagatttaagtacagcatatatggatataagaggattaacacaagatgatacagcaacatatttttgtgcaagacaaaaatttgcaagtagatatagtggagatcaaggaagttattttgatctatggggaagaggaacattagattgtgtaagctca

SEQ ID NO: 49309 - RNA, 384 nt, synthetic construct
  misc_feature 1..384: note = derived and/or modified sequence opt6 from anti-HIV-1_HeavyChain
  source 1..384: mol_type = other RNA
caatcacatctagaacaaagtggaagtgcaatgaaaaaaccaggagcaagtgtaagagtaagctgttggacaagtgaagacatatttgatacaacagaattaatatattgggtaagacaagcaccaggacaaggattagaatggataggatgggtaaaaatagtatcaggagcagtaaatttcgcaagcttagactttagaaatagaataagtttaagcagagacagagatttaagcacagcacatatggatataagaggattaacacaagatgatacagcaacatatttctgtgcaagacaaaaatttgcaagcagatattcaggagatcaaggaagttattttgatttatggggaagaggaacattaataatagtaagttca

SEQ ID NO: 49310 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagcggaagtggagtaaaaaaattaggagcaagtgtaagagtaagttgttggacaagcgaagatatatttgaaagaacagaattaatacattgggtaagacaagcaccaggacaaggactagaatggataggatgggtaaaagcagtaagtggagcagtaaattatggaagtttagattttagacatagagtaagtttaacaagagatagagatttaagtacagcacatatggatataagaggattaacacaaggagatacagcaacatatttttgtgcaagacaaaaatttgaaagcagatatacaggaggacaaggatggtattttgatttatggggaagaggaacacatatagtagtaagtagt

SEQ ID NO: 49311 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagtgtaagagtaagttgttggacaagtgaagatatatttgaaaaaagtgaattaatacattgggtaagacaagcaccaggacaaggattagaatggataggatgggtaaaaacagtaacaggagcagtaaattttggaagtagtgattttagacaaagagtaagtttaacaagagatagagatttaagtacagcacatatggatataagaggattaacacaagatgatacagcaacatatttttgtgcaagacaaaaatttgaaagtttatatagtgatgatcaaggaagttattttgatttatggggaagaggaacattaataatagtaagcagt

SEQ ID NO: 49312 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggaacagtaaattttggaagtctaaattttagacatagaataagtttaacaagagatagagatttatttacagcacatatggatataagaggattaacacaaggagatacagcaacatatttttgtgcaagacaaaaatttgaaagcagatatacaggaggacaaggatggtattttgatttatggggaagaggaacacatatagtagtaagtagt

SEQ ID NO: 49313 - RNA, 384 nt, synthetic construct
  misc_feature 1..384: note = derived and/or modified sequence opt6 from anti-HIV-1_HeavyChain
  source 1..384: mol_type = other RNA
caaagtcatttagaacaaagtggaagtgcaatgaaaaaaccaggagcaagtgtaagagtaagttgttggacaagtgaagatatatttgaaagaacagaattaatatattgggtaagacaagcaccaggaagaggattagaatggataggatgggtaaaaatagtaagtggaacagtaaattttgcaagtttagattttagaaatagaataagtttaagtagagatagagatttaagtacagcacatatggatataagaggattaacacaagacgatacagcaacatatttttgtgcaagacaaaaatttgcaagtagatatagtggagatcaaggaagctattttgatttatggggaagaggaacattaataatagtaagcagt

SEQ ID NO: 49314 - RNA, 384 nt, synthetic construct
  misc_feature 1..384: note = derived and/or modified sequence opt6 from anti-HIV-1_HeavyChain
  source 1..384: mol_type = other RNA
caaagtcatttagaacaaagtggaagtgcaatgaaaaaaccaggagcaagtgtaagagtaagttgttggacaagtgaagatatatttgatacaacagaactaatatattgggtaagacaagcaccaggacaaggattagaatggataggatgggtaaaaatagtaagtggaacagtaaattttgcaagcttagattttagaaatagaataagtttaagtagagatagagatttaagtacagcatacatggatataagaggattaacacaagatgatacagcaacatatttttgtgcaagacaaaaatttgcaagtagatatagtggagatcaaggaagttattttgatttatggggaagaggaacattaataatagtaagtagc

SEQ ID NO: 49315 - RNA, 384 nt, synthetic construct
  misc_feature 1..384: note = derived and/or modified sequence opt6 from anti-HIV-1_HeavyChain
  source 1..384: mol_type = other RNA
caagcaagattagaacaaagtggaagtggagtaaaaaaattaggagcaagtgtaagagtaagttgttggacaagtgaagatatatttgaaagaacagaattaatacattgggtaagacaagcaccgggacaaggattagaatggataggatgggtaaaagcagtaagtggagcagtaaattatggaagtttagattttagaaatagaataagtttaagtagagatagagatttaagtacagcatatatggatataagaggattaacacaagatgatacagcaacatatttttgtgcaagacaaaaatttgcaagtagatatagtggagatcaaggaagttattttgatttatggggaagaggaacattaatagtagtaagtagt

SEQ ID NO: 49316 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtgcaatgaaaaaaccaggagcaagcgtaagagtaagttgttggacaagtgaagacatatttgatacaacagaattaatatattgggtgagacaagcaccaggacaaggattagaatggataggatgggtaaaaatagtatcaggaacagtaaatttcgcaagcttagactttagaaatagaataagtttaagtagagacagagatttaagtacagcacatatggatataagaggattaacacaagatgatacagcaacatatttctgtgcaagacaaaaatttgcaagtagatattcaggagatcaaggaagttattttgatttatggggaagaggaacattaataatagtaagttca

SEQ ID NO: 49317 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagtgtaagagtaagttgttggagtagtgaagatatatttgaaagaacagaattaatacattgggtaagacaagcaccaggacaaggattagaatggataggatgggtaaaaacagtaacaggagcagtaaattttggaagcttagattttagacatagaataagtttaacaagggatagagatttaagtacagcatatatggatataagaggattaacacaagatgatacagcaacatatttttgtgcaagacaaaaatttgcaagtagatatagtggagatcaaggaagttattttgatttatggggaagaggaacattaatagtagtaagtagt

SEQ ID NO: 49318 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagtgtaagagtaagttgttggagtagtgaagatatatttgaaagaacagaattaatacattgggtaagacaagcaccaggacaaggattagaatggataggatgggtaaaaacagtaacaggagcagcaaattttggaagtttagattttagacatagaataagtttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagt

SEQ ID NO: 49319 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagtgtaagagtaagttgttggacaagtgaagatatatttgaaagaagtgaattaatacattgggtaagacaagcaccaggacaaggattagaatggataggatgggtaaaaacagtaacaggagcagtaaattttggaagtttagattttaggcatagaataagtttaacaagagatagagatttatttacagcacatatggatataagaggattaacacaaggagatacagcaacatatttttgtgcaagacaaaaatttgaaagtagatatacaggaggacaaggatggtattttgatttatggggaagagggacacatatagtagtaagtagc

SEQ ID NO: 49320 - RNA, 381 nt, synthetic construct
  misc_feature 1..381: note = derived and/or modified sequence opt6 from anti-HIV-1_HeavyChain
  source 1..381: mol_type = other RNA
agatgtatatggagacaagcaggaggaggagtgaaaaaaccaggagcaagtgtaacattaagttgtaaaacagcagatgaagatgtatttgatgcagcatatatgcattgggtaagacaagcaccaggacaaacatttgaatggttaggatggatgaaaccagtaacaggagcagtaagttatgcaagaaaatttcaaggaagagtaagtttttatatgacaagaggaataagaatggcatatatggatttaagaaatttaagatttgatgatacagcagtatatttttgtgcaagaaaaacagcaggagatgtaagtggagataatagagggtatttttttgatttatggggaagaggaagtagagtaatagtaagtagt

SEQ ID NO: 49321 - RNA, 384 nt, synthetic construct
  misc_feature 1..384: note = derived and/or modified sequence opt6 from anti-HIV-1_HeavyChain
  source 1..384: mol_type = other RNA
caaagtcatttagaacaaagcggaagtgcaatgaaaaaaccaggagcaagtgtaagagtaagctgttggacaagtgaagatatatttgaaagaacagaattaatatattgggtaagacaagcaccaggaagaggattagaatggataggatgggtaaaaatagtaagtggaacagtaaattttgcaagtttagattttagaaatagaataagtttaagtagagatagagatttaagtacagcatatatggatataagaggattaacacaagatgatacagcaacatatttttgtgcaagacaaaaatttgcaagtagatatagtggagatcaaggaagttattttgatttatggggaagaggaacattaatagtagtaagtagt

SEQ ID NO: 49322 - RNA, 384 nt, synthetic construct
  misc_feature 1..384: note = derived and/or modified sequence opt6 from anti-HIV-1_HeavyChain
  source 1..384: mol_type = other RNA
caaagtcatttagaacaatcaggaagcgcaatgaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagtttagattttagacatagaataagtttaacaagagatagagatttatttacagcacatatggatataagaggactaacacaaggagatacagcaacatatttttgtgcaagacaaaaatttgaaagtagatatacaggaggacaaggatggtattttgatttatggggaagaggaacacatatagtagtaagtagt

SEQ ID NO: 49323 - RNA, 384 nt, synthetic construct
  misc_feature 1..384: note = derived and/or modified sequence opt6 from anti-HIV-1_HeavyChain
  source 1..384: mol_type = other RNA
caaagtcatttagaacaaagtggaagtgcaatgaaaaaaccaggagcaagtgtaagagtaagttgttggacaagtgaagatatatttgatacaacagaattaatatattgggtaagacaagcaccaggacaaggattagaatggataggatgggtaaaaatagtaagtggaacagtaaattttgcaagtttagattttagaaatagaataagtttaagtagagatagagatttaagtgcagcacatatggatataagaggattaacacaagatgatacagcaacatatttttgtgcaagacaaaaatttgcaagtagatatagtggagatcaaggaagttattttgatttatggggaagaggaacattaataatagtaagtagt

SEQ ID NO: 49324 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagcgtaagagtaagttgttggacaagcgaagatatatttgaaagaacagaattaatacattgggtaagacaagcaccaggacaaggattagaatggataggatgggtaaaaatagtgagtggagcagtaaattttggaagtccaaattttagacaaagagtaagtttaacaagagatagagatttatttacagcacatatggatataagaggattaacacaaggagatacagcaacatatttttgtgcaagacaaaaatttgcaagtagatatagtggagatcaaggaagttattttgatttatggggaagaggaacattaatagtagtaagtagt

SEQ ID NO: 49325 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagtgtaagagtaagttgttggagtagtgaagatatatttgaaagaacagaattaatacattgggtaagacaagcaccaggacaaggattagaatggataggatgggtaaaaacagtaacaggagcagtaaattttggaagtttagattttagacatagaataagtttaacaagagatagagatttatttacagcacatatggatataagaggactaacacaaggagatacagcaacatatttttgtacaagacaaaaatttgaaagtagatatacaggaggacaaggatggtattttgatttatggggaagaggaacacatatagtagtaagtagc

SEQ ID NO: 49326 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagtgtaagagtaagttgttggagtagtgaagatatatttgaaagaacagaattaatacattgggtaagacaagcaccaggacaaggaccagaatggataggatgggtaaaaacagtaacaggagcagtaaattttggaagtttagattttagacatagaataagcctaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagt

SEQ ID NO: 49327 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagtgtaagagtaagttgctggagtagtgaagatatatttgaaagaacagaattaatacattgggtaagacaagcaccaggacaaggattagaatggataggatgggtaaaaacagtaacaggagcagtaaattttggaccattagattttagacatagaataagtttaacaagagatagagatttatttacagcacatatggatataagaggattaacacaaggagatacagcaacatatttttgtgcaagacaaaaatttgaaagcagatatacaggaggacaaggatggtattttgatttatggggaagaggaacacatatagtagtaagtagt

SEQ ID NO: 49328 - RNA, 384 nt, synthetic construct
  misc_feature 1..384: note = derived and/or modified sequence opt6 from anti-HIV-1_HeavyChain
  source 1..384: mol_type = other RNA
caaagtcatttagaacaatcaggaccagcaatgaaaaaaccaggagcaagtgtaagagtaagttgttggacaagtgaagatatatttgaaagaacagaattaatatattgggtaagacaagcaccaggaagaggactagaatggataggatgggtaaaaacagtaagtggaacagtaaattttggaagcagtgattttagaaatagaataagtttaacaagagatagagatttaagtacagcacatatggatataagaggattaacacaagatgatacagcaacatatttttgtgcaagacaaaaatttgaaagcttatatagtgatgatcaaggaagttattttgatttatggggaagaggaacattaataatagtaagtagt

SEQ ID NO: 49329 - RNA, 384 nt, synthetic construct
  misc_feature 1..384: note = derived and/or modified sequence opt6 from anti-HIV-1_HeavyChain
  source 1..384: mol_type = other RNA
caaagccatctagaacaatcaggatcagcaatgaaaaaaccaggagcatcagtaagagtatcatgctggacatcagaagatatatttgacacaacagaactaatatactgggtaagacaagcaccaggacaaggactagaatggataggatgggtaaaaatagtaagtggaacagtaaattttgcatcactagatttcagaaacagaatatcactatcaagagatagaggactatcaacagcacatatggacataagaggactaacacaagatgacacagcaacatacttttgcgcaagacaaaaatttgcatcaagatatagcggagaccaaggatcatactttgacttatggggaagaggaacattaataatagtatcaagc

SEQ ID NO: 49330 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagcggaagcggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaagtggagcagtaaattttggaagtccaaattttagacatagagtaagtttaacaagagatagagatttatttacagcacatatggatataagaggattaacacaaggagatacagcaacatatttttgtgcaagacaaaaatttgcaagtagatatagtggagatcaaggaagttattttgatctatggggaagaggaacattaataatagtaagtagt

SEQ ID NO: 49331 - RNA, 384 nt, synthetic construct
  misc_feature 1..384: note = derived and/or modified sequence opt6 from anti-HIV-1_HeavyChain
  source 1..384: mol_type = other RNA
caaagtcatttagaacatagtggaagtgcaatgaaaaaaccaggagcaagtgtaagagtaagttgttggacatcagaagatatatttgatacaacagaattaatatattgggtaagacaagcaccaggacaaggattagaatggataggatgggtaaaaatagtaagtggaacagtaaattttgcaagtttagattttagaaatagaataagtttaagtagagatagagatttaagtacagcatatatggatataagaggattaacacaagatgatacagcaacatatttttgtgcaagacaaaaatttgcaagtagatatagtggagatcaaggaagttattttgatttatggggaagaggaacattaatagtagtaagtagt

SEQ ID NO: 49332 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagtgtaagagtaagttgttggacaagcgaagatatatttgaaagaacagaattaatacattgggtaagacaagcaccaggacaaggattagaatggataggatgggtaaaaatagtaagtggagcagtaaatttcggaagtccaaattttagacaaagagtaagtttaacaagagacagagatttatttacagcacatatggatataagaggattaacacaaggagatacagcaacatatttttgtgcaagacaaaaatttgaaagtttatatagtgatgatcaaggaagttattttgatttatggggaagaggaacattaataatagtaagtagt

SEQ ID NO: 49333 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagcggaagtggagtaaaaaaaccaggagcaagcgtaagagtaagttgttggacaagtgaagatatatttgaaagaacagaattaatacattgggtaagacaagcaccaggacaaggattagaatggataggatgggtaaaaacagtaagtggagcagtaaattttggaagtccaaattttagacatagaataagtttaacaagagatagagatctatttacagcacatatggatataagaggattaacacaaggagatacagcaacatatttttgtgcaagacaaaaatttgaaagtagatatacaggaggacaaggatggtattttgatttatggggaagaggaacacatatagtagtaagcagt

SEQ ID NO: 49334 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtgcaagtggagtaagaagaccaggagcaagtgtaagagtaagctgttggacaagtgaagatatatttgaaagaagtgaactaatatattgggtaagacaagcaccaggaagaggattagaatggataggatggataaaattagtaagcggagcagtaaattttggaagcgtagattttagaaatagaataagtttaagtagagatagagatttaagtacagcacatatggatataagaggattaagacaagatgatacagcaacatatttttgtgcaagacaaaaatttgaaagtagatatagtggagatcaaggaagttattttgatttatggggaagaggaacattaataatagtaagtagc

SEQ ID NO: 49335 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtgcaagcggagtaaaaagaccaggagcaagcgtaagagtaagttgttggacaagtgaagacatatttgaaagaacagaattaatatattgggtaagacaagcaccaggacaaggactagaatggataggatgggtaaaaacagtatcaggagcagtaaattttggaagtcaagactttagagatagatttagcctaacaagagacagagatttaagtacagcacatatggatataaggggactaacacaagatgatacagcaacatatttctgtgcaagacaaaaatttgcaagcagatattcaggagatcaaggaagttattttgatttatggggaagaggaacactaataatagtatcatca

SEQ ID NO: 49336 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagtgtaagagtaagctgttggacaagtgaagatatatttgaaaaaagtgaattaatacattgggtaagacaagcaccaggacaaggattagaatggataggatgggtaaaaacagtaacaggagcagtaaattttggaagtttagattttagacatagaataagtttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagt

SEQ ID NO: 49337 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagcggaagcggagtaaaaaaaccaggagcaagtgtaagagtaagctgttggacaagtgaagacatattcgaaagaacagaattaatacattgggtaagacaagcaccaggacaaggattagaatggataggatgggtaaaaacagtatcaggagcagtaaatttcggaagtccaaattttagacatagagtaagtttaacaagagacagagacttatttacggcacatatggatataagaggattaacacaagatgatacagcaacatatttctgtgcaagacaaaaatttgaaagcttatactcagatgatcaaggaagttattttgatttatggggaagaggaacattaataatagtaagttca

SEQ ID NO: 49338 - RNA, 384 nt, synthetic construct
  misc_feature 1..384: note = derived and/or modified sequence opt6 from anti-HIV-1_HeavyChain
  source 1..384: mol_type = other RNA
caaagtcatttaaaacaaagtggaagtgcaatgaaaaaaccaggagcaagtgtaagagtaagttgttggacaagtgaagatatatttgaaagaacagaattaatatattgggtaagacaagcaccaggaagaggactagaatggataggatgggtaaaaacagtaagtggaacggtaaattttggaagtagtgattttagaaatagaataagtttaacaagagatagagatttaagtacagcacatatggatataagaggattaacacaagatgatacagcaacatatttttgtgcaagacaaaaatttgaaagtttatatagtgatgatcaaggaagttattttgatttatggggaagaggaacattaataatagtaagtagt

SEQ ID NO: 49339 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagtgtaagagtaagttgttggagtagtgaagatatatttgaaagaacagaattaatacattgggtaagacaagcaccaggacaaggattagaatggataggatgggtaaaaacggtaacaggagcagtaaattttggaagtttagattttagacatagaataagtctaacaagagatagagatttaagtacagcacatatggatataagaggattaacacaagatgatacagcaacatatttttgtgcaagacaaaaatttgcaagtaggtatagtggagatcaaggaagttattttgatttatggggaagaggaacattaataatagtaagtagt

SEQ ID NO: 49340 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagcggagtaaaaaaattaggagcaagtgtaagagtaagctgttggacaagtgaagatatatttgaaagaacagaattaatacattgggtaagacaagcaccaggacaaggattagaatggataggatgggtaaaagcagtaagtggagcagtaaattatggaagcttagattttagacatagagtaagtttaacaagagatagagatctatttacagcacatatggatataagaggattaacacaagatgatacagcaacatatttttgtgcaagacaaaaatttgaaagtagatatacaggaggacaaggatggtattttgatttatggggaagaggaacacatatagtagtaagtagt

SEQ ID NO: 49341 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagtccaaattttagacatagagtaagtttaacaagagacagagatttatttacagcacatatggatataagaggattaacacaagatgacacagcaacatatttttgtgcaagacaaaaatttgaaagtctatatagtgatgatcaaggaagttattttgatttatggggaagaggaacattaataatagtaagtagt

SEQ ID NO: 49342 - RNA, 384 nt, synthetic construct
  misc_feature 1..384: note = derived and/or modified sequence opt6 from anti-HIV-1_HeavyChain
  source 1..384: mol_type = other RNA
caaagtcatttagaacaaagtggaagtgcaatgaaaaaaccaggagcaagtgtaagagtaagttgttggacaagtgaagatatattagaaagaacagaattaatatattgggtaagacaagcaccaggaagaggattagaatggataggatgggtaaaaacagtaagtggaacagtaaattttggaagtagtgattttagaaatagaataagtttaacaagagatagagatttaagtacagcacatatggatataagaggattaacacaagatgatacagcaacatatttttgtgcaagacaaaaatttgaaagcttatatagtgatgatcaaggaagttattttgatttatggggaagaggaacattaataatagtaagtagt

SEQ ID NO: 49343 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagtccaaattttagacaaagagtaagtttaacaagagatagagatttatttacagcacatatggatataaggggattaacacaaggagatacagcaacatatttttgtgcaagacaaaaatttgcaagcagatatagtggagatcaaggaagttattttgatttatggggaagaggaacactaatagtagtaagtagt

SEQ ID NO: 49344 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagcggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagcccaaattttagacatagaataagtttaacaagagatagagatttattcacagcacatatggatataagaggattaacacaaggagatacagcaacatatttttgtgcaagacaaaaatttgaaagtagatatacaggaggacaaggatggtattttgatttatggggaagaggaacacatatagtagtaagtagt

SEQ ID NO: 49345 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagtgtaagagtaagttgttggacaagtgatgatatatttgaaagaacagaattaatacattgggtaagacaagcaccaggacaaggattagaatggataggatgggtaaaaacagtaacaggagcagtaaattttggaagcccaaattttagacaaagagtaagcttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagcagt

SEQ ID NO: 49346 - RNA, 384 nt, synthetic construct
  misc_feature 1..384: note = derived and/or modified sequence opt6 from anti-HIV-1_HeavyChain
  source 1..384: mol_type = other RNA
caaagtcatttagaacaaagtggaagtgcaatgaaaaaaccaggagcaagtgtaagagtaagttgttggacaagtgaagatatatttgatacaacagaattaatatattgggtaagacaagcaccaggacaaggattagaatggataggatgggtaaaaatagtaagtggaacagtaaattttgcaagcttagattttagaaatagaataagtttaagtagagatagagatttaagtacagcacatatggatataagaggattaacacaagatgatacagcaacatatttttgtgcaagacaaaaatttgcaagtagatatagtggagatcaaggaagctattttgatttatggggaagaggaacattaatagtagtaagtagt

SEQ ID NO: 49347 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagtgtaagagtaagttgttggacaagtgaagacatatttgaaagaacagaattaatacattgggtaagacaagcaccaggacaaggattagaatggataggatgggtaaaaacagtaacaggagcagtaaattttggaagtccaaattttagaaatagaataagtttaagtagagacagagatttaagtacagcacatatggatataagaggattaacacaagatgatacagcaacatatttttgtgcaagacaaaaatttgcaagcagatatagtggagatcaaggaagttatttcgatttatggggaaggggaacattaataatagtaagtagt

SEQ ID NO: 49348 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtgcaagtggagtaaaaagaccaggagcaagtgtaagagtaagttgttggacaagtgaagatatatttgaaagaacagaattaatatattgggtaagacaagcaccaggacaaggattagaatggataggatgggtaaaaacagtaacaggagcagtaaattttggaagtttagattttagacatagaataagtttaacaagagatagagatttatttacagcacatatggatataagaggactaacacaaggagatacagcaacatatttttgtgcaagacaaaaatttgaaagtagatatacaggaggacaaggatggtattttgatttatggggaagaggaacacatatagtagtaagtagt

SEQ ID NO: 49349 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtgcaagtggagtaagaagaccaggagcaagtgtaagagtaagttgttggacaagtgaagatatatttgaaagaagtgaattaatatattgggtaagacaagcaccaggaagaggattagaatggataggatggataaaattagtaagtggagcagtaaattttggaagtgtagattttagagatagagtaagtctaacaagagatagagatttatttacagcacatatggatataagaggattaacacaagatgatacagcaacatatttttgtgcaagacaaaaatttgcaagcagatatagcggagatcaaggaagttattttgatttatggggaagaggaacattaataatagtaagtagt

SEQ ID NO: 49350 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaagtggaacagtaaattttgcaagtttagattttagaaatagaataagtttaagtagagatagagatttaagtacagcatatatggatataagaggattaacacaagatgatacagcaacatatttttgtgcaagacaaaaatttgcaagtagatacagtggagatcaaggaagttattttgatttatggggaagaggaacattaatagtagtaagtagc

SEQ ID NO: 49351 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaagtggagcagtaaattttggaagtccaaattttagacatagaataagcctaagtagagatagagatttaagtacagcatatatggatataagaggattaacacaagatgatacagcaacatatttttgtgcaagacaaaaatttgcaagtagatattcaggagatcaaggaagctattttgatttatggggaagaggaacattaatagtagtaagtagt

SEQ ID NO: 49352 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagcgtaagagtaagttgttggagtagtgaagatatatttgaaagaacagaattaatacattgggtaagacaagcaccaggacaaggattagaatggataggatgggtaaaaacagtaacaggagcagtaaattttggaagcttagattttagacatagaataagtccaacaagagatagagatttatttacagcacatatggatataagaggattaacacaaggagatacagcaacatatttttgtgcaagacaaaaatttgaaagtagatatacaggaggacaaggatggtattttgatttatggggaagaggaacattaatagtagtaagtagt

SEQ ID NO: 49353 - RNA, 384 nt, synthetic construct
  misc_feature 1..384: note = derived and/or modified sequence opt6 from anti-HIV-1_HeavyChain
  source 1..384: mol_type = other RNA
caaagtcatttagaacaatcaggatcagcaatgaaaaaaccaggagcatcagtaagagtaagttgctggacatcagaagatatatttgacacaacagaactaatatactgggtaagacaagcaccaggacaaggactagaatggataggatgggtaaaaatagtaagtggaacagtaaactttgcatcactagatttcagaaacagaatatcactatcaagagatagagatttaccaacagcatacatggacataagaggactaacacaagatgacacagcaacatacttttgcgcaagacaaaaatttgcatcaagatatagcggagaccaaggatcatactttgacttatggggaagaggaacattaatagtagtatcaagc

SEQ ID NO: 49354 - RNA, 384 nt, synthetic construct
  misc_feature 1..384: note = derived and/or modified sequence opt6 from anti-HIV-1_HeavyChain
  source 1..384: mol_type = other RNA
caaagtcatttagaacaaagtggaagtgcaatgaaaaaaccaggagcaagtgtaagagtaagttgttggacaagtgaagatatatttgatacaacagaattaatatattgggtaagacaagcaccaggacaaggattagaatggataggatgggtaaaaatagcaagtggaacagtaaattttgcaagtttagattttagaaatagaataagtctaagtagggatagagatttaagtacagcacatatggatataagaggattaacacaagatgatacagcaacatatttttgtgcaagacaaaaatttgcaagtagatatagcggagatcaaggaagttattttgatttatggggaagaggaacattaatagtagtaagtagt

SEQ ID NO: 49355 - RNA, 384 nt, synthetic construct
  misc_feature 1..384: note = derived and/or modified sequence opt6 from anti-HIV-1_HeavyChain
  source 1..384: mol_type = other RNA
caaagtcatttagaacaaagtggaagcgcaatgaaaaaaccaggagcaagcgtaagagtaagttgttggacaagtgaagatatatttgatacaacagaattaatatattgggtaagacaagcaccaggacaaggattagaatggataggatgggtaaaaacagtaacaggagcagtaaattttggaagcttagattttagacatagaataagtttaacaagagatagagatttatttacagcacatatggatataagaggattaacacaaggagatacagcaacatacttttgtgcaagacaaaaatttgaaagtagatatacaggaggacaaggatggtattttgatctatggggaagaggaacacatatagtagtaagtagt

SEQ ID NO: 49356 - RNA, 384 nt, synthetic construct
  misc_feature 1..384: note = derived and/or modified sequence opt6 from anti-HIV-1_HeavyChain
  source 1..384: mol_type = other RNA
caagtacaattagtacaaagtggagcagaagtaaaaaaaccaggagcaagtgtaagagtaagctgttggacaagtgaagatatatttgatacaacagaattaatatattgggtaagacaagcaccaggacaaggattagaatggataggatgggtaaaaatagtaagtggaacagtaaattttgcaagtttagattttagaaatagaataagtttaagtagagatagagatttaagtacagcacatatggatataagaggattaagacaagatgatacagcaacatatttttgtgcaagacaaaaatttgaaagtagatatagtggagatcaaggaagttattttgatttatggggaagaggaacattaataatagtaagcagt

SEQ ID NO: 49357 - RNA, 384 nt, synthetic construct
  misc_feature 1..384: note = derived and/or modified sequence opt6 from anti-HIV-1_HeavyChain
  source 1..384: mol_type = other RNA
caaagtcatctagaacaaagtggaagtgcaatgaaaaaaccaggagcaagcgtaagagtaagttgttggacaagcgaagatatatttgatacaacagaattaatatattgggtaagacaagcaccaggacaaggattagaatggataggatgggtaaaaatagtaagtggaacagtaaattttgcaagtttagattttagacatagaataagtttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagt

SEQ ID NO: 49358 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtgcaagcggagtaaaaagaccaggagcaagtgtaagagtaagttgttggacaagtgaagatatatttgaaagaagtgaattaatatattgggtaagacaagcaccaggacaaggattagaatggataggatgggtaaaaacagtaacaggagcagtaaattttggaagtctagattttagacatagaataagtttaacaagagatagagatttatttacagcacatatggatataagaggactaacacaaggagacacagcaacatatttttgtgcaagacaaaaatttgaaagtagatatacaggaggacaaggatggtattttgatttatggggaagaggaacacatatagtagtaagcagt

SEQ ID NO: 49359 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagtgtaagagtaagttgttggacaagcgaagatatatttgaaaaaagtgaattaatacattgggtaagacaagcaccaggacaaggattagaatggataggatgggtaaaaacagtaacaggagcagtaaattttggaagtagtgattttagacaaagagtaagtttaacaagagatagagatttatttacagcacatatggatataagaggattaacacaaggagatacagcaacatatttctgtgcaagacaaaaatttgaaagtttatatagtgatgatcaaggaagttattttgatttatggggaagaggaacactaataatagtaagtagt

SEQ ID NO: 49360 - RNA, 384 nt, synthetic construct
  misc_feature 1..384: note = derived and/or modified sequence opt6 from anti-HIV-1_HeavyChain
  source 1..384: mol_type = other RNA
caaagccatctagaacaatcaggatcagcaatgaaaaaaccaggagcatcagtaagagtaagttgctggacatcagaagatatatttgaaagaacagaactaatatactgggtaagacaagcaccaggaagaggactagaatggataggatgggtaaaaacagtaagcggaacagtaaactttggatcaagcgatttcagaaacagaatatcactaacaagagatagagatctttcaacagcacacatggacataagaggactaacacaagatgacacagcaacatacttttgcgcaagacaaaaatttgaatcactatatagcgatgaccaaggatcatactttgacttatggggaagaggaacattaatagtagtatcaagc

SEQ ID NO: 49361 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaattaggagcaagtgtaagagtaagttgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagtttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagt

SEQ ID NO: 49362 - RNA, 381 nt, synthetic construct
  misc_feature 1..381: note = derived and/or modified sequence opt6 from anti-HIV-1_HeavyChain
  source 1..381: mol_type = other RNA
caagcacatttagaacaaagtggaagcggagtaaaaaaaccaggagcaagcgtaagagtaagttgttggacaagtgaagacatattaagaaaatcagaattaatacattgggtaagacaagcaccaggacaaggattagaatggataggatgggtaaaaacagtaacaggagcagtaaatttcggacatcaaatatcagacagagtatcactaacaagagatagagatttatcaacagcacatatggacataagaggattaacacaagatgacacagcaacatatttttgcgcaagacaaaaatttgaatcattatatagtgatgatcaaggatcatattttgacttatggggaagaggaacattaataatagtatcaagt

SEQ ID NO: 49363 - RNA, 384 nt, synthetic construct
  misc_feature 1..384: note = derived and/or modified sequence opt6 from anti-HIV-1_HeavyChain
  source 1..384: mol_type = other RNA
ccagcacatttagaacaaagcggaagtggagtaaaaaaaccaggagcaagtgtaagagtaagttgttgggcaagtgaagatatatttgaaagaacagaattaatacattgggtaagacaagcaccaggacaaggattagaatggataggatgggtaaaaacagtaacaggagcagtaaattttggaagtttagattttagacatagaataagtttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagt

SEQ ID NO: 49364 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagcgcaagcggagtaaaaagaccaggagcaagtgtaagagtaagttgttggacaagtgaagatatatttgaaagaagtgaattaatatattgggtaagacaagcaccaggacaaggattagaatggataggatgggtaaaaacagtaagtggagcggtaaattttggaagtacagattttagagaaagaataagtttaagtagagatagagatttaagtacagcatatatggatataagaggattaacacaagatgatgcagcaacatatttttgtgcaagacaaaaatttgcaagcagatattcaggagatcaaggaagttattttgatttatggggaagaggaacactaatagtagtaagtagt

SEQ ID NO: 49365 - RNA, 384 nt, synthetic construct
  misc_feature 1..384: note = derived and/or modified sequence opt6 from anti-HIV-1_HeavyChain
  source 1..384: mol_type = other RNA
caagcacatctagaacaaagtggaagtggagtaaaaaaaccaggagcaagtgtaagagtaagttgttggagtagtgaagatatatttgaaagaacagaattaatacattgggtaagacaagcaccaggacaaggattagaatggataggatgggtaaaaacagtaacaggagcagtaaattttggaagtttagatttaagacatagaataagtttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagt

SEQ ID NO: 49366 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagtgtaagagtaagttgttggacaagtgaagatatatttgaaagaacagaactaatacattgggtaagacaagcaccaggacaaggattagaatggataggatgggtaaaaacagtaacaggagcagtaaattttggaagtttagattttagacatagaataagtttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacattaatagtagtaagtagt

SEQ ID NO: 49367 - RNA, 384 nt, synthetic construct
  misc_feature 1..384: note = derived and/or modified sequence opt6 from anti-HIV-1_HeavyChain
  source 1..384: mol_type = other RNA
agtcatgatctagaacaaagcggaagtgcaatgaaaaaaccaggagcaagtgtaagagtaagttgttggacaagcgaagatatatttgatacaacagaattaatatattgggtaagacaagcaccaggacaaggattagaatggataggatgggtaaaaatagtaagtggaacagtaaattttgcaagtttagattttagaaatagaataagtttaagcagagatagagatttaagtacagcatatatggatataagaggattaacacaagatgatacagcaacatatttttgtgcaagacaaaaatttgcaagtagatatagtggagatcaaggaagttattttgatttatggggaagaggaacattaatagtagtaagcagt

SEQ ID NO: 49368 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagcggaagtggagtaaaaaaattaggagcaagtgtaagagtaagttgttggacaagtgaagatatatttgaaagaacagaattaatacattgggtaagacaagcaccaggacaaggattagaatggataggatgggtaaaagcagtaacaggagcagtaaattttggaagtttagattttagacatagaataagtttaacaagagatagagatttatttacagcacatatggatataagaggattaacacaaggagatacagcaacatatttttgtgcaaggcaaaaatttgaaagtagatatacaggaggacaaggatggtattttgatttatggggaagaggaacacatatagtagtaagtagt

SEQ ID NO: 49369 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagcgtaagagtaagttgttggacaagtgaagatatatttgaaagaacagaattaatacattgggtaagacaagcaccaggacaaggattagaatggataggatgggtaaaaacagtaacaggagcagtaaattttggaagtccaaattttagacatagagtaagtttaacaagagatagagatttatttacagcacatatggatataagaggattaacacaaggagatacagcaacatatttttgtgcaagacaaaaatttgcaagtagatatagtggagatcaaggaagctattttgatttatggggaagaggaacattaatagtagtaagtagt

SEQ ID NO: 49370 - RNA, 384 nt, synthetic construct
  misc_feature 1..384: note = derived and/or modified sequence opt6 from anti-HIV-1_HeavyChain
  source 1..384: mol_type = other RNA
caaagtcatttagaacaaagtggaagtgcaatgaaaaaaccaggagcaagtgtaagagtaagttgttggacaagtgaagatatatttgatacaacagaattaatatattgggtaagacaagcaccaggacaaggattagaatggataggatgggtaaaaatagtaagtggaacagtaaattttgcaagtagtgattttagaaatagaataagtttaagtagagatagagatttaagtacagcacatatgggaataagaggactaagacaagatgatacagcaacatatttttgtgcaagacaaaaatttgaaagtagatatagtggagatcaaggaagttattttgatttatggggaagaggaacattaataatagtaagtagt

SEQ ID NO: 49371 - RNA, 384 nt, synthetic construct
  misc_feature 1..384: note = derived and/or modified sequence opt6 from anti-HIV-1_HeavyChain
  source 1..384: mol_type = other RNA
gaagtacaattagtacaaagtggagcagatgtaaaaaaaccaggagcaagtgtaagagtaagttgttggacaagtgaagatatatttgatacaacagaattaatatattgggtaagacaagcaccaggacaaggattagaatggataggatgggtaaaaatagtaagtggaacagtaaattttgcaagtttagattttagaaatagaataagtttaagtagagatagagatttaagtacagcatatatggatataagaggactaacacaagatgatacagcaacatatttttgtgcaagacaaaaatttgcaagtagatatagcggagatcaaggaagttattttgatttatggggaagaggaacattaatagtagtaagtagt

SEQ ID NO: 49372 - RNA, 384 nt, synthetic construct
  misc_feature 1..384: note = derived and/or modified sequence opt6 from anti-HIV-1_HeavyChain
  source 1..384: mol_type = other RNA
caagcacatctagaacaaagtggaagtggagtaaaaaaaccaggagcaagtgtaagagtaagttgttggagtagtgaagatatatttgaaagaacagaattaatacattgggtacatcaagcaccaggacaaggattagaatggataggatgggtaaaaacagtaacaggagcagtaaattttggaagtttagattttagacatagaataagtttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagt

SEQ ID NO: 49373 - RNA, 384 nt, synthetic construct
  misc_feature 1..384: note = derived and/or modified sequence opt6 from anti-HIV-1_HeavyChain
  source 1..384: mol_type = other RNA
caaagtcatctagaacaatcaggatcagcaatgaaaaaaccaggagcatcagtaagagtatcatgctggacatcagaagatatatttgacacaacagaactaatatactgggtaagacaagcaccaggacaaggactagaatggataggatgggtaaaaatagtaagcggaacagtaaactttgcatcactagatttcagaaacagaatatcactatcaagagatagagcactatcaacagcacacatggacataagaggactaacacaagatgacacagcaacatacttttgcgcaagacaaaaatttgcatcaagatatagcggagaccaaggatcatactttgacttatggggaagaggaacactaataatagtatcaagc

SEQ ID NO: 49374 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagtgtaagagtaagttgttggagtagtgaagatatatttgaaagaacagaattaatacattgggtaagacaagcaccaggacaaggattagaatggataggatgggtaaaaacagtaacaggagcagtaaattttgcaagtttagattttagaaatagaataagcttaagtagagatagagatttaagtacagcatatatggatataagaggattaacacaagatgatacagcaacatatttttgtgcaagacaaaaatttgcaagtagatatagtggagatcaaggaagttattttgatttatggggaagaggaacattaatagtagtaagtagt

SEQ ID NO: 49375 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtgcaagtggagtaagaagaccaggagcaagtgtaagagtaagttgttggacaagtgaagatatatttgaaagaagtgaattaatatattgggtaagacaagcaccaggaagaggattagaatggataggatggataaaattagtaagtggagcagtaaattttgcaagtttagattttagaaatagaataagtttaagcagagatagagatttaagtacagcatatatggatataagaggattaacacaagatgatacagcaacatatttttgtgcaagacaaaaatttgcaagtagatatagcggagatcaaggaagctattttgatttatggggaagaggaacattaatagtagtaagtagt

SEQ ID NO: 49376 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagtgtaagagtaagttgttggagtagtgaagatatatttgaaagaacagaattaatacattgggtaagacaagcaccaggacaaggattagaatggataggatgggtaaaaacagtaacaggagcagtaaattttggaagtttagattttagacatagaataagcttaacaagagatagagatttatttacagcacatatggatataagaggattaacacaagatgatacagcaacatatttttgtgcaagacaaaaatttgcaagtagatatagtggagatcaaggaagttattttgatttatggggaagaggaacattaataatagtaagtagt

SEQ ID NO: 49377 - RNA, 384 nt, synthetic construct
  misc_feature 1..384: note = derived and/or modified sequence opt6 from anti-HIV-1_HeavyChain
  source 1..384: mol_type = other RNA
caaagtcatttagaacaaagtggaagtgcaatgaaaaaaccaggggcaagtgtaagagtaagttgttggacaagtgaagatatatttgatacaacagaattaatatattgggtaagacaagcaccaggacaaggattaggatggataggatgggtaaaaatagtaagcggaacagtaaattttgcaagcttagattttagaagtagaataagtttaagtagagatagagatttaagtacagcatatatggatataagaggattaacacaagatgatacagcaacatatttttgtgcaagacaaaaatttgcatcaagatatagcggagatcaaggaagttattttgatttatggggaagaggaacattaatagtagtaagtagt

SEQ ID NO: 49378 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggcaaaaacagtaacaggagcagtaaattttggatcattagattttagacatagaataagtttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagt

SEQ ID NO: 49379 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtgcaatgaaaaaaccaggagcaagtgtaagagtaagttgttggacaagtgaagatatatttgaaagaacagaattaatatattgggtaagacaagcaccaggaagaggattagaatggataggatgggtaaaaacagtaagtggaacagtaaattttggaagtagtgattttagaaatagaataagtttaacaagagatagagatttaagtacagcacatatggatataagaggattaacacaagatgatacagcaacatatttttgtgcaagacaaaaatttgaaagtttatatagtgatgatcaaggaagttattttgatctatggggaagaggaacattaataatagtaagtagt

SEQ ID NO: 49380 - RNA, 384 nt, synthetic construct
  misc_feature 1..384: note = derived and/or modified sequence opt6 from anti-HIV-1_HeavyChain
  source 1..384: mol_type = other RNA
caaagtcatttagaacaatcaggaagtgcaatgaaaaaaccaggagcatcagtaagagtatcatgctggacatcagaagatatatttgacacaacagaattaatatactgggtaagacaagcaccaggacaaggattagaatggataggatgggtaaaaatagtaagcggaacagtaaattttggatcactagattttagacacagaatatcactaacaagagatagagatctatttacagcacatatggacataagaggattaacacaaggagacacagcaacatatttttgcgcaagacaaaaatttgaatcaagatatacagggggacaaggatggtattttgacttatggggaagaggaacacatatagtagtatcaagc

SEQ ID NO: 49381 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaattaggagcaagtgtaagagtaagttgttggacaagtgaagatatatttgatacaacagaattaatatattgggtaagacaagcaccaggacaaggattagaatggataggatgggtaaaaatagtaagcggaacagtaaattttgcaagtttagattttagaaatagaataagtttaagtagagatagagatttaagtacggcatatatggatataagaggattaacacaagatgatacagcaacatatttttgtgcaagacaaaaatttgcaagtagatatagtggagatcaaggaagttattttgatttatggggaagaggaacactaatagtagtaagtagc

SEQ ID NO: 49382 - RNA, 384 nt, synthetic construct
  misc_feature 1..384: note = derived and/or modified sequence opt6 from anti-HIV-1_HeavyChain
  source 1..384: mol_type = other RNA
agtcataatttagaacaaagtggaagtgcaatgaaaaaaccaggagcaagtgtaagagtaagctgttggacaagtgaagatatatttgatacaacagaattaatatattgggtaagacaagcaccaggacaaggattagaatggataggatgggtaaaaatagtaagtggaacagtaaattttgcaagtttagattttagaaatagaataagtttaagtagagatagagatttaagtacagcatatatggatataagaggattaacacaagatgatacagcaacatatttttgtgcaagacaaaaatttgcaagtagatatagtggagatcaaggaagttattttgatttatggggaagaggaacattaatagtagtaagcagt

SEQ ID NO: 49383 - RNA, 384 nt, synthetic construct
  misc_feature 1..384: note = derived and/or modified sequence opt6 from anti-HIV-1_HeavyChain
  source 1..384: mol_type = other RNA
agtcatacatggaataatagaggaagtgcaatgaaaaaaccaggagcaagtgtaagagtaagttgttggacaagcgaagatatatttgaaagaacagaattaatatattgggtaagacaagcaccaggaagaggattagaatggataggatgggtaaaaacagtaagtggaacagtaaattttggaagtagtgattttagaaatagaataagcttaagtagagatagagatttaagtacagcacatatggatataagaggattaacacaagatgatacagcaacatatttttgtgcaagacaaaaatttgcaagtagatatagtggagatcaaggaagttattttgatttatggggaagaggaacattaataatagtaagtagt

SEQ ID NO: 49384 - RNA, 384 nt, synthetic construct
  misc_feature 1..384: note = derived and/or modified sequence opt6 from anti-HIV-1_HeavyChain
  source 1..384: mol_type = other RNA
agtcatacatggaatgaaagtggaagtgcaatgaaaaaaccaggggcaagcgtaagagtgagttgttggacaagtgaagacatatttgaaagaacagaattaatatattgggtaagacaagcaccaggaagaggattagaatggataggatgggtaaaaatagtaagtggaacagtaaattttgcaagtttagattttagaaatagaataagtttaagtagagatagagatttaagtacagcatatatggatataagaggtttgacacaagatgatacagcaacatatttttgtgcaagacaaaaatttgcaagcagatatagtggagatcaaggaagttattttgatttatggggaagaggaacactaatagtagtaagtagt

SEQ ID NO: 49385 - RNA, 384 nt, synthetic construct
  misc_feature 1..384: note = derived and/or modified sequence opt6 from anti-HIV-1_HeavyChain
  source 1..384: mol_type = other RNA
agacatacatgggaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggggcagtaaattatggaagtttaaattttagaagtagaataagtttaacaagagatagagatttatttacagcacatatggatataagaggactaacacaaggagatacagcaacatatttttgtgcaagacaaaaatttgaaagtagatatacagggggacaaggatggtattttgatttatggggaagaggaacacatatagtagtaagtagt

SEQ ID NO: 49386 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagtgtaaaagtaagttgttggacaagtgaagatatatttgaaagaacagaactaatacattgggtaagacaagcaccaggacaaggattagaatggataggatgggtaaaaacagtaacaggagcagtaaattttggaagcttagattttagacatagaataagtttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagt

SEQ ID NO: 49387 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagtgtaagagtaagttgttggacaagtgaagatatatttgaaggaagtgaattaatacattgggtaagacaagcaccaggacaaggactagaatggataggatgggtaaaaacagtaacaggagcagtaaattttggaagcgcatattttagacatagagtaagtttaacaagagatagagatttaagtacagcatatatggatataagaggattaacacaagatgatacagcaacatatttttgtgcaagacaaaaatttgcaagcagatatagtggagatcaaggaagttattttgatttatggggaagaggaacattaatagtagtaagtagt

SEQ ID NO: 49388 - RNA, 384 nt, synthetic construct
  misc_feature 1..384: note = derived and/or modified sequence opt6 from anti-HIV-1_HeavyChain
  source 1..384: mol_type = other RNA
ggacatgatttagaacaaagtggaagtggagtaaaaaaaccaggagcaagtgtaagagtaagttgttggacaagtgaagatatatttgaaggatcagaattaatacattgggtaagacaagcaccaggacaaggattagaatggataggatgggtaaaaacagtaacaggagcagtaaattttggaagtgcatattttagacatagaataagtttaagtagagatagagatttaagtacagcatatatggatataagaggattaacacaagacgatacagcaacatatttttgtgcaagacaaaaatttgcaagtagatatagtggagatcaaggaagttattttgatttatggggaagaggaacattaatagtagtaagtagt

SEQ ID NO: 49389 - RNA, 384 nt, synthetic construct
  misc_feature 1..384: note = derived and/or modified sequence opt6 from anti-HIV-1_HeavyChain
  source 1..384: mol_type = other RNA
agtcatacatggaataatagaggaagtgcaatgaaaaaaccaggagcaagtgtaagagtaagctgttggacaagtgaagacatatttgatacaacagaattaatatattgggtaagacaagcaccaggacaaggattagaatggataggatgggtaaaaacagtatcaggaacagtaaatttcggaagtagtgactttagaaatagaataagtttaacaagagacagagatttaagtacagcacatatggatataagaggattaacacaagatgatacagcaacatatttctgtgcaagacaaaaatttgaaagtttatacagtgatgatcaaggaagttattttgatttatggggaagaggaacattaataatagtaagtagt

SEQ ID NO: 49390 - RNA, 384 nt, synthetic construct
  misc_feature 1..384: note = derived and/or modified sequence opt6 from anti-HIV-1_HeavyChain
  source 1..384: mol_type = other RNA
agacatacatgggaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaagtggagcagtaaattttggaagtccaaattttagacatagagtaagtttaacaagagatagagatttatttacagcacatatggatataagaggattaacacaaggagatacagcaacatatttttgtgcaagacaaaaatttgaaagtagatatacaggaggacaaggatggtactttgatttatggggaagaggaacacatatagtagtaagtagt

SEQ ID NO: 49391 - RNA, 384 nt, synthetic construct
  misc_feature 1..384: note = derived and/or modified sequence opt6 from anti-HIV-1_HeavyChain
  source 1..384: mol_type = other RNA
agtcatacatggaataatagaggaagtgcaatgaaaaaaccaggagcaagtgtaagagtaagctgttggacaagtgaagatatatttgaaagaacagaattaatatattgggtaagacaagcaccaggaagaggattagaatggataggatgggtaaaaacagtaagtggaacagtaaattttggaagtagtgattttagaaatagaataagtttaacaagagatagagatctaagtacagcacatatggatataagaggattaacacaagatgatacagcaacatatttttgtgcaagacaaaaatttgaaagtttatatagtgatgatcaaggaagttattttgatttatggggaagaggaacattaataatagtaagtagt

SEQ ID NO: 49392 - RNA, 384 nt, synthetic construct
  misc_feature 1..384: note = derived and/or modified sequence opt6 from anti-HIV-1_HeavyChain
  source 1..384: mol_type = other RNA
caaagtcatttagaacaaagtggaagtgcaatgaaaaaaccaggagcaagtgtaagagtaagttgtttagcaagtgaagatatatttgatacaacagaattaatatattgggtaagacaagcaccaggacaaggattagaatggataggatgggtaaaaatagtatcaggaacagtaaattttgcaagtttagattttagaaatagaataagtttaagtagagacagagatttaagtacagcatatatggatataagaggattaacacaagatgatacagcaacatatttttgtgcaagacaaaaatttgcaagtagatattcaggagatcaaggaagttattttgatttatggggaagaggaacattaatagtagtaagtagt

SEQ ID NO: 49393 - RNA, 384 nt, synthetic construct
  misc_feature 1..384: note = derived and/or modified sequence opt6 from anti-HIV-1_HeavyChain
  source 1..384: mol_type = other RNA
caaagtcatttagaacaaagtggggcagcaatgaaaaaaccaggagcaagtgtaagagtaagttgttggacaagcgaagatatatttgatacaacagaattaatatattgggtaagacaagcaccaggacaaggattagaatggataggatgggtaaaaatagtaagcggaacagtaaattttgcaagtctagattttagaaatagaataagtttaagtagagatagagatttaagtacagcacatatggatataagaggattaagacaagatgatacagcaacatatttctgtgcaagacaaaaatttgaaagcagatatagcggagatcaaggaagttattttgatttatggggaagaggaacattaataatagtaagtagt

SEQ ID NO: 49394 - RNA, 384 nt, synthetic construct
  misc_feature 1..384: note = derived and/or modified sequence opt6 from anti-HIV-1_HeavyChain
  source 1..384: mol_type = other RNA
agacatacatgggaacaaagtggaagtggagtaaaaaaaccaggagcaagtgtaagagtaagttgttggacaagtgaagatatatttgaaaaaagtgaattaatacattgggtaagacaagcaccaggacaaggattagaatggataggatgggtaaaaacagtaacaggagcagtaaattttggaagcagtgattttagacaaagagtaagtttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagt

SEQ ID NO: 49395 - RNA, 384 nt, synthetic construct
  misc_feature 1..384: note = derived and/or modified sequence opt6 from anti-HIV-1_HeavyChain
  source 1..384: mol_type = other RNA
agtcatacatggaatgaaagtggaagtgcgatgaaaaaaccaggagcaagtgtaagagtaagttgttggacaagtgaagatatatttgatacaacagaattaatatattgggtaagacaagcaccaggacaaggattagaatggataggatgggtaaaaatagtaagtggaacagtaaattttgcaagtttagattttagaaatagaataagtttaagtagagatagagatttaagtacagcatatatggatataagaggattaacacaagatgatacagcaacatatttttgtgcaagacaaaaatttgcaagtagatatagtggagatcaaggaagttattttgatttatggggaagaggaacattaatagtagtaagtagt

SEQ ID NO: 49396 - RNA, 384 nt, synthetic construct
  misc_feature 1..384: note = derived and/or modified sequence opt6 from anti-HIV-1_HeavyChain
  source 1..384: mol_type = other RNA
agacatacatggaatgaaagtggaagtggagtaaaaaaaccaggagcaagtgtaagggtaagttgttggagcagtgaagatatatttgaaagaacagaattaatacattgggtaagacaagcaccaggaagaggattagaatggataggatgggtaaaaacagtaagtggaacagtaaattttggaagtagtgattttagaaatagaataagtctaacaagagatagagatttaagtacagcacatatggatataagaggattaacacaagatgatacagcaacatatttttgtgcaagacaaaaatttgaaagtttatatagtgatgatcaaggaagttattttgatttatggggaagaggaacattaataatagtaagtagt

SEQ ID NO: 49397 - RNA, 384 nt, synthetic construct
  misc_feature 1..384: note = derived and/or modified sequence opt6 from anti-HIV-1_HeavyChain
  source 1..384: mol_type = other RNA
caaagtcatttagaacaaagtggaagtgaaatgaaaaaaccaggagcaagtgtaagagtaagttgttggacaagtgaagatatatttgatacaacagaattaatatattgggtaagacaagcaccaggacaaggattagaatggataggatgggtaaaaatagtaagtggaacagtaaattttgcaagtttagattttagaaatagaataagcttaagtagagatagagatttaagcacagcatatatggatataagaggattaacacaagatgatacagcaacatatttttgtgcaagacaaaaatttgcaagtagatatagtggagatcaaggaagctatttcgatttatggggaagaggaacattaatagtagtaagtagt

SEQ ID NO: 49398 - RNA, 384 nt, synthetic construct
  misc_feature 1..384: note = derived and/or modified sequence opt6 from anti-HIV-1_HeavyChain
  source 1..384: mol_type = other RNA
agacatacatgggaacaaagtggaagcggagtaaaaaaaccaggagcaagtgtaagagtaagctgttggacaagcgaagacatatttgaaagaacagaattaatacattgggtaagacaagcaccaggacaaggattagaatggataggatgggtaaaaacagtaacaggaacagtaaatttcggaagtttaaattttagacaaagagtaagtttaacaagagacagagatttatttacagcacatatggatataagaggattaacacaaggagatacagcaacatatttctgtgcaagacaaaaatttgaaagtttatacagtgatgatcaaggaagctattttgatttatggggaagaggaacattaataatagtaagtagt

SEQ ID NO: 49399 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagcggaagtggagtaaaaaaaccaggagcaagcgtaagagtaagttgttggacaagtgaagatatatttgaaagaagtgaattaatacattgggtaagacaagcaccaggacaaggattagaatggataggatgggtaaaaacagtaacaggagcagtaaattttggaagtcaaatatttagacatagaataagtttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagt

SEQ ID NO: 49400 - RNA, 384 nt, synthetic construct
  misc_feature 1..384: note = derived and/or modified sequence opt6 from anti-HIV-1_HeavyChain
  source 1..384: mol_type = other RNA
agccatacatggaataaaagtgggagtgcaatgaaaaaaccaggagcaagtgtaagagtaagttgttggacgagtgaagatatatttgaaagaacagaattaatatactgggtaagacaagcaccaggaagaggattagaatggataggatgggtaaaaacagtaagtggaacagtaaattttggaagtagtgattttagaaatagaataagtttaacaagagatagagatttaagtacagcacatatggatataagaggattaacacaagatgatacagcaacatatttttgtgcaagacaaaaatttgaaagtttatatagtgatgatcaaggaagttattttgatttatggggaagaggaacattaataatagtaagcagt

SEQ ID NO: 49401 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagtgtaagagtaagttgttggagtagtgaagatatatttgaaagaacagaattaatacattgggtaagacaagcaccaggacaaggattagaatggataggatgggtaaaaacagtaacaggagcagtaaattttggaagtcaaatatttagacatagaataagcctaacaagagatagagatttatttacagcacatatggatataagaggattaacacaaggagatacagcaacatatttttgtgcaagacaaaaatttgaaagtagatatacaggaggacaaggatggtattttgatctatggggaagaggaccaacattatttgtaagtagt

SEQ ID NO: 49402 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtgcaagtggagtaagaagaccaggagcaagtgtaagagtaagttgttggacaagtgaagatatatttgaaagaagtgaattaatatattgggtaagacaagcaccaggaagaggattagaatggataggatggataaaaacatgtagtggagcagtaaattttggaagtgtagattttagagatagagtaagtttaacaagagatagagatttatttacagcacatatggatataagaggattaacacaaggagatacagcaacatatttttgtgcaaggcaaaaatttgaaagtaggtatacaggaggacaaggatggtattttgatttatggggaagaggaacacatatagtagtaagtagt

SEQ ID NO: 49403 - RNA, 384 nt, synthetic construct
  misc_feature 1..384: note = derived and/or modified sequence opt6 from anti-HIV-1_HeavyChain
  source 1..384: mol_type = other RNA
agtcatacagtagaacaaagtggaagtgcaatgaaaaaaccaggagcaagtgtaagagtaagttgttggacaagtgaagacatatttgatacaacagaattaatatattgggtaagacaagcaccaggacaaggattagaatggataggatgggtaaaaatagtaagtggaacagtaaattttgcaagtttagattttagaaatagaataagtttaagtagagacagagatttaagtacagcatatatggatataagaggattaacacaagatgatacagcaacatatttttgtgcaagacaaaaatttgcaagtagatatagtggagatcaaggaagttattttgatttatggggaagaggaacattaatagtagtaagttca

SEQ ID NO: 49404 - RNA, 384 nt, synthetic construct
  misc_feature 1..384: note = derived and/or modified sequence opt6 from anti-HIV-1_HeavyChain
  source 1..384: mol_type = other RNA
agacatacatggaataaaagtggaagcggagtaaaaaaaccaggagcaagtgtaagagtatcatgttggagtagtgaagatatatttgaaagaacagaattaatacattgggtaagacaagcaccaggacaaggattagaatggataggatgggtaaaaacagtaacaggagcagtaaattttggaagtttagattttagacatagaataagtttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagt

SEQ ID NO: 49405 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagcggaagtggagtaaaaaaaccaggagcaagtgtaagagtaagttgttggacaagtgaagatatatttgaaagaacagaattaatacattgggtaagacaagcaccaggacaaagattagaatggataggatgggtaaaaacagtaacaggagcagtaaattttggaagtccaaattttagacatagagtaagtttaacaagagacagagatttaagtacagcatatatggatataagaggattaacacaagatgatacagcaacatatttttgtgcaagacaaaaatttgcaagtagatatagtggagatcaaggaagttattttgatttatggggaagaggaacattaatagtagtaagtagt

SEQ ID NO: 49406 - RNA, 384 nt, synthetic construct
  misc_feature 1..384: note = derived and/or modified sequence opt6 from anti-HIV-1_HeavyChain
  source 1..384: mol_type = other RNA
tcacatgatttagaacaatcaggatcagcaatgaaaaaaccaggagcatcagtaagagtatcatgctggacatcagaagatatatttgacacaacagaactaatatactgggtaagacaagcaccaggacaaggattagaatggataggatgggtaaaaatagtaagcggaacagtaaactttgcatcattagatttcagaaacagaataagtctatcaagagatagagatttatcaacagcacatatggacataagaggattaagacaagatgacacagcaacatatttttgcgcaagacaaaaatttgaatcaagatatagcggagaccaaggatcatattttgacctatggggaagaggaacattaataatagtatcaagt

SEQ ID NO: 49407 - RNA, 384 nt, synthetic construct
  misc_feature 1..384: note = derived and/or modified sequence opt6 from anti-HIV-1_HeavyChain
  source 1..384: mol_type = other RNA
agacatacatggaatgaaagtggaagtggagtaaaaaaaccaggagcaagcgtaagagtaagttgttggagtagtgaagatatatttgaaagaacagaattaatacattgggtaagacaagcaccaggacaaggattagaatggataggatgggtaaaaacagtaacaggagcagtaaattttggaagtttagattttagacatagaataagtttaacaagagatagagatttatttacagcacatatggatataagaggattaacacaaggagatacaacaacatatttttgtgcaagacaaaaatttgaaagtagatatacaggaggacaaggatggtattttgatttatggggaagaggaacacatatagtagtaagtagt

SEQ ID NO: 49408 - RNA, 384 nt, synthetic construct
  misc_feature 1..384: note = derived and/or modified sequence opt6 from anti-HIV-1_HeavyChain
  source 1..384: mol_type = other RNA
agacatacatgggaacaagtatggagtggagtaaaaaaaccaggagcaagtgtaagagtaagttgttggagtagtgaagatatatttgaaagaacagaattaatacattgggtaagacaagcaccaggacaaggattagaatggataggatgggtaaaaacagtaacaggagcagtaaattttggaagtttagattttagacatagaataagtttaacaagagatagagatttatttacagcacatatggatataagaggactaacacaaggagatacagcaacatatttttgtgcaagacaaaaatttgaaagtagatatacaggaggacaaggatggtattttgatttatggggaagaggaacacatatagtagtaagcagt

SEQ ID NO: 49409 - RNA, 384 nt, synthetic construct
  misc_feature 1..384: note = derived and/or modified sequence opt6 from anti-HIV-1_HeavyChain
  source 1..384: mol_type = other RNA
caaagccatctagaacaatcaggatcagcaatgaaaaaaccaggagcatcagtaacagtatcatgctggacatcagaagatatatttgacacaacagaactaatatactgggtaagacaagcaccaggacaaggactagaatggataggatgggtaaaaatagtaagcggaacagtaaactttgcatcattagatttcagaaacagaatatcactatcaagagatagagatctatcaacagcatacatggacataagaggactaacacaagatgacacagcaacatacttttgcgcaagacaaaaatttgcatcgagatatagcggagaccaaggatcatactttgacttatggggaagaggaacattaatagtagtatcaagc

SEQ ID NO: 49410 - RNA, 384 nt, synthetic construct
  misc_feature 1..384: note = derived and/or modified sequence opt6 from anti-HIV-1_HeavyChain
  source 1..384: mol_type = other RNA
agacatgatttagaacaaagtggaagtggagtaaaaaaaccaggagcaagtgtaagagtaagttgttggagtagtgaagatatatttgaaagaacagaattaatacattgggtaagacaagcaccaggacaaggactagaatggataggatgggtaaaaacagtaacaggagcagtaaattttggaagtttagattttagacatagaataagtttaacaagagatagagatttatttacagcacatatggatataagaggattaacacaaggagatacagcaacatatttttgtgcaagacaaaaatttgaaagcagatatacaggaggacaaggatggtattttgatttatggggaagaggaacacatatagtagtaagtagt

SEQ ID NO: 49411 - RNA, 384 nt, synthetic construct
  misc_feature 1..384: note = derived and/or modified sequence opt6 from anti-HIV-1_HeavyChain
  source 1..384: mol_type = other RNA
gtaacaacatggaataaatcaggatcagcaatgaaaaaaccaggagcatcagtaagagtatcatgctggacatcagaagatatatttgacacaacagaattaatatactgggtaagacaagcaccaggaagaggactagaatggataggatgggtaaaaacagtaagcggaacagtaaactttggaagtagcgatttcagaaacagaatatcactaacaagagatagagatctatcaacagcacacatggacataagaggactaacacaagatgacacagcaacatacttttgcgcaagacaaaaatttgaatcactatatagcgatgaccaaggatcatactttgacttatggggaagaggaacattaataatagtatcaagt

SEQ ID NO: 49412 - RNA, 384 nt, synthetic construct
  misc_feature 1..384: note = derived and/or modified sequence opt6 from anti-HIV-1_HeavyChain
  source 1..384: mol_type = other RNA
agacatacatggaataatacaggaagtggagtaaaaaaaccaggagcaagcgtaagagtaagctgtttagcaagtgaagatatatttgaaagaacagaattaatacattgggtaagacaagcaccaggacaaggattagaatggataggatgggtaaaaacagtaacaggagcagtaaattttggaagtttagattttagacatagaataagcttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagt

SEQ ID NO: 49413 - RNA, 384 nt, synthetic construct
  misc_feature 1..384: note = derived and/or modified sequence opt6 from anti-HIV-1_HeavyChain
  source 1..384: mol_type = other RNA
caaagtcatttagaacaaagtggaagtgcaatgaaaaaaccaggagcaagtgtaagagtaagttgtttagcaagtgaagatatatttgaaagaacagaattaatatattgggtaagacaagcaccaggaagaggaccagaatggataggatgggtaaaaacagtaagtggaacagtaaattttggaagtagtgattttagaaatagaataagtttaacaagagatagagatttaagtacagcacatatggatataagaggattaacacaagatgatacagcaacatatttttgtgcaagacaaaaatttgaaagtttatatagtgatgatcaaggaagttattttgatttatggggaagaggaacattaataatagtaagtagt

SEQ ID NO: 49414 - RNA, 384 nt, synthetic construct
  misc_feature 1..384: note = derived and/or modified sequence opt6 from anti-HIV-1_HeavyChain
  source 1..384: mol_type = other RNA
agacatacatggaataatacaggaagtggagtaaaaaaaccaggagcaagtgtaagagtaagttgttggacaagtgatgatatatttgaaagaacagaattaatacattgggtaagacaagcaccaggacaaggattagaatggataggatgggtaaaaacagtaagtggaacagtaaattttgcaagtttagattttagaaatagaataagtctaagtagagatagagatttaagtacagcatatatggatataagaggattaacacaagatgatacagcaacatatttttgtgcaagacaaaaatttgcaagtagatatagtggagatcaaggaagttattttgatttatggggaagaggaacattaatagtagtaagtagt

SEQ ID NO: 49415 - RNA, 384 nt, synthetic construct
  misc_feature 1..384: note = derived and/or modified sequence opt6 from anti-HIV-1_HeavyChain
  source 1..384: mol_type = other RNA
ggaacaccaggaaataaaagtggaagtggagtaaaaaaaccaggagcaagtgtaagagtaagttgttggagtagtgaagatatatttgaaagaacagaattaatacattgggtaagacaagcaccaggacaaggattagaatggataggatgggtaaaaacagtaacaggagcagtaaattttggaagtttagattttagacatagaataagtttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagttca

SEQ ID NO: 49416 - RNA, 384 nt, synthetic construct
  misc_feature 1..384: note = derived and/or modified sequence opt6 from anti-HIV-1_HeavyChain
  source 1..384: mol_type = other RNA
ggaacaccaggaagtgaaagtggaagtggagtaaaaagaccaggagcaagcgtaagagtaagctgttggacaagtgaagatatatttgaaacaacagaattaatacattgggtaagacaagcaccaggacaaggattagaatggataggatgggtaaaaacagtaagtggagcagtaaattttggaagtttaaattttagacatagagtaagtttaacaagagatagagatttatttacagcacatatggatataagaggattaacacaaggagatacagcaacatatttttgtgcaagacaaaaatttgaaagtaggtatacaggaggacaaggatggtattttgatttatggggaagaggaacacatatagtagtaagtagt

SEQ ID NO: 49417 - RNA, 384 nt, synthetic construct
  misc_feature 1..384: note = derived and/or modified sequence opt6 from anti-HIV-1_HeavyChain
  source 1..384: mol_type = other RNA
gtaacaccaggaacaaacttaggattaagaatgaaaaaaccaggagcatcagtaagagtatcatgctggacatcagaagatatatttgacacaacagaactaatatactgggtaagacaagcaccaggacaaggattagaatggataggatgggtaaaaatagtaagtggaacagtaaactttgcatcactagatttcagaaacagaatatcactatcaagagatagagatctatcaacagcatacatggacatacgaggactaacacaagatgacacagcaacatacttttgcgcaagacaaaaatttgcatcaagatatagcggagaccaaggatcatactttgacttatggggaagaggaacattaatagtagtatcaagc

SEQ ID NO: 49418 - RNA, 384 nt, synthetic construct
  misc_feature 1..384: note = derived and/or modified sequence opt6 from anti-HIV-1_HeavyChain
  source 1..384: mol_type = other RNA
agacatgatttagaacaaagtggagcaggagtaaaaaaaccaggagcaagtgtaagagtaagttgttggagtagtgaagatatatttgaaagaacagaattaatacattgggtaagacaagcaccaggacaaggattagaatggataggatgggtaaaaacagtaacaggagcagtaaattttggaagtttagattttagacatagaataagtttaacaagagatagagatttatttacagcacatatggatataagaggattaacacaaggagacacagcaacatacttttgtgcaagacaaaaatttgaaagtagatatacaggaggacaaggatggtattttgatctatggggaagaggaacacatatagtagtaagtagt

SEQ ID NO: 49419 - RNA, 384 nt, synthetic construct
  misc_feature 1..384: note = derived and/or modified sequence opt6 from anti-HIV-1_HeavyChain
  source 1..384: mol_type = other RNA
caagtacatttagaacaaagtggaagtggagtaaaaaaaccaggagcaagtgtaagagtaagttgttggacaagtgaagatatatttgaaaaaagtgaattaatacattgggtaagacaagcaccaggacaaggattagaatggataggatgggtaaaaacagtaacaggagcagtaaattttggaagtagtgattttagacaaagagtaagtctaacaccagatagagatttatttacagcacatatggatataagaggattaacacaaggagatacagcaacatatttttgtgcaagacaaaaatttgaaagtagatatacaggaggacaaggatggtattttgatctatggggaagaggaacacatatagtagtaagtagt

SEQ ID NO: 49420 - RNA, 384 nt, synthetic construct
  misc_feature 1..384: note = derived and/or modified sequence opt6 from anti-HIV-1_HeavyChain
  source 1..384: mol_type = other RNA
ggaacaacatgggaacaaagtggaagtggagtaaaaaaaccaggagcaagtgtaagagtaagttgttggacaagcgaagatatatttgaaaaaagtgaattaatacattgggtaagacaagcaccaggacaaggattagaatggataggatgggtaaaaacagtaacaggggcagtaaattttggaagtttagattttagacatagaatatcattaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagt

SEQ ID NO: 49421 - RNA, 384 nt, synthetic construct
  misc_feature 1..384: note = derived and/or modified sequence opt6 from anti-HIV-1_HeavyChain
  source 1..384: mol_type = other RNA
agtcatgatttagaacaaagtggaagtgaatggaaaaaaccaggagcaagtgtaagagtaagttgttggacaagtgaagatatatttgatacaacagaactaatacattgggtaagacaagcaccaggacaaggattagaatggataggatgggtaaaaacagtaacaggagcagtaaattttggaagtttagattttagacatagaataagtttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagt

SEQ ID NO: 49422 - RNA, 384 nt, synthetic construct
  misc_feature 1..384: note = derived and/or modified sequence opt6 from anti-HIV-1_HeavyChain
  source 1..384: mol_type = other RNA
caaagcagaccaggaaacaaaagcggaagcgcaatgaaaaaaccaggagcaagcgtaagagtaagctgttggacaagcgaagacatattcgaaagaacagaattactatgggtaagacaagcaccaggaagaggactagaatggataggatgggtaaaaacagtaagcggaacagtaaactttggatcaagcgatttcagaaacaggatatcactaacaagagatagagatctatcaacagcacacatggacataagaggactaacacaagatgacacagcaacatacttttgcgcaagacaaaaatttgaatcactatatagcgatgaccaaggatcatactttgacttgtggggaagaggaacattaataatagtatcgagc

SEQ ID NO: 49423 - RNA, 384 nt, synthetic construct
  misc_feature 1..384: note = derived and/or modified sequence opt6 from anti-HIV-1_HeavyChain
  source 1..384: mol_type = other RNA
ggaacaacatggagtaaaagtggaagtggagtaaaaaaaccaggagcaagtgtaagagtaagttgttggacaagtgaagatatatttgaaagaacagaattaatatattgggtaagacaagcaccaggacaaggattagaatggataggatgggtaaaaatagtaagtggaacagtaaattttgcaagtttagattttagaaatagaataagtttaagtagagatagagatttaagtacagcacatatggatataagaggattaacacaagatgatacagcaacatatttttgtgcaagacaaaaatttgcaagtagatatagtggagatcaagggagttattttgacttatggggaagaggaacattaataatagtaagtagt

SEQ ID NO: 49424 - RNA, 387 nt, synthetic construct
  misc_feature 1..387: note = derived and/or modified sequence opt6 from anti-HIV-1_HeavyChain
  source 1..387: mol_type = other RNA
caagcacacttagaacaaagcggaagcggagtaaaaaaaccaggagcaagtgtaagagtaagctgttggacaagtgaagacatactaagaaaaaaaagagtagactcagtaggatgcgatacagcaccaggacaaggactagaatggataggatgggtaaaaacagtaacaggagcagtaaactttggatcaagtgatttcagacaaagagtatcactaacaagagatagagatttatttacagcacacatggacataagaggactaacacaagatgacacagcaacatacttttgcgcaagacaaaaatttgcatcaagatatagcggagaccaaggatcatattttgacttatggggaagaggaacattaatagtagtatcaagc

SEQ ID NO: 49425 - RNA, 387 nt, synthetic construct
  misc_feature 1..387: note = derived and/or modified sequence opt6 from anti-HIV-1_HeavyChain
  source 1..387: mol_type = other RNA
aaagcacatttaggaaataaaagtggaagtggagtaaaaaaaccaggggcaagtgtaagagtaagttgttggagtagtgaagatatatttgaaagaacagaattaatacattgggtaagacaagcaccaggacaaggattagaatggataggatgggtaaaaacagtaacaggagcagtaaattttggaagtttagattttagacatagaataagtttaacaagagatagagatttatttacagcacacatggatataagaggattaacacaaggagatacagcaacatatttttgtgcaagacaaaaatttgaaagcagatatacaggaggacaaggatggtattttgatttatggggaagaggaacacatatagtagtaagtagt

SEQ ID NO: 49426 - RNA, 384 nt, synthetic construct
  misc_feature 1..384: note = derived and/or modified sequence opt6 from anti-HIV-1_HeavyChain
  source 1..384: mol_type = other RNA
acaacagtaggaacaatattaggaagagcaatgaaaaaaccaggagcaagtgtaagagtaagttgttggacaagtgaagatatatttgatacaacagaattaatatattgggtaagacaagcaccaggacaaggattagaatggataggatgggtaaaaatagtaagcggaacagtaaattttgcaagtttagattttagaaatagaataagtctaagtagagatagagatttaagtacagcatatatggatataagaggattaacacaagatgatacagcaacatatttttgtgcaagacaaaaatttgcaagtagatatagtggagatcaaggaagttattttgatttatggggaagaggaacattaatagtagtaagtagt

SEQ ID NO: 49427 - RNA, 384 nt, synthetic construct
  misc_feature 1..384: note = derived and/or modified sequence opt6 from anti-HIV-1_HeavyChain
  source 1..384: mol_type = other RNA
caaagccatctagaacaatcaggatcagcaatgaaaaaaccaggagcatcagtaaaagtatcatgctggacatcagaagatatatttgacacaacagaactaatatactgggtaagacaagcaccaggacaaggactagaatggataggatgggtaaaaatagtaagcggaacagtaaactttgcatcactagatttcagaaacagaatatcactatcaagagatagagatttatcgacagcatacatggacataagaggactaacacaagatgacacagcaacatacttttgcgcaagacaaaaatttgcatcaagatatagcggggaccaaggatcatactttgacttatggggaagaggaacattaatagtagtatcaagc

SEQ ID NO: 49428 - RNA, 387 nt, synthetic construct
  misc_feature 1..387: note = derived and/or modified sequence opt6 from anti-HIV-1_HeavyChain
  source 1..387: mol_type = other RNA
caaagccatctagaacaagtatgggtatgtcaaagtaaaaaaccaggagcaagcgtaagagtaagctgttggacaagtgaagacatatttgatacaacagaattaatatattgggtaagacaagccccaggacaaggattagaatggataggatgggtaaaaatagtaagtggaacagtaaatttcgcaagtttagactttagaaatagaataagtttaagtagagacagagacttaagcacagcacatatggatataagaggactaacacaagacgatacagcaacatatttctgtgcaagacaaaaattcgcaagcagatactcaggagatcaaggaagttatttcgatttatggggaagaggaacactaataatagtaagttca

SEQ ID NO: 49429 - RNA, 384 nt, synthetic construct
  misc_feature 1..384: note = derived and/or modified sequence opt6 from anti-HIV-1_HeavyChain
  source 1..384: mol_type = other RNA
agacatacagtagaacaaagcggaagtggagtaaaaaaaccaggagcaagtgtaagagtaagttgttggagtagtgaagatatatttgaaagaacagaattaatacattgggtaagacaagcaccaggacaaggattagaatggatgggatgggtaaaaacagtaacaggagcagtaaattttggaagtttagattttagacatagaataagtttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagt

SEQ ID NO: 49430 - RNA, 384 nt, synthetic construct
  misc_feature 1..384: note = derived and/or modified sequence opt6 from anti-HIV-1_HeavyChain
  source 1..384: mol_type = other RNA
caaagtcatttagaacaaagcggaagtgcaatgaaaaaaccaggagcaagtgtaagagtaagttgtagtgcaagagaagatatatttgatacaacagaattaatatattgggtaagacaagcaccaggacaaggattagaatggataggatgggtaaaaatagtatgtggaacagtaaattttgcaagtttagattttagaaatagaataagcttaagtagagacagagatttaagtacagcacatatggatataagaggattaacacaagatgatacagcaacatatttttgtgcaagacaaaaatttgcaagtagatatagtggagatcaaggaagttattttgatttatggggaagaggaacattaataatagtatcaagt

SEQ ID NO: 49431 - RNA, 387 nt, synthetic construct
  misc_feature 1..387: note = derived and/or modified sequence opt6 from anti-HIV-1_HeavyChain
  source 1..387: mol_type = other RNA
gaagtacaaagaggaggaagagtagtaggaagagatgtaaaaaaaccaggagcaagcgtaagagtaagttgttggacaagcgaagatatatttcatacagaattaatatattgggtaagacaagcaccaggacaaggattagaatggataggatgggtaaaaatagtaagtggaacagtaaattttgcaagtttagattttagaaatagaataagtttaagtagagatagagatttaagtacagcatatatggatataagaggattaacacaagatgatacagcaacatatttttgtgcaagacaaaaatttgcaagtagatatagtggagatcaaggaagttattttgatttatggggaagaggaacattaatagtagtaagtagt

SEQ ID NO: 49432 - RNA, 384 nt, synthetic construct
  misc_feature 1..384: note = derived and/or modified sequence opt6 from anti-HIV-1_HeavyChain
  source 1..384: mol_type = other RNA
ggaacaacatggaatgaaagtggaagtggagtaaaaaaaccaggagcaagtgtaagagtaccatgttggagtagtgaagatatatttgaaagaacagaattaatacatagagtaagacaagcaccaggacaaggattagaatggataggatgggtaaaaacagtaacaggagcagtaaattttggaagtccaaattttagacatagaataagtttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagt

SEQ ID NO: 49433 - RNA, 384 nt, synthetic construct
  misc_feature 1..384: note = derived and/or modified sequence opt6 from anti-HIV-1_HeavyChain
  source 1..384: mol_type = other RNA
agaagtaattgggtacaatcgggagcagacgtaaaaaaaccaggggcatcagtaaaaagttcatgctggacatcagaagatatatttgatacaacagaactaatatactgggtaagacaagcaccaggacaaggactagaatggataggatgggtaaaaatagtaagcggaacagtaaactttgcatcattagatttcagaaacagaatatcactatcaagagatagagatttatcaacagcatacatggacataagaggattaacacaagatgacacagcaacatacttttgcgcaagacaaaaatttgcatcaagatatagtggagaccaaggatcatattttgatttatggggaagaggaacattaatagtagtatcaagc

SEQ ID NO: 49434 - RNA, 384 nt, synthetic construct
  misc_feature 1..384: note = derived and/or modified sequence opt6 from anti-HIV-1_HeavyChain
  source 1..384: mol_type = other RNA
ccagtacaattagtacaaagtggagcagaagtaaaaaaaccaggagcatcagtaaaagtaagttgttggacaagtgaagatatatttgaaagaacagaattaatacattgggtaagacaagcaccaggacaaggattagaatggataggatgggtaaaaacagtaacaggagcagtaaattttggaagtttagattttagacatagaatatcattaacaagagatagagatttatttacagcacatatggatataagaggattaacacaaggagatacagcaacatatttttgtgcaagacaaaaatttgaatcaagatatacaggaggacaaggatggtattttgatttatggggaagaggaacacatatagtagtaagtagt

SEQ ID NO: 49435 - RNA, 399 nt, synthetic construct
  misc_feature 1..399: note = derived and/or modified sequence opt6 from anti-HIV-1_HeavyChain
  source 1..399: mol_type = other RNA
agggaatatttagaacaaagtggaggaggagtaaaaaaattaggagcaagtgtaagagtaagttgtagagcaagtgaagatttatttggagatgaagcaatatatgatgatgaattaatacattggttaagacaagtaccaggacaaagaccagaatggatgggatggataagaccaaaaacaggagcaagaaatcaagcaagacaatttcaaccaagaataaatttaagtagagatagagcattaaatacagcatatttagatttaagtagtttaacaagcgcagatagtgcaacatatttttgtgcaagacaaacatttaaaccagatttttattttgcagatcaaggatggagttttaatttatggggaagaggagcaagagtaatagtaagtagt

SEQ ID NO: 49436 - RNA, 399 nt, synthetic construct
  misc_feature 1..399: note = derived and/or modified sequence opt6 from anti-HIV-1_HeavyChain
  source 1..399: mol_type = other RNA
caagtacaattagtacaatcaggaacagaagtaaaaaaaccaggagcatcactaagagtatcatgcagagcatcagaagatctatttggagataaaataatatatgacgatgaagtaatacattggttaagacaactaccaggacaaagaccagaatggatgggatggataagaccaaaatcaggagcaagaaatcaagcaagacaattccaaccaagaatatcactaacaagagatagagcactatcaacagcatacctagacttaaactcactaacatcagcagactcaggaacatacttttgcgcaagacaaacatttaaaccagacttttactttgcagatcaaggatggtcattcaatctatggggaagaggagcacactttatagtaagctca

SEQ ID NO: 49437 - RNA, 399 nt, synthetic construct
  misc_feature 1..399: note = derived and/or modified sequence opt6 from anti-HIV-1_HeavyChain
  source 1..399: mol_type = other RNA
caagcacatctagaacaatcaggatcaggagtaaaaaaaccaggagcatcagtaagagtatcatgcagagcatcagaagatctatttggagatgaaataatatatgacgatgaagtaatacattggttaagacaagtaccaggacaaagaccagaatggatgggatggataagaccaaaaacaggagcaagaaatcaagcaagacaattccaaccaagaatatcactaacaagagatagagcactatcaacagcatacttagacttaaactcattaacaagcgcagactcaggaacatacttttgcgcaagacaaacatttaaaccagacttttactttgcagatcaagggtggtcattcaatttatggggaaggggagcacactttatagtaagctca

SEQ ID NO: 49438 - RNA, 399 nt, synthetic construct
  misc_feature 1..399: note = derived and/or modified sequence opt6 from anti-HIV-1_HeavyChain
  source 1..399: mol_type = other RNA
ggaaatatatggagtgaaagcggaggaggagtaaaaaaaccaggagcaagtgtaagagtaagttgtagagcaagtgaagatttatttggagatgaaataatatatgatgatgaagtaatacattggttaagacaagtaccaggacaaagaccagaatggatgggatggataagaccaaaaaatggaggaagaaatcaagcaagacaatttcaaccaagaataagtttaacaagagatagagcattaaatacagcatatctagatttaaatagtttaacaagtgcagatagtggaacatatttttgtgcaagacaaacatttaaaccagatttttattttgcagatcaaggatggagttttaatttatggggaagaggagcaagagtaatagtaagtagt

SEQ ID NO: 49439 - RNA, 399 nt, synthetic construct
  misc_feature 1..399: note = derived and/or modified sequence opt6 from anti-HIV-1_HeavyChain
  source 1..399: mol_type = other RNA
caagtacaattagtacaatcaggagcagaagtaaaaaaaccaggagcatcactaagagtaccatgcagagcatcagaagatctatttggagatgaaataatatatgacgatgaagtaatacattggttaagacaagtaccaggacaaagaccagaatggatgggatggataagaccaaaaacaggagcaagaaatcaagcaagacaattccaaccaagaatatcactaacaagagatagagcactatcaacagcatacttagacttaaactcattaacaagcgcagactcaggaacatacttttgcgcaagacaaacatttaaaccagacttttactttgcagatcaaggatggtcattcaatctatggggaagaggagcacactttatagtaagctca

SEQ ID NO: 49440 - RNA, 390 nt, synthetic construct
  misc_feature 1..390: note = derived and/or modified sequence opt6 from anti-HIV-1_HeavyChain
  source 1..390: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaatagtaagtggagcagtaaattttggaagtccaaattttagacaaagagtaagtttaacaagagatagagatttatttacagcacatatggatataagaggattaacacaaggagatacagcaacatatttttgtgcaagacaaaaatttgaaagaggaggacaaggatggatatttgatttatggggaagaggaacattaatagcagtaagtagtgcaagtagaagtgca

SEQ ID NO: 49441 - RNA, 393 nt, synthetic construct
  misc_feature 1..393: note = derived and/or modified sequence opt6 from anti-HIV-1_HeavyChain
  source 1..393: mol_type = other RNA
caagcacatttagaacaaagcggaagtggagtaaaaaaattaggagcaagtgtaagagtaagttgttggacaagtgaagatatatttgaaagaacagaattaatacattgggtaagacaagcgccaggacaaggattagaatggataggatgggtaaaagcagtaagtggagcagtaaattatggaagtttagattttagacatagagtaagtctaacaagagatagagatttaagtacagcacatatggatataagaggattaacacaagatgatacagcaacatatttttgtgcaagacaaaaatttgcaagaggagatcaaggatggttttttgatctatggggaagaggaacattaatagtagtaagtagtgcaagtacaagaagtaca

SEQ ID NO: 49442 - RNA, 414 nt, synthetic construct
  misc_feature 1..414: note = derived and/or modified sequence opt6 from anti-HIV-1_HeavyChain
  source 1..414: mol_type = other RNA
caagtacaattagtacaaagtggagcagaagtaaaaaaaccaggtgcaagtgtaacagtaagttgtaaagcaagtagatatacatttataaattattatatacattgggtaagacaagcaccaggacaaggactagaatggataggatgggtaaaaccagtaagtggagcagtaaattttggatcaccaaattttagacatagagtatcattaacaagagatagagatttatttacagcacatatggatataagaggattaacacaaggagatacagcaacatatttttgtgcaagacaaaaatttgcaagaggagatcaaggatggttttttgatttatggggaagaggaacattaatagtagtaagtagtgcatcaacaaaaggaccaagtgtatttccacatgatttaaga

SEQ ID NO: 49443 - RNA, 414 nt, synthetic construct
  misc_feature 1..414: note = derived and/or modified sequence opt6 from anti-HIV-1_HeavyChain
  source 1..414: mol_type = other RNA
caagtacaattagtacaaagtggagcagaagtaaaaaaaccaggagcaagtgtaaaagtaagttgtaaagcaagtggatatacaataacaagacattatatgcattgggtaagacaagcaccaggacaaggattagaatggataggatgggtaaaaacagtaacaggagcagtaaattttggatcaccaaattttagacatagagtatcattaacaagagatagagatctatttacagcacatatggatataagaggattaacacaaggagatacagcaacatatttttgtgcaagacaaaaatttgaaagaggaggacaaggatggtattttgatttatggggaagaggaacattaatagtagtaagttcagcatcaacaaaaggaccaagtgtatttccacatgatttaaga

SEQ ID NO: 49444 - RNA, 408 nt, synthetic construct
  misc_feature 1..408: note = derived and/or modified sequence opt6 from anti-HIV-1_HeavyChain
  source 1..408: mol_type = other RNA
caagcacatttagaacaaagtggaagtggagtaaaaaaaccaggagcaagcgtaagagtaagttgttggacaagtgaagatatatttgaaaaaagtgaattaatacattgggtaagacaagcaccaggacagggattagaatggataggatgggtaaaaacagtaacaggagcagtaaattttggaagtccaaattttaggcatagagtaagtttaacaagagatagagatttatttacagcacatatggatataagaggactaacacaaggagatacagcaacatatttttgtgcaagacaaaaatattatgcaggaggacaaggatggtattttgatctatggggaagaggaacattaatagtagtaagtagtgcaagtacaaaaggaccaagtgatgatctaaga

SEQ ID NO: 49445 - RNA, 411 nt, synthetic construct
  misc_feature 1..411: note = derived and/or modified sequence opt6 from anti-HIV-1_HeavyChain
  source 1..411: mol_type = other RNA
caagcacatttagaacaaagtggaagtggagtaaaaaaaccaggagcaagcgtaagagtaagttgttggacaagtgaagatatatttgaaagaacagaattaatacattgggtaagacaagcaccaggacaaggattagaatggataggatgggtaaaaatagtaagtggagcagtaaattttggaagtccaaattttagacaaagagtaagcttaacaagagatagagatttatttacagcacatatggatataagaggattaacacaaggagatacagcaacatatttttgcgcaagacaaaaatttgaaagaggaggacaaggatggatatttgatttatggggaagaggaacattaatagcagtaagtagtgcaagtacaaaaggaccaagtgtatatgatttaaga

SEQ ID NO: 49446 - RNA, 417 nt, synthetic construct
  misc_feature 1..417: note = derived and/or modified sequence opt6 from anti-HIV-1_HeavyChain
  source 1..417: mol_type = other RNA
caagtacaattagtacaaagtggaagtggagtgaaaaaaccaggagcaagtgtaagagtaagttgttggacaagcgaagatatatttgaaagaacagaattaatacattgggtaagacaagcaccaggacaaggattagaatggataggatgggtaaaaacagtaagtggagcagtaaattttggaagtccaaattttagacatagagtaagtttaacaagagatagagatttatttacagcacatatggatataagaggattaacacaaggagatacagcaacatatttttgtgcaagacaaaaatttgaaagaggaggacaaggatggtattttgatctatggggaagaggaacattaatagtagtaagtagtgcaagtacaaaaggaccaagtgtatttccacatgatttaaga

SEQ ID NO: 49447 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaaccaggagcaagtgtaagagtaagttgttggacaagtgaagatatatttgaaaaaagtgaattaatacattgggtaagacaagcaccaggacaaggattagaatggataggatgggtaaaaacagtaacaggagcagtaaattttggaagtccaaattttagacacagagtaagtctaacaagagatagagatttatttacagcacatatggatataagaggattaacacaaggagatacagcaacatatttttgtgcaagacaaaaatttgaaaggggaggacaaggatggtattttgatttatggggaagaggaacattaatagtagtaagtagtgcaagtacaaaaggaccaagtgtatttccaacaatatatgta

SEQ ID NO: 49448 - RNA, 417 nt, synthetic construct
  misc_feature 1..417: note = derived and/or modified sequence opt6 from anti-HIV-1_HeavyChain
  source 1..417: mol_type = other RNA
caagtacaattagaacaaagtggaagtggagtaaaaaaattaggagcaagtgtaagagtaagttgttggacaagtgaagatatatttgaagatgaattaatacattgggtaagacaagcaccaggacaaggactagaatggataggatgggtaaaagcagtaagtggagcagtaaattatggatcattagattttagacatagagtatcattaacgagagatagagatttatttacagcacatatggatataagaggattaacacaagatgatacagcaacatatttttgtgcaagacaaaaatttgcaagaggagatcaaggatggttttttgatttatggggaagaggaacattaatagtagtaagttcaggattacatcaaggaccaataggattaccaccaagattatcaaga

SEQ ID NO: 49449 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaatagtaagtggagcagtaaattttggaagtccaaattttagacaaagagtaagtttaacaagagatagagatttatttacagcacatatggatataagaggattaacacaaggagatacagcaacatatttttgtgcaagacaaaaatttgaaagaggaggacaaggatggatatttgatttatggggaagaggaacattaatagcagtaagtagtgcaagtccaagagcacatagaagtagtccaacaatatgtgta

SEQ ID NO: 49450 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtgaaaaaaccaggagcaagtgtaagagtaagttgttggacaagtgaagatatatttgaaagaacagaattaatacattgggtaaggcaagcaccaggacaaggattagaatggataggatgggtaaaaacagtaacaggagcagtaaattttggaagtagtgattttagacaaagagtaagtttaacaagagatagagatctatttacagcacatatggatataagaggactaacacaaggagatacagcaacatatttttgtgcaagacaaaaattttatgcaggaggacaaggatggtattttgatttatggggaagaggaacattaatagtagtaagtagtgcaagtacaaaaggaccaagtgtatttccacatgatctaaga

SEQ ID NO: 49451 - RNA, 414 nt, synthetic construct
  misc_feature 1..414: note = derived and/or modified sequence opt6 from anti-HIV-1_HeavyChain
  source 1..414: mol_type = other RNA
caagtacatttagtacaaagtggagcagaagtaaaaagaccaggagcaagcgtgaaagtaagttgtaaagcaagtggatatacatttacagattattttatacattgggtaagacaagcaccaggacaaggactagaatggataggatgggtaaaaacagtaagtggagcagtaaattttggatcattaaattttagacacagagtatcattaacaagagatagagatttatttacagcacacatggatataagaggattaacacaaggagatacagcaacatatttttgtgcaagacaaaaatttgcaagaggagatcaaggatggttttttgatttatggggaagaggaacattaatagtagtaagctcagcatcaacaaaaggaccaagcgtatttccacatgatttaaga

SEQ ID NO: 49452 - RNA, 420 nt, synthetic construct
  misc_feature 1..420: note = derived and/or modified sequence opt6 from anti-HIV-1_HeavyChain
  source 1..420: mol_type = other RNA
caagtacaattagtacaaagtggagcagaagtaaaaaaaccaggagcaagcgtaaaagtaagttgtaaagcaagtggatatatatttacaggaagttatatgcattgggtaagacaagcaccaggacaaacatttgaatggttaggatggatgaaaccagtaacaggagcagtaaattatgcaagacaatttcaaggaagagtaagtttttatagaacaagagaattaggaatagcatatatggatttaagagatttaaaatttgatgatacagcagtatatttttgtgcaagaaaaacaaaaggagatgtaagtggagatgatagagggtttttttttgatttatggggaagaggaacaagagtaatagtaagtagtgcaagtacaaaaggaccaagtgtatttccacatgatttaaga

SEQ ID NO: 49453 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagcggagtaaaaaaaccaggagcaagtgtaagagtaagttgttggacaagcgaagatatatttgaaaaaagtgaattaatacattgggtaagacaagcaccaggacaaggattagaatggataggatgggtaaaaacagtaacaggagcagtaaattttggaagtccaaattttagacatagagtaagtttaacaagagatagagatttatttacagcacatatggatataagaggattaacacaaggagatacagcaacatatttttgtgcaagacaaaaatttgaaagaggaggacaaggatggtattttgatttatggggacgaggaacattaatagtagtaagtagtgcaagcacaaaaggaccaagtgtatttccacatgatttaaga

SEQ ID NO: 49454 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaaccaggagcaagtgtaagagtaagctgttggacaagtgaagatatatttgaaggaagtgaattaatacattgggtaagacaagcaccaggacaaggattagaatggataggatgggtaaaaacagtaacaggagcagtgaattttggaagtccaaattttagacatagagtaagtctaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagcagtgcaagtacaaaaggaccaagtgtatttccacatgatttaaga

SEQ ID NO: 49455 - RNA, 420 nt, synthetic construct
  misc_feature 1..420: note = derived and/or modified sequence opt6 from anti-HIV-1_HeavyChain
  source 1..420: mol_type = other RNA
caagtacaattagtacaatcaggagcagaagtaaaaaaaccaggagcatcagtaaaagtatcatgcaaagcatcaggatatacatttacaggatactatatacattgggtaagacaagcaccaggacaaggattagaatggatgggatggataaatccaaactcaggagcaacaaattacgcacaaaaatttcaaggaagattaacaatagcaagagatacatcaatatcaacagcatacatggacttaagaaatttaagattcgatgacacagcagtatacttttgcgcaagaaaaacagcaggagatgtaagtggagataacagaggatatttctttgacttatggggaagaggaagtagagtaatagtatcaagtgcaagcacaaaaggaccatcagtatttccacatgacttaaga

SEQ ID NO: 49456 - RNA, 414 nt, synthetic construct
  misc_feature 1..414: note = derived and/or modified sequence opt6 from anti-HIV-1_HeavyChain
  source 1..414: mol_type = other RNA
caagcacatctagaacaaagtggaagtggagtaaaaaaaccaggagcaagtgtaagagtaagttgttggacaagtgaagatatatttgaaaaaagtgaattaatacattgggtaagacaagcaccaggacaaggattagaatggataggatgggtaaaaacagtaacaggagcagtaaattttggaagtagtgattttagacaaagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagtgcaagtacaaaaggaccaagtgtatttcatgatttaaga

SEQ ID NO: 49457 - RNA, 414 nt, synthetic construct
  misc_feature 1..414: note = derived and/or modified sequence opt6 from anti-HIV-1_HeavyChain
  source 1..414: mol_type = other RNA
caagcaacattagaacaaagtggaagtggagtaaaaaaaccaggagcaagtgtaagagtaagttgttggtcaagcgaagatatatttaaaacagaattaatacattgggtaagacaagcaccaggacaaggattagaatggataggatgggtaaaagcagtaagtggagcagtaaattatggatcattagattttagacatagagtatcattaacaagagatagagatttatcaacagcacatatggatataagaggattaacacaagatgacacagcaacacatttttgtgcaagacaaaaatttgcaagaggagatcaaggatggttttttgatttatggggaagaggaacactaatagtagtaagttcagcatcaacaaaaggaccaagtgtatttccaacaatatatgta

SEQ ID NO: 49458 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaaccaggagcaagtgtaagagtatcatgttggacaagtgaagatatatttgaaagaacagaattaatacattgggtaagacaagcaccaggacaaggattagaatggataggatgggtaaaaacagtaacaggagcagtaaattttggaagtccaaattttagacatagagtaagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagtgcaagcacaaaaggaccaagtgtatttccaacaatatgtgta

SEQ ID NO: 49459 - RNA, 414 nt, synthetic construct
  misc_feature 1..414: note = derived and/or modified sequence opt6 from anti-HIV-1_HeavyChain
  source 1..414: mol_type = other RNA
caagcacatttagaacaaagtggaagcggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaagtggagcagtaaattttggaagtccaaattttagacatagagtaagtttaacaagagatagagatttatttacagcacatatggatataagaggattaacacaaggagatacagcaacatatttttgtgcaagacaaaaatttgaaagaggaggacaaggatggatatttgatttatggggaagaggaacattaatagcagtaagtagtgcaagtccaagagcacatagaagcagtccaagaagtgca

SEQ ID NO: 49460 - RNA, 414 nt, synthetic construct
  misc_feature 1..414: note = derived and/or modified sequence opt6 from anti-HIV-1_HeavyChain
  source 1..414: mol_type = other RNA
caagcacatttagaacaaagtggaagtggagtaaaaaaaccaggagcaagtgtaagagtaagttgttggacaagtgaagatatatttaaaagtgaattaatacattgggtaagacaagcaccaggacaaggattagaatggataggttgggtaaaaacagtaacaggagcagtaaattttggatcaagtgattttagacaaagagtatcattaacaagagatagagatttatttacagcacatatggatataagaggattaacacaaggagatacagcaacatatttttgtgcaagacaaaaatttgaaagaggaggacaaggatggatatttgatttatggggaagaggaacattaatagcagtaagttcagcatcaacaaaaggaccaagtgtatttccaacaatatgtgta

SEQ ID NO: 49461 - RNA, 414 nt, synthetic construct
  misc_feature 1..414: note = derived and/or modified sequence opt6 from anti-HIV-1_HeavyChain
  source 1..414: mol_type = other RNA
caagcacatttagaacaaagtggaccaggagtaaaaaaattaggagcaagtgtaagagtaagttgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagtttaacaagagatagagatctatttacagcacatatggatataagaggattaacacaagatgatacagcaatatatttttgtgcaagacaaaaatttgcaagaggagatcaaggatggttttttgatttatggggaagaggaacattaatagtagtaagtagtgcaagtacaaaagcacacagaagtagtccaagaagtaca

SEQ ID NO: 49462 - RNA, 420 nt, synthetic construct
  misc_feature 1..420: note = derived and/or modified sequence opt6 from anti-HIV-1_HeavyChain
  source 1..420: mol_type = other RNA
caagtacaattagtacaaagcggagctgaaatgaaaaaaccaggagcaagtgtaaaattaagctgtatgacaagtggatatgtattcacagacttttatatacactgggtaagacaagcaccaggacaaggactagaatggatgggatggataaatccaggaacaggaggaacaatatcagcaccaagatttctaggaagagtaacattaactagagacacaagtataagtgcagcatatatagaaataaatagagtaacaatagacgatacagcaacatatttctgtgcaagacaaaaatttgcaagcagatactcaggagatcaaggaagctattttgatttatggggaagaggaacactaatagtagtaagttcagcatcaacaaaaggaccattaggactaccaccaagaagtgca

SEQ ID NO: 49463 - RNA, 414 nt, synthetic construct
  misc_feature 1..414: note = derived and/or modified sequence opt6 from anti-HIV-1_HeavyChain
  source 1..414: mol_type = other RNA
caagcacatttagaacaaagtggaagtggagtaaaaaaaccaggagcaagtgtaagagtaagctgttggacaccagaagatatatttgaaagaacagaattaatacattgggtaagacaagcaccaggacaaggattagaatggataggatgggtaaaaatagtaagtggagcagtaaattttggaagtccaaattttagacaaagagtaagtttaacaagagatagagatttatttacagcacatatggatataagaggattaacacaaggagatacagcaacatatttttgtgcaagacaaaaatttgaaagaggaggacaaggatggatatttgatttatggggaagaggaacattaatagcagtaagtagtgcaagtccaagagcacatagaagtagtccaagaagtgca

SEQ ID NO: 49464 - RNA, 414 nt, synthetic construct
  misc_feature 1..414: note = derived and/or modified sequence opt6 from anti-HIV-1_HeavyChain
  source 1..414: mol_type = other RNA
caagcacatttggaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaccagtaacaggagcagtaaatttagcaccaaattttagacatagagtaagtttaacaagagatagagatttatttacagcacatatggatataagaggattaacacaaggagatacagcaacatatttttgtgcaagacaaaaatttgaaagaggaggacaaggatggtattttgacttatggggaagaggaacactaatagtagtaagttcagcatcaacaaaaggaccaagcgtatttccacatgatttaaga

SEQ ID NO: 49465 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaaccaggagcaagtgtaagagtaagttgttggagtagtgaagatatatttgaaagaacagaattaatacattgggtaagacaagcaccaggacaaggattagaatggataggatgggtaaaagcagttagtggagcagtaaattatggaagtttagattttagacatagagtaagtttaacaagagatagagatttaagtacagcacatatggatataagaggactaacacaagatgatacagcaacatatttttgtgcaagacaaaaatttgcaagaggagatcaaggatggttttttgatttatggggaagaggaacactaatagtagtaagtagtgcaagtacaaaaggaccaagtgtatttccacatgatttaaga

SEQ ID NO: 49466 - RNA, 414 nt, synthetic construct
  misc_feature 1..414: note = derived and/or modified sequence opt6 from anti-HIV-1_HeavyChain
  source 1..414: mol_type = other RNA
caagcacatttagaacaaagcggaagtggagtaaaaaaaccaggagcaagtgtaagagtaagttgttggacaagtgaagatatatttgaaagaagtgaattaatacattgggtaagacaagcaccaggacaaggattggaatggataggatgggtaaaaacagtaacaggagcagtaaattttggaagtccaaattttagacaaagagtaagtttaacaagagatagagatttatttacagcacatatggatataagaggactaacacaaggagatacggcaacatatttttgtgcaagacaaaaattttatgcaggaggacaaggatggtattttgatttatggggaagaggaacactaatagtagtaagtagtgcaagcacaaaagcacatagaagtagtccaagaagcaca

SEQ ID NO: 49467 - RNA, 414 nt, synthetic construct
  misc_feature 1..414: note = derived and/or modified sequence opt6 from anti-HIV-1_HeavyChain
  source 1..414: mol_type = other RNA
caagcacatttagaacaaagcggaagtggagtaaaaaaaccaggagcaagtgtaagagtaagttgttggacaagtgaagatatatttaaaagtgaattaatacattgggtaagacaagcaccaggacaaggattagaatggataggatgggtaaaaactgtaacaggagcagtaaattttggatcaagtgattttagacaaagagtatcattaacaagagatagagatctatttacagcacatatggatataagaggattaacacaaggagatacagcaacatatttttgtgcaagacaaaaattttatgcaggaggacaaggatggtattttgatttatggggaagaggaacattaatagtagtaagttcagcatcaacaaaaggaccaagtgtatttccaacaatatgtgta

SEQ ID NO: 49468 - RNA, 414 nt, synthetic construct
  misc_feature 1..414: note = derived and/or modified sequence opt6 from anti-HIV-1_HeavyChain
  source 1..414: mol_type = other RNA
caagcacatttagaacaaagcgggagtggagtaaaaaaattaggagcaagtgtaagagtaagttgttggacaagcgaagatatatttaaaacagaattaatacattgggtaagacaagcaccaggacaaggattagaatggataggatgggtaaaagcagtaagtggagcagtaaattatggatcattagattttagacatagagtatcattaacaagagatagagatttatcaacagcacatatggatataagaggattaacacaagatgatacagcaacatatttttgtgcaagacaaaaatttgcaagaggagatcaaggatggttttttgatttatggggaagaggaacattaatagtagtaagttcagcatcaacaaaaggaccaagtgtatttccacatgatttaaga

SEQ ID NO: 49469 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaatcaggaagtggagtaaaaaaaccaggagcatcagtaagagtatcatgttggacatcagaagatatatttgaaaaaagcgaattaatacattgggtaagacaagcaccaggacaaggattagaatggataggatgggtaaaaacagtaacaggagcagtaaattttggatcaagtgattttagacaaagagtatcattaacaagagatagagatttatttacagcgcatatggatataagaggactaacacaaggagatacagcaacatatttttgtgcaagacaaaaattttatgcaggaggacaaggatggtattttgatttatggggaagaggaacattaatagtagtaagttcagcatcaacaaaaggaccaagtgtatttccaacaatatatgta

SEQ ID NO: 49470 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaatcaggatcaggagtaaaaaaaccagggacatcagtaagagtatcatgttggacatcagaagatatatttgaaagaacagaattaatacattgggtaagacaagcaccaggacaaggattagaatggataggatgggtaaaaacagtaacaggagcagtaaattttggatcaccaaattttagacatagagtatcattaacaagagatagagatttatttacagcacatatggatataagaggattaacacaaggagatacagcaacatatttttgtgcaagacaaaaatttgcaagaggagatcaaggatggttttttgatttatggggaagaggaacactaatagtagtaagttcagcatcaacaaaaggaccaagtgtatttccaacaatatgtgta

SEQ ID NO: 49471 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaaccaggagcaagtgtaagagtaagttgttggacaagtgaagacatatttgaaaaaagtgaattaatacattgggtaagacaagcaccaggacaagggctagaatggataggatgggtaaaaacagtaacaggagcagtaaattttggaagtagtgattttagacaaagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagtgcaagtacaaaaggaccaagtgtatttccacaaatatatgta

SEQ ID NO: 49472 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagcggagtaaaaaaaccaggagcaagtgtaagagtaagttgttggacaagtgaagatatatttgaaaaaagtgaattaatacattgggtaagacaaacaccaggacaaggattagaatggataggatgggtaaaaacagtaacaggagcagtaaattttggaagtagtgattttagacaaagagtaagcttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagtgcaagtacaaaaggaccaagtgtatttccaacaatatatgta

SEQ ID NO: 49473 - RNA, 417 nt, synthetic construct
  misc_feature 1..417: note = derived and/or modified sequence opt6 from anti-HIV-1_HeavyChain
  source 1..417: mol_type = other RNA
caagcacatctagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaatagtaagtggagcagtaaattttggaagcccaaattttagacaaagagtaagcttaacaagagatagagatttatttacagcacatatgggaataagaggattaacacaaggagatacagcaacatatttttgtgcaagacaaaaatttgaaagaggaggacaaggatggatatttgatttatggggaagaggaacattaatagcagtaagtagtgcaagtacaaaaggaccaagcgtatttccaacaatatatgta

SEQ ID NO: 49474 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaattaggagcaagtgtaagagtaagttgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagtttaacaagagatagagatttatttacagcacatatggatataagaggattaacacaagatgatacagcaacatatttttgtgcaagacaaaaatttgcaagaggagatcaaggatggttttttgatttatggggaagaggaacattaatagtagtaagtagtgcaagtacaaaaggaccaagtgtatttccacatgatttaaga

SEQ ID NO: 49475 - RNA, 417 nt, synthetic construct
  misc_feature 1..417: note = derived and/or modified sequence opt6 from anti-HIV-1_HeavyChain
  source 1..417: mol_type = other RNA
caagcacatctagaacaaagcggaagtggagtaaaaaaaccaggagcaagtgtaagagtaagttgttggacaagtgaagatatatttgaaagaacagaattaatacattgggtaagacaagcaccaggacaaggactagaatggataggatgggtaaaaacagtaacaggagcagtaaattttggaagtccaaattttagacatagagtaagtttaacaagagatagagatttatttacagcacatatggatataagaggattaacacaaggagatacagcaacatatttttgtgcaagacaaaaatttgaaaggggaggacaaggatggatatttgatttatggggaagaggaacattaatagcagtgagtagtgcaagtacaaaaggaccaagtgtatttccaagaagtgcagta

SEQ ID NO: 49476 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatggatgaaaatagtaagtggagcagtaaattttggaagtccaaattttagacaaagagtaagtttaacaagggatagagatttatttacagcacatatggatataagaggattaacacaaggagatacagcaacatatttttgtgcaagacaaaaatttgaaagaggaggacaaggatggatatttgatttatggggaagaggaacattaatagcagtaagtagtgcaagcacaaaaggaccaagtgtatttccacatgatttaaga

SEQ ID NO: 49477 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaaccaggagcaagtgtaagagtaagttgttggacatcagaagatataagtgaaggaagcgaattaatacattgggtaagacaagcaccaggacaaggattagaatggataggatgggtaaaaacagtaacaggagcagtaaattttggaagtgcatattttagacatagagtgagtttaacaagagatagagatttatttacagcacatatggatataagaggattaacacaaggagatacagcaacatatttttgtgcaagacaaaaattttataaaggaggacaaggatggtattttgatttatggggaagagggacattaatagtagtaagtagcgcaagtacaaaaggaccaagtgtatttccaacaatatgtgta

SEQ ID NO: 49478 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaaccaggagcaagtgtaagagtaagttgttggacaagcgaagatatatttgaaagaacagaattaatacattgggtaagacaagcaccaggacaaggattagaatggataggatgggtaaaaacagtaacaggagcagtaaattatggaagtttagattttagacatagagtaagtttaacaagagatagagatctaagtacagcacatatggatataagaggattaacacaagatgatacagcaacatatttttgtgcaagacaaaaatttgcaagaggagatcaaggatggttttttgatttatggggaagaggaacattaatagtagtaagcagcgcaagtacaaaaggaccaagtgtatttccacatgatttaaga

SEQ ID NO: 49479 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtgaaaaaaccaggagcaagtgtaagagtaagctgttggagtagtgaagatatatttgaaagaacagaattaatacattgggtaagacaagcaccaggacaaggattagaatggattggatgggtaaaaatagttagtggagcagtaaattttggaagtccaaattttagacaaagagtaagcttaacaagagatagagatttatttacagcacatatggatataagaggattaacacaaggagatacagcaacatatttttgtgcaagacaaaaatttgaaagaggaggacaaggatggatatttgatttatggggaagaggaacattaatagcagtaagttcagcaagtacaaaaggaccaagtgtatttccaacaatatatgta

SEQ ID NO: 49480 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaagaccgggagcaagtgtaagagtaagttgttggacaagtgaagatatatttgaaacaacagaattaatacattgggtaagacaagcaccaggacaaggactagaatggataggatgggtaaaaacagtaagtggagcagtaaattttggatcattaaattttagacatagagtaagtttaacaagagatagagatttatttacagcacatatggatataaggggattaacacaaggagatacagcaacatatttttgtgcaagacaaaaatttgcaagaggagatcaaggatggttttttgatttatggggaagaggaacattaatagtagtaagtagtgcaagtacaaaaggaccaagtgtatttccaacaatatgtgta

SEQ ID NO: 49481 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaatttaggaagtccaaattttagacatagagtaagtctaacgagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagcgcaagtacaaaaggaccaagtgtatttccacatgatttaaga

SEQ ID NO: 49482 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaattaggagcaagtgtaagagtaagctgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagtttaacaagagatagagatttaagtacagcacatatggatataagaggactaacacaagatgatacagcaacatatttttgtgcaagacaaaaatttgaaagaggaggacaaggatggatatttgatttatggggaagaggaacattaatagcagtaagtagtgcaagtacaaaaggaccaagtgtatttccaacaatatgtgta

SEQ ID NO: 49483 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaaccaggagcaagtgtaagagtaagttgttggacaagtgaagacatatttgaaagaacagaattaatacattgggtaagacaagcaccaggacaaggattagaatggataggatgggtaaaaacagtaacaggagcagtaaattttggaagtccaaattttagacatagagtaagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagtgcaagcacaaaaggaccaagcgtttttccacatgatttagta

SEQ ID NO: 49484 - RNA, 417 nt, synthetic construct
  misc_feature 1..417: note = derived and/or modified sequence opt6 from anti-HIV-1_HeavyChain
  source 1..417: mol_type = other RNA
caagcacatctagaacaaagcggaagtggagtaaaaaaaccaggagcaagtgtaagagtaagttgttggagtagtgaagatatatttgaaagaacagaattaatacattgggtaagacaagcaccaggacaaggactagaatggataggatgggtaaaagcagtaagtggagcagtaaattatggaagcttagattttagacacagagtaagtttaacaagagatagagatttatttacagcacatatggatataagaggattaacacaagatgatacagcaacatatttttgtgcaagacaaaaatttgcaagaggagatcaagggtggttttttgatttatggggaagaggaacattaatagtagtaagtagtgcaagtacaaaaggaccaagtgtatttccaacaatatatgta

SEQ ID NO: 49485 - RNA, 420 nt, synthetic construct
  misc_feature 1..420: note = derived and/or modified sequence opt6 from anti-HIV-1_HeavyChain
  source 1..420: mol_type = other RNA
caagtacatttagaacaaagtggaagtggagtaaaaaaaccaggagcaccagtaagagtaagttgttggagtagtgaagatatatttgaaagaacagaattaatacattgggtaagacaagcaccaggacaaggattagaatggataggatgggtaaaaacagtgacaggagcagtaaattttggaagtttagattttagacatagaataagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagtgcaagtacaaaagcacatagcgtactaccaccaagaagtagagta

SEQ ID NO: 49486 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaaccaggagcattagtaagagtaagttgttggacaagtgaagatatatttgaaaaaagtgaattaatacattgggtaagacaagcaccaggacaaggattagaatggataggatgggtgaaaacagtaacaggagcagtaaattttggatcaagtgattttagacaaagagtaagtttaacaagagatagagatctatttacagcacatatggacataagaggattaacacaaggagatacagcaacatatttttgtgcaagacaaaaattttatgcaggaggacaagggtggtattttgatttatggggaagaggaacattaatagtagtaagtagtgcaagtacaaaaggaccaagtgtatttccacatgatttaaga

SEQ ID NO: 49487 - RNA, 414 nt, synthetic construct
  misc_feature 1..414: note = derived and/or modified sequence opt6 from anti-HIV-1_HeavyChain
  source 1..414: mol_type = other RNA
caagtacaattagtacaaagtggagcagaagtaaaaaaaccaggagcaagtgtaaaagtaagttgtcaagtaagtggatatacattaacagaattaagtatgcattgggtaagacaagcaccaggacaaggattagaatggataggatgggtaaaaacagtaacaggagcagtaaattttggatcaccaaattttagacatagagtatcattaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagttcagcatcaacaaaaggaccaagcgtatttccacatgatttaaga

SEQ ID NO: 49488 - RNA, 414 nt, synthetic construct
  misc_feature 1..414: note = derived and/or modified sequence opt6 from anti-HIV-1_HeavyChain
  source 1..414: mol_type = other RNA
caagcacatttagaacaaagtggaagtggagtaaaaaaaccaggagcaagtgtaagagtaagttgttggacaagtgaagatatatttaaaacagaattaatacattgggtaagacaagcaccaggacaaggattagaatggataggatgggtaaaaatagtaagtggagcagtaaattttggaagcccaaattttagacaaagagtatcattaacaagagatagagatttatttacagcacatatggatataagaggactaacacaaggagatacagcaacatatttttgtgcaagacaaaaatttgaaagaggaggacaaggatggatatttgatttatggggaagaggaacattaatagcagtaagctcagcatcaacaaaaggaccaagtgtatttccacatgatttaaga

SEQ ID NO: 49489 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaactaggagcaagtgtaagagtaagctgttggacaagtgaagatatatttgaaagaacagaactaatacattgggtaagacaagcaccaggacaaggattagaatggataggatgggtaaaagcagtaagtggagcagtaaattatggaagtttagattttagacatagagtaagtttaacaagagatagagatttatttacagcacatatggatataagaggattaacacaagatgatacagcaacatatttttgtgcaagacaaaaatttgcaagaggagatcaaggatggttttttgatttatggggaagaggaacattaatagtagtaagtagtgcaagtacaaaaggaccaagtgtatttccaacaatatgtgta

SEQ ID NO: 49490 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaatcaggatcaggagtaaaaaaaccaggagcatcagtaagagtaagttgttggacatcagaagatatatttgaaaaaagtgaattaatacattgggtaagacaagcaccaggacaagggctagaatgggtaggatgggtaaaaacagtaacaggagcagtaaattttggatcaagtgattttagacaaagagtatcattaacaagagatagagatctatttacagcacatatggatataagaggactaacacaaggagatacagcaacatatttttgtgcaagacaaaaattttatgcaggaggacaagggtggtattttgatctatggggaagaggaacattaatagtagtaagttcagcatcaacaaaaggaccaagtgtatttccacatgatttaaga

SEQ ID NO: 49491 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaaccaggagcaagtgtaagagtaagttgttggacaagtgaagatatatttgaaaaaagtgaattaatacattgggtaagacaagcaccaggacaaggattagaatggataggatgggtaaaaacagtaacaggagcagtaaattttggaagtagtgattttagacaaagagtaagtttaacaagagatagagatttatttacagcacatatggatataagaggattaacacaaggagatacagcaacatatttttgtgcaagacaaaaatttgaaagaggagggcaaggatggtattttgatctatggggaaggggaacattaatagtagtaagtagtgcatcaacaaaaggaccaagtgtatttccaacaatatgtgta

SEQ ID NO: 49492 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaattaggagcaagtgtaagagtaagttgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagtttaacaagagatagagatttaagtacagcacatatggatataagaggattaacacaagatgatacagcaacatatttttgtgcaagacaaaaatttgcaagaggagatcaaggatggttttttgatttatggggaagaggaacattaatagtagtaagtagtgcaagtacaaaaggaccaagtgtatttccacaaatatgtgta

SEQ ID NO: 49493 - RNA, 414 nt, synthetic construct
  misc_feature 1..414: note = derived and/or modified sequence opt6 from anti-HIV-1_HeavyChain
  source 1..414: mol_type = other RNA
caagcacatttagaacaaagtggaagtggggtaaaaaaaccaggtgcaagtgtaagagtaagttgttggacaagtgaagatatatttgaaaaaagtgaattaatacattgggtaagacaagcaccaggacaaggattagaatggataggatgggtaaaaacagtaacaggagcagtaaattttggacatcaaatatcagatagagtatcattaacaccagatagagatttatttacagcacatatggatataagaggattaacacaaggagatacagcaacatatttttgtgcaagacaaaaattttatgcaggaggacaaggatggtattttgatttatggggaagaggaacattaatagtagtaagttcagcatcaacaaaaggaccaagtgtatttccaacaatatgtgta

SEQ ID NO: 49494 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagcggagtaaaaaaaccaggagcaagtgtaagagtaagttgttggacaagtgaagatatatttgaaaaaagtgaattaatacattgggtaaggagagcaccaggacaaggattagaatggataggatgggtaaaaacagtaacaggagcagtaaattttggaagtagtgattttagacaaagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagtgcaagtacaaaagcacatagaagtagtccaacaatatgtgta

SEQ ID NO: 49495 - RNA, 417 nt, synthetic construct
  misc_feature 1..417: note = derived and/or modified sequence opt6 from anti-HIV-1_HeavyChain
  source 1..417: mol_type = other RNA
caagcacatctagaacaaagtggaagtggagtaaaaaaattaggagcaagtgtaagagtaagttgttggacaagtgaagatatatttgaaagaacagaattaatacattgggtaagacaagcaccaggacaaggactagaatggataggatgggtaaaagcagtaagtggagcagtaaattatggaagtttagattttagacatagagtaagtttaacaagagatagagatttatttacagcacatatggatataagaggattaacacaagatgatacagcaacatatttttgtgcaagacaaaaatttgcaagaggagatcaaggatggttttttgatttatggggaagaggaacattaatagtagtaagtagtgcaccaacaaaaggaccaagtgtatttccaacaatatgtgta

SEQ ID NO: 49496 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaaccaggagcaagtgtaagagtatcatgttggacaagtgaagatatatttgaaagaacagaattaatacattgggtaagacaagcaccaggacaaggattagaatggataggatgggtaaaaacagtaacaggagcagtaaattttggaagtagtgattttagacaaagagtaagtttaacaagagatagagatttatttacagcacatatggatataagaggattaacacaaggagatacagcaacatatttttgtgcaagacaaaaattttatgcaggaggacaaggatggtattttgatttatggggtagaggaacattaatagtagtaagtagtgcaagtacaaaaggaccaagtgtatttccacaaatatatgta

SEQ ID NO: 49497 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaaccaggagcaagtgtaagagtaagctgttggacaagtgaagatatatttgaaaaaagtgaattaatacattgggtaagacaagcaccaggacaaggattagaatggataggatgggtaaaaacagtaacaggagcagtaaattttggaagtagcgattttagacaaagagtaagcttaacaagaggaagagatttatttacagcacatatggacataagaggactaacacaaggagatacagcaacatatttttgtgcaagacaaaaattttatgcaggaggacaaggatggtattttgatttatggggaagaggaacattaatagtagtaagtagtgcaagtacaaaaggaccaagtgtatttccaacaatatgtgta

SEQ ID NO: 49498 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaaccaggagcaagtgtaagagtaagttgttggacaagcgaagatatatttgaaagaacagaattaatacattgggtaagacaagcaccaggacaaggattagaatggataggatgggtaaaaacagtaacaggagcagtaaattttggaagtccaaattttagacatagagtaagtttaacaagagatagagatttaagtacagcacatatggatataagaggattaacacaagatgatacagcaacatatttttgtgcaagacaaaaatttgcaagaggagatcaaggatggttttttgatttatggggaagaggaacattaatagtagtaagtagtgcaagtacaaaaggaccaagtgtgtttccacatgatcatgta

SEQ ID NO: 49499 - RNA, 417 nt, synthetic construct
  misc_feature 1..417: note = derived and/or modified sequence opt6 from anti-HIV-1_HeavyChain
  source 1..417: mol_type = other RNA
caagcacatctagaacaaagtggaagcggagtaaaaaaaccaggagcaagtgtaagagtaagttgttggacaagcgaagatatattcgaaagaacagaattaatacattgggtaagacaagcaccaggacaaggactagaatggataggatgggtaaaaacagtaacaggagcagtaaattttggaagcccaaattttagacatagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagtgcaagtacaaaagggccaagtgtatttccacaaatatgtgta

SEQ ID NO: 49500 - RNA, 417 nt, synthetic construct
  misc_feature 1..417: note = derived and/or modified sequence opt6 from anti-HIV-1_HeavyChain
  source 1..417: mol_type = other RNA
caagcacatctagaacaaagtggaagtggagtaaaaaaaccaggagcaagcgtaagagtaagttgttggacaagtgaagatatatttgaaagaacagaattaatacattgggtaagacaagcaccgggacaaggattagaatggataggatgggtaaaaatagtaagtggagcagtaaattttggaagtccaaattttagacaaagagtaagcttaacaagagatagagatttatttacagcacatatggatataagaggattaacacaaggagatacagcaacatatttttgtgcaagacaaaaatttgaaagaggaggacaaggatggatatttgatttatggggaagaggaacattaatagtagtaagtagtgcaagtacaaaaggaccaagtgtatttccaacaatatgtgta

SEQ ID NO: 49501 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaaccaggagcaagtgtaagagtaagttgttgggcaagtgaagatatatttgaaagaacagaattaatacattgggtaagacaagcaccaggacaaggactagaatggataggatgggtaaaaacagtaacaggagcagtaaattttggaagtccaaattttagacatagagtaagtttaacaagagatagagatttatttacagcgcatatggatataagaggattaacacaaggagatacagcaacatatttttgtgcaagacaaaaattttatgcaggaggacaaggatggtattttgatttatggggaagaggaacactaatagtagtaagtagtgcaagtacaaaaggaccaagtgtatttccacatgatttatta

SEQ ID NO: 49502 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaaccaggagcaagtgtaagagtaagttgttggacaagtgaagatatatttgaaaaaagtgaattaatacattgggtaagacaagcaccaggacaaggattagaatggataggatgggtaaaaacagtaacaggagcagtaaattttggaagtagtgattttagacaaagagtaagtttaacaagagatagagatttatttacagcacatatggatataagaggattaacacaaggagatacagcaacatacttttgtgcaagacaaaaatttgaaagaggaggacaaggatggatatttgatttatggggaagaggaacattaatagcagtaagcagtgcaagtacaaaaggaccaagcgtatttccacatgatttaaga

SEQ ID NO: 49503 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagcggagtaaaaaaaccaggagcaagtgtaagagtgagttgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagtttaacaagagatagagatttaagtacagcacatatggatataagaggattaacacaagatgatacagcaacatatttttgtgcaagacaaaaatttgcaagaggagatcaaggatggttttttgatttatggggaagaggaacattaatagtagtaagtagtgcaagtacaaaaggaccatcagtatttccacatgatttaaga

SEQ ID NO: 49504 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaaccaggagcaagtgtaagagtaagttgttggacaagtgaagatatatttgaaagaagtgaattaatacattgggtaagacaagcaccaggacaaggattagaatggataggatgggtaaaaacagtaacaggagcagtaaattttggaagtccaaattttagacatagagtaagtttaacaagagatagagatttatttacagcacatatggatataagaggattaacacaaggagatacagcaacatatttttgtgcaagacaaaaatattatgcaggaggacaaggatggtattttgatttatggggaagaggaacattaatagtagtaagttcagcaagcacaaaaggaccaagtgtattcccaacaatatgtaga

SEQ ID NO: 49505 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaaccaggagcaagtgtaagagtaagttgttggacatcagaagatatatttgaaaaaagtgaattaatacattgggtaagacaagcaccaggacaaggattagaatggataggatgggtaaaaacagtaacaggagcagtaaattttggaagtagtgattttagacaaagagtaagtttaacaagagatagagatttatttacagcacatatggatataagaggactaacacaaggagatacagcaacatatttttgtgcaagacaaaaatttgaaagaggaggacaaggatggtattttgatctatggggaagaggaacattaatagtagtaagtagtgcaagtacaaaaggaccaagtgtatttccacatgatttaaga

SEQ ID NO: 49506 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaactaggagcaagtgtaagagtaagctgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagcttaacaagggatagagatttatttacagcacatatggatataagaggattaacacaagatgatacagcaacatatttttgtgcaagacaaaaatttgcaagaggagatcaaggatggttttttgatttatgggggaggggaacattaatagtagtaagtagtgcaagtacaaaaggaccatcagtatttccaacaatatatgta

SEQ ID NO: 49507 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaaccaggagcaagtgtaagagtatcatgttggacatcagaagatatatttgaaaaaagtgaattaatacattgggtaagacaagcaccaggacaaggattagaatggataggatgggtaaaaacagtaacaggagcagtaaattttggatcaagtgattttagacaaagagtaagtttaacaagagatagagatttatttacagcacatatggatataagaggattaacacaaggagatacagcaacgtatttttgtgcaagacaaaaattttataaaggaggacaaggatggtattttgatttatggggaagaggaacattaatagtagtatcaagtgcaagcacaaaaggaccaagtgtatttccacatgatctaaga

SEQ ID NO: 49508 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagcggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggaacagtaaattttggaagtttaaattttagacaaagagtaagtttaacaagagatagagacctatttacagcacatatggatataagaggattaacacaagatgatacagcaacatatttttgtgcaagacaaaaatttgcaagaggagatcaaggatggttttttgatttatggggaagaggaacattaatagtagtaagtagtgcaagtacaaaaggaccaagtgtatttccacatgatttaaga

SEQ ID NO: 49509 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaaccaggagcaagtgtaagagtaagttgttggccaagtgaagatatatttgaaaaaagcgaattaatacattgggtaagacaagcaccaggacaaggattagaatggataggatgggtaaaaacagtaacaggagcagtaaattttggaagtagtgattttagacaaagagtaagtttaacaagagatagagatttatttacagcgcatatggatataagaggattaacacaaggagatacagcaacatatttttgtgcaagacaaaaatttgaaagaggaggacaaggatggatatttgatttatggggaagaggaacattaatagcagtaagtagtgcaagtacaaaaggaccaagtgtatttccacatgatttaaga

SEQ ID NO: 49510 - RNA, 417 nt, synthetic construct
  misc_feature 1..417: note = derived and/or modified sequence opt6 from anti-HIV-1_HeavyChain
  source 1..417: mol_type = other RNA
caagcacatctagaacaaagtggaagtggagtgaaaagaccaggagcaagtgtaagagtaagctgttggacaagtgaagatatatttgaaacaacagaattaatacattgggtaagacaagcaccaggacaaggattagaatggataggatgggtaaaaacagtaagtggagcagtaaattttggaagtttaaattttagacatagagtaagtttaacaagagatagagatttatttacagcacatatggatataagaggattaacacaaggagatacagcaacatatttttgtgcaagacaaaaatttgcaagaggagatcaaggatggttttttgatttatggggaagaggaacattaatagtagtaagttcagcatcaacaaaaggaccaagtgtatttccacatgatttaagg

SEQ ID NO: 49511 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtagaaaaaccaggagcaagtgtaagagtaagttgttggacgagtgaagatatatttgaaagaagtgaattaatacattgggtaagacaagcaccaggacaaggattagaatggataggatgggtaaaaacagtgacaggagcagtaaatttcggaagtccaaattttagacatagagtaagtttaacaagagatagagatttatttacagcacatatggatataagaggattaacacaaggagatacagcaacatatttttgtgcaagacaaaaatattatgcaggaggacaaggatggtattttgatttatggggaagaggaacattaatagtagtaagtagtgcaagtacaaaaggaccaagtgtatttccacatgatttaaga

SEQ ID NO: 49512 - RNA, 417 nt, synthetic construct
  misc_feature 1..417: note = derived and/or modified sequence opt6 from anti-HIV-1_HeavyChain
  source 1..417: mol_type = other RNA
caagcgcatttagaacaaagtggaagtggagtaaaaaaaccaggagcaagtgtaagagtaagttgttggacaagtgaagatatatttgaaagaacggaattaatacattgggtaagacaagcaccaggacaaggattagaatggataggatgggtaaaaatagtaagtggagcagtaaattttggaagtccaaattttagacaaagagtaagtttaacaagagatagagatttatttacagcacatatggatataagaggattaacacaaggagatacagcaacatatttttgtgcaagacaaaaatttgaaagaggaggacaaggatggatatttgatttatggggaagaggaacattaatagcagtaagtagcgcaagtacaaaaggaccaagtgtatttccacatgatttaaga

SEQ ID NO: 49513 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagcccaaattttagacatagagtaagtttaacaagagacagaaatttatttacagcacatatggatataagaggattaacacaaggagatacagcaacatatttttgtgcaagacaaaaatttgaaagaggaggacaaggatggtattttgatttatggggaagaggaacattaatagtagtaagtagtgcaagcacaaaaggaccaagtgtatttccacatgatttaaga

SEQ ID NO: 49514 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaaccaggggcaagtgtaagagtaagctgttggacatcagaagatatatttgaaagaacagaattaatacattgggtaagacaagcaccaggacaaggattagaatggataggatgggtaaaaatagtaagtggagcagtaaattttggaagtccaaattttagacaaagagtaagtctaacaagagatagagatttatttacagcacatatggatataagaggactaacacaaggagatacagcaacatatttttgtgcaagacaaaaattttatgcaggaggacaaggatggtattttgatttatggggaagaggaacattaatagtagtaagcagtgcatcaacaaaaggaccaagtgtatttccacatgatttaaga

SEQ ID NO: 49515 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaaccaggagcaagtgtaagagtaagctgttggacaagtgaagatatatttgaaagaacagaattaatacattgggtaagacaagcaccaggacaaggactagaatggataggatgggtaaaaacagtaacaggagcagtaaattatggaagtttaaattttagaagtagaataagtttaacaagagatagagatctatttacagcacatatggatataagaggattaacacaaggagatacagcaacatatttttgtgcaagacaaaaatttgaaagaggaggacaaggatggatatttgatttatggggaagaggaacattaatagcagtaagtagtgcaagtacaaaaggaccaagtgtatttccacatgatttaaga

SEQ ID NO: 49516 - RNA, 417 nt, synthetic construct
  misc_feature 1..417: note = derived and/or modified sequence opt6 from anti-HIV-1_HeavyChain
  source 1..417: mol_type = other RNA
caaagtcatttagaacaatcaggaagcgcaatgaaaaaacctggagcatcagtaagagtatcatgttggacatcagaagatatatttgatacaacagaattaatatattgggtaagacaagcaccaggacaaggattagaatggataggatgggtaaaaatagtaagtggaacagtaaactttgcatcattagattttagaaatagaataagtttatcaagagatagagatttaagtacagcacatatggatataagaggattaacacaaggagatacagcaacatatttttgtgcaagacaaaaattttatgcaggaggacaaggatggtattttgatttatggggaagaggaacattaatagtagtaagttcagcatcaacaaaaggaccaagtgtatttccacatgatttaaga

SEQ ID NO: 49517 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaaccaggagcaagtgtaagagtaagttgttggacaagtgaagatatatttgaaagaatagaactaatacattgggtaagacaagcaccaggacaaggattagaatggataggatgggtaaaaacagtaacaggagcagtaaattttggaagtccaaattttagacatagagtaagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagtgcaagcacaaaaggaccaagtgtatttccacatgatctaaga

SEQ ID NO: 49518 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaattaggagcaagcgtaagagtaagttgttggacaagcgaagatatatttgaaagaacagaattaatacattgggtaagacaagcaccaggacaaggattagaatggataggatgggtaaaagcagtaagtggagcagtaaattatggaagtttagattttagacaaagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagttcagcaagtacaaaaggaccaagtgtatttccacatgatttaaga

SEQ ID NO: 49519 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagcggagtaaaaaaaccaggagcaagcgtaagagtaagttgttggagtagtgaagatatatttgaaagagcagaattaatacattgggtaagacaagcaccaggacaaggattagaatggataggatgggtaaaaacagtaacaggagcagtaaattttggaagtccaaattttagacaaagagtaagtttaacaagagatagagatttatttacagcacatatggatataagaggattaacacaaggagatacagcaacatatttttgtgcaagacaaaaatttgaaagaggaggacaaggatggatatttgatttatggggaagaggaacattaatagcagtaagtagtgcaagtacaaaaggaccaagtgtatttccacatgatttaaga

SEQ ID NO: 49520 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagcggaagtggagtaaaaaaaccaggagcaagtgtaagagtaagctgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagtttaacaagagatagagatttatttacagcacatatggatataagaggattaacacaagatgatacagcaacatatttttgtgcaagacaaaaatttgcaagaggagatcaaggatggttttttgatttatggggaagaggaacattaatagtagtaagtagtgcaagtacaaaaggaccaagtgtatttccgcatgatttaaga

SEQ ID NO: 49521 - RNA, 417 nt, synthetic construct
  misc_feature 1..417: note = derived and/or modified sequence opt6 from anti-HIV-1_HeavyChain
  source 1..417: mol_type = other RNA
caaagtcatttagaacaaagtggaagtgcaatgaaaaaaccaggagcaagtgtaagagtaagttgttggacaagtgaagatatatttgatacaacagaattaatatattgggtaagacaagcaccaggacaaggattagaatggataggatgggtaaaaatagtaagtggaacagtaaattttgcaagcttagattttagaaatagaataagtttaagtagagatagagatttaagtacagcacatatggatataagaggactaacacaagatgatacagcaacatatttttgtgcaaggcaaaaatttgaaagaggaggacaaggatggtattttgatttatggggaagaggaacattaatagtagtaagtagtgcaagtacaaaaggaccaagtgtatttccacatgatttaaga

SEQ ID NO: 49522 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaatcaggatcaggagtaaaaaaaccaggagcatcagtaagagtatcatgttggagttcagaagatatatttgaaagaacagaattaatacattgggtaagacaagcaccaggacaaggactagaatggataggatgggtaaaaacagtaacaggagcagtaaattttggatcactagattttagacatagaatatcattaacaagagatagagatttatttacagcacatatggatataagaggactaacacaaggagatacagcaacatatttttgtgcaagacaaaaattttatgcaggaggacaaggatggtattttgatttatggggaagaggaacattaatagtagtaagttcagcatcaacaaaaggaccaagcgtatttccacatgatttaaga

SEQ ID NO: 49523 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaatcaggatcaggagtaaaaaaaccaggagcatcagtaagagtaagctgttggacaagcgaagatatatttgaaaaaagtgaattaatacattgggtaagacaagcaccaggacaaggattagaatggataggatgggtaaaaacagtaacaggagcagtaaattttggaagtagtgattttagacaaagagtaagtttaacaagagatagagatttatttacagcacatatggacataagaggattaacacaagatgatacagcaatatatttttgtgcaagacaaaaatttgcaagaggagatcaaggatggttttttgatttatggggaagaggaacattaatagtagtaagtagtgcaagtacaaaaggaccaagtgtatttccgcatgatttaaga

SEQ ID NO: 49524 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaggaccaggagcaagtgtaagagtaagttgttggacaagtgaagatatatttgaaacaacagaattaatacattgggtaagacaagcaccaggacaaggattagaatggataggatgggtaaaaacagtaagtggagcagtaaattttggaagtttaaattttagacatagagtatcattaacaagagatagagatttatttacagcacatatggatataagaggattaacacaaggagatacagcaacatatttttgtgcaagacaaaaatttgcaagaggagatcaaggatggttttttgatttatggggaagaggaacactaatagtagtaagtagtgcaagtacaaaaggaccaagtgtatttccacacgatttaaga

SEQ ID NO: 49525 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagcggaagtggagtaaaaaaaccaggagcaagtgtaagagtaagttgttggacaagtgaagatatatttgaaggaagtgaattaatacattgggtaagacaagcaccaggacaaggattagaatggatagggtgggtaaaaacagtaacaggagcagtaaattttggaagtgcatattttagacatagagtaccattaacaagagatagagatttatttacagcacatatggatataagaggattaacacaaggagatacagcaacatatttttgtgcaagacaaaaattttataaaggaggacaaggatggtattttgatttatggggaagaggaacattaatagtagtaagtagtgcaagtacaaaaggaccaagtgtatttccacatgatttaaga

SEQ ID NO: 49526 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaaccaggagcaagtgtaagagtaagctgttggacaagtgaagatatatttgaaagaacagaattaatacattgggtaagacaagcaccagggcaaggactagaatggataggatgggtaaaaacagtaacaggagcagtaaattttggaagcccgaattttagacatagagtaagcttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagtgcaagtacaaaaggaccaagtgtatttccacatgatttaaga

SEQ ID NO: 49527 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaagtaggagcaagtgtaagagtaagttgttggacaagcgaagatatatttgaaagaacagaattaatacattgggtaagacaagcaccaggacaaggattagaatggataggatgggtaaaagcagtaagtggagcagtaaattatggaagtttagattttagacatagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtgagtagtgcaagtacaaaaggaccaagtgtatttccacatgatttaaga

SEQ ID NO: 49528 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagtccaaattttaggcatagagtaagtttaacaagagatagagatttatttacagcacatatggatataagaggattaacacaagatgatacagcaacatatttttgtgcaagacaaaaatttgcaagaggagatcaaggatggttttttgatttatggggaagaggaacattaatagtagtaagtagtgcatcaacaaaaggaccaagtgtatttccacatgatttaaga

SEQ ID NO: 49529 - RNA, 417 nt, synthetic construct
  misc_feature 1..417: note = derived and/or modified sequence opt6 from anti-HIV-1_HeavyChain
  source 1..417: mol_type = other RNA
caaagtcatttagaacaaagtggaagtgcaatgaaaaaaccaggagcaagtgtaagagtaagttgttggacaagtgaagatatatttgaaagaacagaattaatatattgggtaagacaagcaccaggaagaggattagaatggataggatgggtaaaaacagtaagtggaacagtaaattttggaagcagtgattttagaaatagaataagtctaacaagagatagagatttaagtacagcacatatggatataagagggttaacacaagatgatacagcaacatatttttgtgcaagacaaaaatttgcaagaggagatcaaggatggttttttgatttatggggaagaggaacattaatagtagtaagtagtgcaagtacaaaaggaccaagcgtatttccacatgatttaaga

SEQ ID NO: 49530 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtgaaagtggagtaaaaaaattaggagcaagtgtaagagtaagctgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagtttaacaagagatagagatctatttacagcacatatggatataagaggattaacacaagatgatacagcaacatatttttgtgcaagacaaaaatttgcaagaggagatcaaggatggttttttgatctatggggaagaggaacattaatagtagtaagtagtgcaagtacaaaaggaccaagtgtatttccacatgatttaaga

SEQ ID NO: 49531 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaaccaggagcaagtgtaagagtaagttgttggacaagtgaagatatatttgaaaaaagtgaattaatacattgggtaagacaagcaccaggacaaggattagaatggataggatgggtaaaaacagtaacaggagcagtaaattttggaagtagtgattttagacaaagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagcgcaagtacaaaaggaccaagtgtatttccaacaacattaaga

SEQ ID NO: 49532 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagcggagtaaaaaaagtaggagcaagtgtaagagtaagctgttggacaagtgaagatatatttgaaagaacagaattaatacattgggtaagacaagcaccaggacaaggattagaatggataggatgggtaaaaacagtaacaggagcagtaaattttggaagtagtgattttagacaaagagtaagtttaacaagagatagagatctatttacagcacatatggatataagaggattaacacaaggagatacagcaacatatttttgtgcaagacaaaaattttatgcaggaggacaaggatggtattttgatttatggggaagaggaacattaatagtagtaagtagtgcgagtacaaaaggaccaagtgtatttccacatgatttaaga

SEQ ID NO: 49533 - RNA, 420 nt, synthetic construct
  misc_feature 1..420: note = derived and/or modified sequence opt6 from anti-HIV-1_HeavyChain
  source 1..420: mol_type = other RNA
caagcaagaccaggagcaaatagaggatcaggagtaaaaaaaccaggagcatcagtaagagtaagttgttggacatcagaagatatatttgaaagaacagaattaatacattgggtaagacaagcaccaggacaaggattagaatggataggatgggtaaaaatagtaagtggagcagtaaattttggatcaccaaattttagacaaagagtatcattaacaagagatagagatttatttacagcacatatggatataagaggattaacacaaggagatacagcaacatatttttgtgcaagacaaaaatttgaaaggggaggacaaggatggatatttgatttatggggaagaggaacattaatagccgtaagttcagcatcaacaaaaggaccatcagtatttccacatgatttaaga

SEQ ID NO: 49534 - RNA, 417 nt, synthetic construct
  misc_feature 1..417: note = derived and/or modified sequence opt6 from anti-HIV-1_HeavyChain
  source 1..417: mol_type = other RNA
caagcacatctagaacaaagcggaagtggagtaaaaaaaccaggagcaagtgtaagagtaagttgttggacaagtgaagatatatttgaaagaagtgaattaatacattgggtaagacaagcaccaggacaaggattagaatggataggatgggtaaaaacagtaacaggagcagtaaattttggaagtccaaattttagacatagagtaagcctaacaagagatagagatttatttacagcacatatggatataagaggactaacacaaggagatacagcaacatatttttgtgcaagacaaaaatattatgcaggtggacaaggatggtattttgatttatggggaagaggaacattaatagtagtaagtagtgcaagtacaaaaggaccaagtgtatttccacatgatttaaga

SEQ ID NO: 49535 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaaccaggagcaagtgtaagagtaagttgttggacaagtgaagatatatttgaaggaagtgaattaatacattgggtaagacaagcaccaggacaaggattagaatggataggatgggtaaaaacagtaacaggagcagtaaattttggaagtgcatattttagacatagagtaagtttaacaagagatagagatttatttacagcacatatggatataagaggattaacacaaggagatacagcaacatatttttgtgcaagacaaaaattttataaaggaggacaaggatggtattttgatttatggggaagaggaacattaatagtagtaagtagtgcaagcacaaaaggaccaagtgtgtttccacatgatttaaga

SEQ ID NO: 49536 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaattaggagcatcagtaagagtaagctgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagtttaacaagagatagagatttaagtacagcacatatggatataagaggattaacacaagatgatacagcaacatatttttgtgcaagacaaaaatttgcaagaggagatcaaggatggttttttgatttatggggaagaggaacactaatagtagtaagtagcgcaagtacaaaaggaccaagtgtattaccaccaagaagtgca

SEQ ID NO: 49537 - RNA, 417 nt, synthetic construct
  misc_feature 1..417: note = derived and/or modified sequence opt6 from anti-HIV-1_HeavyChain
  source 1..417: mol_type = other RNA
caagcacatctagaacaatcaggatcaggaatgaaaaaaccaggagcatcagtaagagtatcatgttggagtagtgaagatatatttgaaagaacagaattaatacattgggtaagacaagcaccaggacaaggattagaatggataggatgggtaaaaacagtaacaggagcagtaaattttggatcaagtgattttagacaaagagtatcattaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagttcagcatcaacaaaaggaccaagtgtatttccacatgatttaaga

SEQ ID NO: 49538 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaagaaccaggaacaagtgtaagagtaagctgttggacaagtgaagatatatttgaaagaacagaattaatacattgggtaagacaagcaccaggacaaggattagaatggataggatgggtaaaaacagtaacgggagcagtaaattttggaagtccaaattttagacatagagtaagtttaacaagagacagagacctatttacagcacatatggatataagaggattaacacaaggagatacagcaacatatttttgtgcaagacaaaaatttgaaagaggaggacaaggatggatatttgatttatgggggagaggaacactaatagcagtaagtagtgcaagcacaaaaggaccatcagtatttccacaaacattaaga

SEQ ID NO: 49539 - RNA, 417 nt, synthetic construct
  misc_feature 1..417: note = derived and/or modified sequence opt6 from anti-HIV-1_HeavyChain
  source 1..417: mol_type = other RNA
caaagtcatttagaacaatcaggatcagcaatgaaaaaaccaggagcatcagtaagagtatcatgttggacaagtgaagatatatttgatacaacagaattaatatattgggtaagacaagcaccaggacaaggattagaatggataggatgggtaaaaatagtaagtggaacagtaaattttgcatcattagattttagacatagagtatcattaacaagagatagagatttatcaacagcacatatggatataagagggctaacacaagatgatacagcaacatatttttgtgcaagacaaaaatttgcaagaggagatcaaggatggttttttgatttatggggaagaggaacactaatagtagtaagttcagcttcaacaaaaggaccaagtgtatttccacatgatttaaga

SEQ ID NO: 49540 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagcggagtaaaaaaaccaggagcaagtgtaagagtgagttgttggacaagtgaagatatatttgaaacaacagaattaatacattgggtaagacaagcaccaggacaaggattagaatggataggatgggtaaaaacagtaagtggagcagtaaattttggaagtttaaattttagacatagagtaagtttaacaagagatagagatttatttacagcacatatggatataagaggattaacacaaggagatacagcaacatatttttgtgcaagacaaaaatttgcaagaggagatcaaggatggttttttgatttatggggaagaggaacattaatagtagtaagtagcgcaagtacaaaaggaccaagtgtatttccacatgatttaaga

SEQ ID NO: 49541 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaagtaggagcatcagtaagagtaagttgttggacaagtgaagatatatttgaaagaacagaattaatacattgggtaagacaagcaccaggacaaggattagaatggataggatgggtaaaaacagtaacaggagcagtaaattttggaagtccaaattttagacatagagtaagtttaacaagagacagagatttatttacagcacatatggatataagaggattaacacaaggagatacagcaacatatttttgtgcaagacaaaaatttgaaagaggaggacaaggatggtattttgatttatggggaagaggaacattaatagtagtaagtagcgcaagtacaaaaggaccaagtgtatttccacatgatctaaga

SEQ ID NO: 49542 - RNA, 417 nt, synthetic construct
  misc_feature 1..417: note = derived and/or modified sequence opt6 from anti-HIV-1_HeavyChain
  source 1..417: mol_type = other RNA
caggcacatttagaacaaagtggagcaggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaagtggagcagtaaattttggaagtccaaattttagacatagagtaagcttaacaagagatagagatttatttacagcacatatggatataagaggattaacacaaggagatacagcaacatatttttgtgcaagacaaaaatttgaaagaggaggacaaggatggtattttgatttatggggaagaggaacactaatagtagtaagtagcgcaagcacaaaaggaccaagtgtatttccacatgatttaaga

SEQ ID NO: 49543 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaaccaggggcaagtgtaagagtaagttgttggacaagtgaagatatatttgaaagaacagaattaatacattgggtaagacaagcaccaggacaaggactagaatggataggatgggtaaaaacagtaacaggagcagtaaattacggaagtttaaattttagaagtagaataagtttaacaagagatagagatttatttacagcacatatggatataagaggattaacagaaggagatacagcaacatatttttgtgcaagacaaaaattttatgcagggggacaaggatggtattttgatttatggggaagaggaacattaatagtagtaagtagtgcaagtacaaaaggaccaagtgtatttccacatgatttaaga

SEQ ID NO: 49544 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagcggagtaaaaaaaccaggagcaagcgtaagagtaagctgtttagcaagtgaagatatatttgaaagaacagaattaatacattgggtaagacaagcaccaggacaaggattagaatggataggatgggtaaaaacagtaacaggagcagtaaattttggaagtccaaattttagacatagagtaagtttaacaagagacagagacttatttacagcacatatggatataagaggattaacacaaggagatacagcaacatatttttgtgcaagacaaaaatttgaaagaggaggacaaggatggtattttgatttatggggaagaggaacattaatagtagtaagtagcgcaagcacaaaaggaccaagtgtatttccacatgatctaaga

SEQ ID NO: 49545 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaaccaggagcaagtgtaagagtaagttgttggagtagtgaagatatatttgaaagaacagaattaatacattgggtaagacaagcaccaggacaaggattagaatggataggatgggtaaaaacagtaacaggagcagtgaattttggaagtttagattttagacataggataagtttaacaagagatagagatttatttacagcacatatggatataagaggattaacacaaggagatacagcaacatatttttgtgcaagacaaaaatttgaaagaggaggacaaggatggatatttgatttatggggaagaggaacattaatagcagtaagtagtgcaagtacaaaaggaccaagtgtatttccacatgatttaaga

SEQ ID NO: 49546 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagcggagtaaaaaaaccaggagcaagtgtaagagtaagttgttggacaagtgaagatatatttgaaagaacagaattaatacattgggtaagacaagcaccaggacaaggattagaatggataggatgggtgaaaacagtaacaggagcagtaaattttggaagtccaaattttagacaaagagtaagcttaacaagagacagagatttatttacagcacatatggatataagaggactaacacaaggagatacagcaacatatttttgtgcaagacaaaaatttgaaagaggaggacaaggatggtattttgatttatggggaagaggaacattaatagtagtaagtagtgcaagtacaaaaggaccaagtgtatttccacatgatttaaga

SEQ ID NO: 49547 - RNA, 417 nt, synthetic construct
  misc_feature 1..417: note = derived and/or modified sequence opt6 from anti-HIV-1_HeavyChain
  source 1..417: mol_type = other RNA
caagtacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagtccaaactttagacatagagtaagcttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagtgcaagtacaaaaggaccaagtgtatttccacatgatttaaga

SEQ ID NO: 49548 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagcggaagtggagtaaaaaaaccaggagcaagtgtaagagtaagttgttggacaagtgaagatatatttgaaagaacggaattaatacattgggtaagacaagcaccaggacaaggactagaatggataggatgggtgaaaacagtaagtggagcagtaaattttggaagtccaaattttagacaaagagtaagtttaacaagagatagagatttatttacagcacatatggatataagaggattaacacaaggagatacagcaacatatttatgtgcaagacaaaaatttgaaagaggaggacaaggatggatatttgatttatggggaaggggaacattaatagcagtaagcagtgcaagtacaaaaggaccaagtgtatttccacatgatttaaga

SEQ ID NO: 49549 - RNA, 417 nt, synthetic construct
  misc_feature 1..417: note = derived and/or modified sequence opt6 from anti-HIV-1_HeavyChain
  source 1..417: mol_type = other RNA
caaagtcatttagaacaatcaggatcagcaatgaaaaaaccaggagcaagtgtaagagtaagttgttggacatcagaagatatatttgaaaggacagaactaatatattgggtaagacaagcaccaggaagaggattagaatggataggatgggtaaaaacagtaagcggaacagtaaattttggaagtagtgattttagacatagagtaagtttaacaagagatagagatttatttacagcacatatggatataagaggattaacacaaggagatacagcaacatatttttgtgcaagacaaaaattttataaaggaggacaaggatggtattttgatttatggggaagaggaacattaatagtagtaagttcagcaagtacaaaaggaccaagtgtgtttccacatgatttaaga

SEQ ID NO: 49550 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaatcaggatcaggagtaaaaaaaccaggagcatcagtaagagtatcatgttggacaagtgaagatatatttgaaaaaagtgaattaatacattgggtaagacaagcaccaggacaaggattagaatggataggatgggtaaaaacagtaacaggagcagtaaattttggatcaagtgattttagacaaagagtatcattaacaccagatagagatttatttacagcacatatggatataagaggattaacacaaggagatacagcaacatatttttgtgcaagacaaaaattttatgcaggaggacaaggatggtattttgatttatggggaagaggaacattaatagtagtaagttcagcatcaacaaaaggatcaagtgtatttccacatgatttaaga

SEQ ID NO: 49551 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaatcaggatcaggagtaaaaaaaccaggagcatcagtaagagtatcatgttggacatcagaagatatatttgaaaaaagtgaattaatacattgggtaagacaagcaccaggacaaggattagaatggataggatgggtaaaaacagtaacaggagcagtaaattttggatcaagtgattttagacaaagagtatcattaacaccagatagagatctatttacagcacatatggatataagaggattaacacaaggagatacagcaacatatttttgtgcaagacaaaaattttatgcaggaggacaaggatggtattttgatttatggggaagaggaacattaatagtagtaagttcagcatcaacaaaaggaccaagtgtatttccacatgatttaaga

SEQ ID NO: 49552 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaattaggagcaagtgtaagagtaagctgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagtttaacaagagatagagatctaagtacagcacatatggatataagaggattaacacaagatgatacagcaacatatttttgtgcaagacaaaaatttgcaagaggagatcaaggatggttttttgatttatggggaagaggaacattaatagtagtaagtagcgcaagtacaaaaggaccaagtgtatttccacatgatttaaga

SEQ ID NO: 49553 - RNA, 417 nt, synthetic construct
  misc_feature 1..417: note = derived and/or modified sequence opt6 from anti-HIV-1_HeavyChain
  source 1..417: mol_type = other RNA
caagtacatttagaacaaagcggaagcggagtaaaaaaattaggagcaagcgtaagagtaagttgttggacatcagaagatatatttgaaagaacagaattaatacattgggtaagacaagcaccaggacaaggattagaatggataggatgggtaaaagcagtaagcggagcagtaaattatggaagtttagattttagacatagagtaagtttaacaagagatagagatttatttacagcacatatggatataagaggattaacacaagatgatacagcaacatatttttgtgcaagacaaaaatttgcaagaggagatcaaggatggttttttgatttatggggaagaggaacactaatagtagtaagttcagcaagtacaaaaggaccaagtgtatttccacatagaagtaca

SEQ ID NO: 49554 - RNA, 420 nt, synthetic construct
  misc_feature 1..420: note = derived and/or modified sequence opt6 from anti-HIV-1_HeavyChain
  source 1..420: mol_type = other RNA
caagtatatatggaacaagcaggagcaggagtaaaaaaaccaggagcaagtgtaacattaagttgtaaaacagcagatgaagatgtatttgatgcagcatatatgcattgggtaagacaagcaccaggacaaacatttgaatggttaggatggatgaaaccagtaacaggagcagtaagttatgcaagaaaatttcaaggaagagtaagtttttatatgacaagagaattaggaatggcatatatggatttaagaaatttaagatttgatgatacagcagtatatttttgtgcaagaaaaacagcaggagatgtaagtggagataatagaggatatttttttgatttatggggaagaggaagtagagtaatagtaagtagtgcaagtacaaaaggaccaagtgtatttacaatatatgta

SEQ ID NO: 49555 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaattaggagcaagtgtaagagtaagttgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagtttaacaagagatagagatttatttacagcacatatggatataagaggattaacacaagatgatacagcaacatatttttgtgcaagacaaaaatttgcaagaggagatcaaggatggttttttgatttatggggaagaggaacattaatagtagtaagtagcgcaagtacaaaaggaccaagtgtatttccacatgatccagca

SEQ ID NO: 49556 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaatcaggaagtggagtaaaaaaactaggagcaagtgtaagagtaagttgttggacaagtgaagatatatttgaaagaacagaattaatacattgggtaagacaagcaccaggacaaggactagaatggataggatgggtaaaagcagtaagtggagcagtaaattatggaagcttagattttagacatagagtaagtttaacaagagatagagatttaagtacagcacatatggatataagaggattaacacaagatgatacagcaacatatttttgtgcaagacaaaaatttgcaagaggagatcaaggatggttttttgatttatggggaagaggaacattaatagtagtaagtagtgcaagtacaaaaggaccaagtgtattaccaccaagaagtaca

SEQ ID NO: 49557 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaaccaggagcaagtgtaagagtaagctgttggtcaagtgaagatatatttgaaagaacagaattaatacattgggtaagacaagcaccaggacaaggattagaatggataggatgggtaaaagcagtaagtggagcagtaaattatggaagtttagattttagacatagagtaagcttaacaagagatagagatttatttacagcacatatggatataagaggactaacacaagatgatacagcaacatatttttgtgcaagacaaaaatttgcaagaggagatcaaggatggttttttgatttatggggaagaggaacattaatagtagtaagtagtgcaagtacaaaaggaccaagtgtatttccacatgatttaaga

SEQ ID NO: 49558 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtgaatggaaaaaattaggagcaagtgtaagagtaagttgttggacaagcgaagatatatttgaaagaacagaattaatacattgggtaagacaagcaccaggacaaggattagaatggataggatgggtaaaagcagtaagtggagcagtaaattatggaagcttagattttagacatagagtaagcttaacaagagatagagatttaagtacagcacatatggatataagaggattaacacaagatgatacagcaacatatttttgtgcaagacaaaaatttgcaagaggagatcaaggatggttttttgatctatggggaagaggaacattaatagtagtaagtagtgcaagtacaaaaggacctagtgtatttccacatgatttaaga

SEQ ID NO: 49559 - RNA, 417 nt, synthetic construct
  misc_feature 1..417: note = derived and/or modified sequence opt6 from anti-HIV-1_HeavyChain
  source 1..417: mol_type = other RNA
caagcacatctagaacaaagtggatcagaagtaaaaaaaccaggagcatcagtaagagtatcatgttggacatcagaagatatatttgaaaaaagcgaattaatacattgggtaagacaagcacctggacaaggactagaatggataggatgggtaaaaacagtaacaggagcagtaaattttggatcaagtgattttagacaaagagtatcattaacaagagatagagatttatttacagcacatatggatataagaggattaacacaaggagatacagcaacatatttttgtgcaagacaaaaattttatgcaggaggacaaggatggtattttgatttatggggaagaggaacactaatagtagtaagttcagcatcaacaaaaggaccaagtgtatttccacatgatttaaga

SEQ ID NO: 49560 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaattaggagcaagtgtaagagtaagttgttggacgagcgaagatatatttgaaagaacagaattaatacattgggtaagacaagcaccaggacaaggattagaatggataggatgggtaaaaacagtaacaggagcagtaaattttggaagtccaaattttagacatagagtaagtttaacaagagacagagatttatttacagcacatatggatataagaggattaacacaaggagatacagcaacatatttttgtgcaagacaaaaatttgaaagaggaggacaaggatggtattttgatttatggggaagaggaacattaatagtagtatcaagtgcaagtacaaaaggaccaagtgtatttccacatgatttaaga

SEQ ID NO: 49561 - RNA, 417 nt, synthetic construct
  misc_feature 1..417: note = derived and/or modified sequence opt6 from anti-HIV-1_HeavyChain
  source 1..417: mol_type = other RNA
caagcacatcttgaacaaagtggaagtggagtaaaaaaaccaggagcaagtgtaagagtaagttgttggacaagtgaagatatattaagaaaaagtgaactaatacattgggtaagacaagcaccaggacaaggactagaatggataggatgggtaaaaacagtaacaggagcagtaaattttggaagtagtgattttagacaaagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagtgcatcaacaaaaggaccgagtgtatttccacatgatttaaga

SEQ ID NO: 49562 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtgcaagcggagtaaaaagaccaggagcaagtgtaagagtaagctgtctagcaagtgaagatatatttgaaagaagtgaattaatatattgggtaagacaagcaccaggacaaggattagaatggataggatgggtaaaaatagtaagtggagcagtaaatttcggaagtccaaattttagacaaagagtaagtctaacaagagacagagacttatttacagcacatatggatataagaggactaacacaaggagatacagcaacatatttttgtgcaagacaaaaatttgaaagaggaggacaaggatggatatttgatttatggggaagaggaacattaatagcagtaagtagtgcaagtacaaaaggaccatcagtatttccacatgacttaaga

SEQ ID NO: 49563 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaagaccaggagcatcggtaagagtaagttgttggacaagtgaagatatatttgaaacaacagaattaatacattgggtaagacaagcaccaggacaaggattagaatggataggatgggtaaaaacagtaacaggagcagtaaattttggaagcgcatattttagacatagagtaagtttaacaagagatagagatttatttacagcacatatggatataagaggattaacacaaggagatacagcaacatatttttgtgcaagacaaaaattttataaaggaggacaaggatggtattttgatttatggggaagaggaacattaatagtagtaagcagtgcaagtacaaaaggaccaagtgtatttccacatgatttaaga

SEQ ID NO: 49564 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtgcaagtggagtaaaaagaccaggagcaagtgtaagagtaagttgttggacaagtgaagatatatttgaaagaagtgaattaatatattgggtaagacaagcaccaggacaaggattagaatggataggatgggtaaaaacagtaagtggagcagtaaattttggaagtacagattttagacatagagtaagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagtgcaagtacaaaaggaccaagtgtatttccacatgatttaaga

SEQ ID NO: 49565 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaattaggagcaagtgtaagagtaagttgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagtttaacaagagatagagatttaagtacagcacatatggatataagaggattaacgcaagatgatacagcaacatatttttgtgcaaggcaaaaatttgcaagaggagatcaaggatggttttttgatttatggggaagaggaacattaatagtagtaagtagtgcaagtacaaaaggaccaagtggattaccaccaagaagtgca

SEQ ID NO: 49566 - RNA, 417 nt, synthetic construct
  misc_feature 1..417: note = derived and/or modified sequence opt6 from anti-HIV-1_HeavyChain
  source 1..417: mol_type = other RNA
caaagtcatttagaacaaagtggaagtgcaatgaaaaaaccaggagcaagtgtaagagtaagttgttggacaagtgaagatatatttgatacaacagaattaatatattgggtaagacaagcaccaggacaaggattagaatggataggatgggtaaaaatagtaagtggaacagtaaattttgcaagtttagattttagaaatagaataagtttaagtagagatagagatttaagtacagcacatatggatataagaggattaacacaaggagatacagcaacatatttttgtgcaagacaaaaatttgaaagaggaggacaaggatggatatttgatctatggggaagaggaacattaatagcagtaagtagtgcaagtacaaaaggaccaagtgtatttccattaagaagtgca

SEQ ID NO: 49567 - RNA, 423 nt, synthetic construct
  misc_feature 1..423: note = derived and/or modified sequence opt6 from anti-HIV-1_HeavyChain
  source 1..423: mol_type = other RNA
caagtacaaatggaacaagcaggagcaggaatgaaaaaaccaggagcaagtatgacagtaagctgtaaaacagcagatgaagatatatttgatgcagcatatatgcattgggtaagacaagcaccaggacaaacatttgaatggttaggatggatgaaaccagtaacaggagcagtaaattatgcaagacaatttcaaggaagagcaagtttttatagaacaagagaattaggaatagcatatatggatttaagagatttaaaatttgatgatacagcagtatatttttgtgcaagaaaaacaaaaggagatgtaagtggagatgatagaggatttttttttgatttatggggaagaggaacaagagtaatagtatcaagtgcaagtacaaaaggaccaagtgtatttccacatgatttaaga

SEQ ID NO: 49568 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaaccaggagcaagtgtaagagtaagttgttggagtagcgaagatatatttgaaagaacagaattaatacattgggtaagacaagcaccaggacaaggattagaatggataggatgggtaaaaacagtaacaggagcagtaaattttggaagcttagattttagacatagaataagtttaacaagagatagagatttatttacagcacatatggatataagaggattaacacaaggagatacagcaacatatttttgtgcaagacaaaaattttataaaggaggacaaggatggtattttgatttatggggaagaggaacgttaatagtagtaagtagcgcaagtacaaaaggaccaagtgtatttccacaaatatgtaga

SEQ ID NO: 49569 - RNA, 414 nt, synthetic construct
  misc_feature 1..414: note = derived and/or modified sequence opt6 from anti-HIV-1_HeavyChain
  source 1..414: mol_type = other RNA
caagcacatttagaacaaagtggagcaggagtaaaaaaaccaggagcaagtgtaagagtaagctgttggacaagcgaagatatatttgaaaaatcagaattaatacattgggtaagacaagcaccaggacaaggattagaatggataggatgggtaaaaacagtaacaggagcagtaaatttagtacatcaaatatcagacagagtatcactaacaagagatagagatttatcaacagcacatatggacataagaggactaacacaagatgacacagcaacatatttttgtgcaagacaaaaatttgcaagaggagatcaaggatggtttttcgatttatggggaagaggaacattaatagtagtaagttcagcatcaacaaaaggaccaagcgtatttccacatgatttaaga

SEQ ID NO: 49570 - RNA, 420 nt, synthetic construct
  misc_feature 1..420: note = derived and/or modified sequence opt6 from anti-HIV-1_HeavyChain
  source 1..420: mol_type = other RNA
caagcacatttagaacaaagtggaagcggagtaaaaaaattaggagcaagtgtaagagtaagttgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagtttaacaagagatagagatttaagtacagcacatatggatataagaggattaacacaagatgatacagcaacatatttttgtgcaagacaaaaatttgcaagaggagatcaaggatggttttttgatttatggggaagaggaacattaatagtagtaagtagtgcaagtacaaaaggaccaagcgggttaccaccaagactatgtgta

SEQ ID NO: 49571 - RNA, 417 nt, synthetic construct
  misc_feature 1..417: note = derived and/or modified sequence opt6 from anti-HIV-1_HeavyChain
  source 1..417: mol_type = other RNA
caagcaagattagaacaaagtggaagtggagtaaaaaaaccaggagcaagtgtaagagtaagttgttggacaagtgaagatatatttgaaggaagtgaattaatacattgggtaagacaagcaccaggacaaggattagaatggataggatgggtaaaaacagtaacaggagcagtaaattttggaagtgcatattttagacatagagtaagtttaacaagagatagagatttatttacagcacatatggatataagaggattaacacaaggagatacagcaacatatttttgcgcaagacaaaaatttgcaagaggagatcaaggatggttttttgatttatggggaagaggaacattaatagtagtaagtagtgcaagtacaaaaggaccaagtgtatttccacatgatagtgca

SEQ ID NO: 49572 - RNA, 414 nt, synthetic construct
  misc_feature 1..414: note = derived and/or modified sequence opt6 from anti-HIV-1_HeavyChain
  source 1..414: mol_type = other RNA
caagtacaattagtacaaagtggagcagaagtaaaaaaaccaggaagtagtgtaaaagtaagttgtaaagtaagtggaggagtatttacaagttatgcagtaacatgggtaagacaagcaccaggacaaggattagaatggataggatgggtaaaagcagtaagcggagcagtaaattatggatcattagattttagacatagagtatcattaacaagagatagagatttatttacagcacatatggatataagaggattaacacaagatgatacagctatatatttttgtgcaagacaaaaatttgcaagaggagatcaaggatggttttttgatttatggggaagaggaacattaatagtagtaagttcagcatcaacaaaaggaccaagtgtatttccacatgatttaaga

SEQ ID NO: 49573 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaagtggggcagtaaattttggaagtccaaattttagacaaagagtaagtttaacaagagatagagatttatttacagcacatatggatataagaggattaacacaaggagatacagcaacatatttttgtgcaagacaaaaatttgaaagaggaggacaaggatggatatttgatttatggggaagaggaacattaatagcagtaagtagtgcaagtacaaaaggaccaagtgtatttccacatgatttaaga

SEQ ID NO: 49574 - RNA, 417 nt, synthetic construct
  misc_feature 1..417: note = derived and/or modified sequence opt6 from anti-HIV-1_HeavyChain
  source 1..417: mol_type = other RNA
caaagtcatttagaacaatcaggatcagcaatgaaaaaaccaggagcatcagtaacagtatcatgctggacaagtgaagatatatttgatacaacagaattaatatactgggtaagacaagcaccaggacaaggactagaatggataggatgggtaaaaatagtaagtggaacagtaaactttgcatcactagatttcagaaacagaatatcactatcaagagatagagatttatcaacagcacacatggacataagaggattaacacaagatgacacagcaacatacttttgtgcaagacaaaaatttgcatcaagatatagcggagaccaaggaagttactttgacttatggggaagaggaacattaataatagtatcaagtgcaagtacaaaaggaccatcagacgatctaaga

SEQ ID NO: 49575 - RNA, 414 nt, synthetic construct
  misc_feature 1..414: note = derived and/or modified sequence opt6 from anti-HIV-1_HeavyChain
  source 1..414: mol_type = other RNA
caagtacaattagtacaaagtggagcagaagtaaaaaaaccaggagcaagtgtaaaagtaagttgtaaatcaagtggatattcatttacaagatttgatataacatgggtaagacaagcaccaggacaaggattagaatggataggatgggtaaaaacagtaagtggagcagtaaattttggatcactaaattttagacatagagtatcattaacaagagatagagatttatttacagcacatatggatataagaggattaacacaaggagatacagcaacatatttttgtgcaagacaaaaatttgcaagaggagatcaaggatggttttttgatttatggggaagaggaacattaatagtagtaagctcagcatcaacaaaaggaccaagtgtatttccacatgatttaaga

SEQ ID NO: 49576 - RNA, 420 nt, synthetic construct
  misc_feature 1..420: note = derived and/or modified sequence opt6 from anti-HIV-1_HeavyChain
  source 1..420: mol_type = other RNA
caagcacatctagaacaaagtggaagtggagtaaaaaaaccaggagcaagtgtaagagtaagttgttggacaagtgaagatatatttgaaaaaagtgaattaatacattgggtaagacaagcaccaggacaaggattagaatggataggatgggtaaaaacagtaacaggagcagtaaattttggaagtagtgattttagacaaagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagtgcaagtacaaaaggaccaatagggttaccaccaagattatgtgta

SEQ ID NO: 49577 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagcggagcgggagtaaaaaaaccaggagcaagtgtaagagtaagctgttggacaagtgaagatatatttgaaagaacagaattaatacattgggtaagacaagcaccaggacaaggactagaatggataggatgggtaaaaacagtaacaggagcagtaaattttggatcaccaaattttagacatagagtaagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagcgcaagtacaaaaggaccaagcgtatttccacatgatttaaga

SEQ ID NO: 49578 - RNA, 420 nt, synthetic construct
  misc_feature 1..420: note = derived and/or modified sequence opt6 from anti-HIV-1_HeavyChain
  source 1..420: mol_type = other RNA
caagcacatttagaacaaagtggaagcggagtgaaaaaattaggagcaagtgtaagagtaagttgttggacaagtgaagacatatttgaaagaacagaattaatacattgggtaagacaagcaccaggacaaggattagaatggataggatgggtaaaagcagtatcaggagcagtaaattatggaagtctagattttagacatagagtaagcttaacaagagatagagatttatttacagcacatatggatataagaggattaacacaagatgatacagcaacatatttttgtgcaagacaaaaatttgcaagaggagatcaaggatggttttttgatttatggggaagaggaacattaatagtagtaagtagtgcaagtacaaaaggaccaagtggaccaagtccagaaatatgtgta

SEQ ID NO: 49579 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggagcaggagtaaaaagaccaggagcaagcgtaagagtaagttgttggacaagtgaagatatatttgaaacaactgaactaatacattgggtaagacaagcaccaggacaaggattagaatggataggatgggtaaaaacagtaagtggagcagtaaattttggaagtttaaattttagacatagagtaagtttaacaagagatagagatttatttacagcacatatggatataagaggattaacacaaggagatacagcaacatatttttgtgcaagacaaaaatttgcaagaggagatcaaggatggttttttgatttatggggaagaggaacattaatagtagtaagtagtgcaagtacaaaaggaccaagtgtatttccacatgatttaaga

SEQ ID NO: 49580 - RNA, 417 nt, synthetic construct
  misc_feature 1..417: note = derived and/or modified sequence opt6 from anti-HIV-1_HeavyChain
  source 1..417: mol_type = other RNA
agagcacatttagaacaaagcggaagtggagtaaaaaaattaggagcaagtgtaagagtaagttgttggacaagtgaagatatatttgaaagaacagaattaatacattgggtaagacaagcaccaggacaaggactagaatggataggatgggtaaaagcagtaagtggagcagcaaattatggaagcccaaattttagacaaagagtaagtttaacaagagacagagacttatttacagcacatatggatataagaggattaacacaaggagatacagcaacatatttttgtgcaagacaaaaatttgaaagaggaggacaaggatggatatttgatttatggggaagaggaacattaatagcagtatcaagcgcaagtacaaaaggaccaagtgtatttccacatgatttaaga

SEQ ID NO: 49581 - RNA, 417 nt, synthetic construct
  misc_feature 1..417: note = derived and/or modified sequence opt6 from anti-HIV-1_HeavyChain
  source 1..417: mol_type = other RNA
caagtacatttagaacaatcaggaagtggagtaaaaaaattaggagcatcagtaagagtatcatgttggacatcagaagatatatttgaaagaacagaattaatacattgggtaagacaagcaccaggacaaggattagaatggataggatgggtaaaagcagtaagtggagcagtaaattatggatcattagattttagacatagagtatcattaacaagagatagagatttatttacagcacatatggatataagaggattaacacaagatgatacagcaacatatttttgtgcaagacaaaaatttgcaagaggagatcaaggatggttttttgatttatggggaagaggaacactaatagtagtaagctcagcatcaacaaaaggaccaagtgtatttccacatgatttaaga

SEQ ID NO: 49582 - RNA, 417 nt, synthetic construct
  misc_feature 1..417: note = derived and/or modified sequence opt6 from anti-HIV-1_HeavyChain
  source 1..417: mol_type = other RNA
agagcacatttagaacaaagtggaagtggagtaaaaaaaccaggagcaagtgtaagagtaagctgttggacaagtgaagatatatttgaaagaacagaattaatacattgggtaagacaagcaccaggacaaggattagaatggataggatgggtaaaaatagtaagtggagcagtaaatttcggaagtccaaattttagacaaagagcaagtttaacaagagacagagacttatttacagcacatatggatataagaggattaacacaaggagatacagcaacatatttttgtgcaagacaaaaatttgaaagaggaggacaaggatggatatttgatttatggggaagaggaacattaatagcagtaagtagtgcaagcacaaaaggaccaagtgtatttccaacaatatatgta

SEQ ID NO: 49583 - RNA, 414 nt, synthetic construct
  misc_feature 1..414: note = derived and/or modified sequence opt6 from anti-HIV-1_HeavyChain
  source 1..414: mol_type = other RNA
caagtacaattagtacaaagtgaagcagaagtaaaaaaaccaggagcaagtgtaaaaataagttgtgcaacaagcggatatgcatttacattatattatttacattgggtaagacaagcaccaggacaaggattagaatggataggatgggtaaaaacagtaacaggagcagtaaattttggatcagcatattttagacatagagtatcattaacaagagatagagatttatttacagcacatatggatataagaggattaacacaaggagatacagcaacatatttttgtgcaagacaaaaattttataaaggaggacaaggatggtactttgatttatggggaagaggaacattaatagtagtaagttcagcatcaacaaaaggaccaagtgtatttccacatgatttaaga

SEQ ID NO: 49584 - RNA, 420 nt, synthetic construct
  misc_feature 1..420: note = derived and/or modified sequence opt6 from anti-HIV-1_HeavyChain
  source 1..420: mol_type = other RNA
caagcacatccagaacaaagtggaagcggagtaaaaaaaccaggagcaagtgtaagagtaagttgttggacaagtgaagatatatttgaaagaacagaattaatacattgggtaagacaagcaccaggacaagggttagaatggataggatgggtaaaaatagtaagtggagcagtaaattttggaagtccaaattttagacaaagagtaagtttaacaagagatagagatttatttacagcacatatggatataaggggattaacacaaggagatacagcaacatatttttgtgcaagacaaaaatttgaaagaggaggacaaggatggatatttgatctatggggaagaggaacattaatagcagtaagtagtgcaagtacaaaaggaccaagtggattaccaccaagattatgtgta

SEQ ID NO: 49585 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtgaaaaaaccaggagcaagtgtaagagtaagttgttggacaagtgaagatatatttgaaagaacagaattaatacattgggtaagacaagcaccaggacaaggattagaatggataggatgggtaaaaacagtaagtggagcagtaaattttggaagtccaaattttagacatagagtaagtttaacaagagatagagatctatttacagcacatatggatataagaggattaacacaaggagatacagcaacatatttttgtgcaagacaaaaatttgaaagaggaggacaaggatggtattttgatctatggggaagaggaacattaatagtagtaagtagtgcaagtacaaaaggaccaagtgtatttccaccaagaagtaca

SEQ ID NO: 49586 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaagaccaggagcaagtgtaagagtaagttgttggacaagtgaagatatatttgaaaaatcagaattaatacattgggtaagacaagcaccaggacaaggattagaatggataggatgggtaaaaacagtaacaggagcagtaaattttggaagtccaaattttagacatagagtaagtttaacaagagacagagatttatttacagcacatatggatataagaggattaacacaaggagacacagcaacatatttttgtgcaagacaaaaatttgaaagaggaggacaaggatggtattttgatttatggggaagaggaacattaatagtagtaagtagtgcaagcacaaaaggaccatcagtatttccacatgatttaaga

SEQ ID NO: 49587 - RNA, 417 nt, synthetic construct
  misc_feature 1..417: note = derived and/or modified sequence opt6 from anti-HIV-1_HeavyChain
  source 1..417: mol_type = other RNA
ggagcacatttagaacaatcaggatcaggagtaaaaaaaccaggagcatcagtaagagtatcatgttggacatcagaagatatatttgaaaaaagtgaattaatacattgggtaagacaagcaccaggacaaggattagaatggataggatgggtaaaaacagtaacaggagcagtaaattttggatcaagtgattttagacaaagagtatcattaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagttcagcatcaacaaaaggaccaagtgtgtttccacatgatttaaga

SEQ ID NO: 49588 - RNA, 417 nt, synthetic construct
  misc_feature 1..417: note = derived and/or modified sequence opt6 from anti-HIV-1_HeavyChain
  source 1..417: mol_type = other RNA
agacatgatttagaacaaagcggaagtggagtaaaaaaaccaggagcaagtgtaagagtaagttgttggacaagtgaagatatatttgaaagaacagaattaatacattgggtaagacaagcaccaggacaaggattagaatggataggatgggttaaaatagtaagtggagcagtaaattttggaagtccaaattttagacaaagagtaagtctaacaagagatagagatttattcacagcacatatggatataagaggattaacacaaggagatacagcaacatatttttgtgcaagacaaaaatttgaaagaggaggacaaggatggatatttgatttatggggaagaggaacattaatagcagtaagtagtgcaagtacaaaaggaccaagtgtatttccacatgatttaaga

SEQ ID NO: 49589 - RNA, 420 nt, synthetic construct
  misc_feature 1..420: note = derived and/or modified sequence opt6 from anti-HIV-1_HeavyChain
  source 1..420: mol_type = other RNA
caagcacatttagaacaaagtggaagtggagtaaaaaaaccaggagcaagtgtaagagtaagttgttggagtagtgaagatatatttgaaagaacagaattaatacattgggtaagacaagcaccaggacaaggattagaatggataggatgggtaaaaacagtaacaggagcagtaaattttggaagtctagattttagacatagaataagtttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagtgcaagtacaaaaggaccaagtgtaacaatatatgta

SEQ ID NO: 49590 - RNA, 414 nt, synthetic construct
  misc_feature 1..414: note = derived and/or modified sequence opt6 from anti-HIV-1_HeavyChain
  source 1..414: mol_type = other RNA
caagcacatttagaacaaagtggaagtggagtaaaaaaaccaggagcaagtgtaagagtaagttgttggacaagtgaagatatatttgaaaaaagcgaattaatacattgggtaagacaagcaccaggacaaggattagaatggataggatgggtaaaaacagtaacaggagcagtaaattttggatcaagtgattttagacaaagagtaagcttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagtgcaagtccaggaccaataggaccaagtccaagaagtgca

SEQ ID NO: 49591 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtgcaagtggagtaaaaagaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagttcagattttagacaaagagtaagtttaacaagagatagagatttatttacagcacatatggatataagaggattaacacaaggagatacagcaacatatttttgtgcaagacaaaaattttatgcgggaggacaaggatggtattttgatttatggggaagaggaacattaatagtagtaagtagtgcaagtacaaaaggaccaagtgtatttccacatgatttaaga

SEQ ID NO: 49592 - RNA, 417 nt, synthetic construct
  misc_feature 1..417: note = derived and/or modified sequence opt6 from anti-HIV-1_HeavyChain
  source 1..417: mol_type = other RNA
caagtacaattagtacaaagtggagcagaagtaaaaaaaccaggagcatcagtaagagtatcatgttggacatcagaagatatatttgaaaaaagtgaattaatacattgggtaagacaagcaccaggacaaggattagaatggataggatgggtaaaaacagtaacaggagcagtaaattttggatcaagtgattttagacaaagagtatcattaacaagagatagagatttatttacagcacatatggatataagaggattaacacaaggagatacagcaacatatttttgtgcaagacaaaaattttatgcaggaggacaaggatggtattttgatttatggggaagaggaacactaatagtagtaagttcagcatcaacaaaaggaccaagtgtattcccaacaatatatgta

SEQ ID NO: 49593 - RNA, 417 nt, synthetic construct
  misc_feature 1..417: note = derived and/or modified sequence opt6 from anti-HIV-1_HeavyChain
  source 1..417: mol_type = other RNA
caagcacatctagaacaaagtggaagtggagtaaaaaaaccaggagcaagcgtaagagtaagttgttggacaagtgaagatatatttgaaaggacagaattaatacattgggtaagacaagcaccaggacaaggattagaaagaataggatgggtaaaaacagtaacaggagcagtaaattttggaagcccaaattttagacatagggtaagtctaacaagggatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagtgcgagtacaaaaggaccaagtgtatttccaacaatatgtgta

SEQ ID NO: 49594 - RNA, 420 nt, synthetic construct
  misc_feature 1..420: note = derived and/or modified sequence opt6 from anti-HIV-1_HeavyChain
  source 1..420: mol_type = other RNA
caaagtcatttagaacaatcaggatcagcaatgaaaaaaccaggagcatcagtaagagtatcatgttggacatcagaagatatatttgatacaacagaattaatacattgggtaagacaagcaccaggacaaggattagaatggataggatgggtaaaaacagtatcaggagcagtaaattttggatcattaaattttagacatagagtatcattaacaagagatagagatttatttacagcacatatggatataagaggattaacacaaggagatacagcaacatatttttgtgcaagacaaaaatttgcaagaggagatcaaggatggttttttgatttatggggaagaggaacattaatagtagtaagttcagcatcaacaaatggaccaataggaccatcaccaacagatttaaga

SEQ ID NO: 49595 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaattaggagcaagtgtaagagtaagttgttggacaagtgaagatatatttgaaagaacagaattaatacaatgggtaagacaagcaccaggacaaggattagaatggatgggatgggtaaaagcagtaagtggagcagtaaattatggaagtttagattttagacatagggtaagtttaacacgagatagagatttatttacagcacatatggatataagaggattaacacaagacgatacagcaacatatttttgtgcaagacaaaaatttgcaagaggagatcaaggatggttttttgatttatggggaagaggaacattaatagtagtaagtagtgcatcaacaaaaggaccaagcgtatttccacatgatttaaga

SEQ ID NO: 49596 - RNA, 417 nt, synthetic construct
  misc_feature 1..417: note = derived and/or modified sequence opt6 from anti-HIV-1_HeavyChain
  source 1..417: mol_type = other RNA
caaagtcatttagaacaatcaggatcagcaatgaaaaaaccaggagcatcagtaagagtatcatgttggacatcagaagatatatttgatacaacagaattaatatattgggtaagacaagcaccaggacaaggattagaatggataggatgggtaaaagcagtaagtggagcagtaaattatggatcactagattttagacatagagtatcactaacaagagatagagatttatcaacagcacatatggatataagaggattaacacaagatgatacagcaacatatttttgtgcaagacaaaaatttgcaagaggagatcaaggatggttttttgatttatggggaagaggaacattaatagtagtaagttcagcatcaacaaaaggaccaagtgtatttccacatgatttaaga

SEQ ID NO: 49597 - RNA, 417 nt, synthetic construct
  misc_feature 1..417: note = derived and/or modified sequence opt6 from anti-HIV-1_HeavyChain
  source 1..417: mol_type = other RNA
caagcacatctagaacaatcaggaagtggagtaaaaaaattaggagcaagtgtaagagtaagctgttggacaagtgaagatatatttgaaagaacagaattaatacattgggtaagacaagcaccaggacaaggactagaatggataggatgggtaaaagcagtaagcggagcagtaaattatggaagtttagattttagacatagagtaagtctaacaagagatagagatttaagtacagcacatatggatattagaggattaacacaagatgatacagcaacgtatttttgtgcaagacaaaaatttgcaagaggggatcaaggatggttttttgatttatggggaagaggaacattaatagtagtaagcagtgcaagtacaaaaggaccaagtgtatttccaactatatatgta

SEQ ID NO: 49598 - RNA, 417 nt, synthetic construct
  misc_feature 1..417: note = derived and/or modified sequence opt6 from anti-HIV-1_HeavyChain
  source 1..417: mol_type = other RNA
caagcacatctagaacaaagtggaagtggagtaaaaaaaccaggagcaagcgtaagagtaagctgttggacaagtgaagatatatttgaaagaacagaattaatacattgggtaagacaagcaccaggacaaggattagaatggataggatgggtaaaaacagtaacaggagcagtaaattttggaagtccaaattttagacatagagtaagtctaacaagagacagagatttatttacagcacatatggatataagaggattaacacaaggagatacagcaacatatttttgtgcaagacaaaaatttgaaagaggaggacaaggatggtattttgatttatggggaagaggaacattaatagtagtaagtagtgcaagtacaaaaggaccatcagtatttccacatgatccaaga

SEQ ID NO: 49599 - RNA, 423 nt, synthetic construct
  misc_feature 1..423: note = derived and/or modified sequence opt6 from anti-HIV-1_HeavyChain
  source 1..423: mol_type = other RNA
caagtatatatggaacaagcaggagcaggaatgaaaaaaccaggagcaagtatgacagtaagttgtaaaacagcagatgaagatatatttgatgcagcatatatgcattgggtaagacaagcaccaggacaaacatttgaatggttaggatggatgaaaccagtaacaggagcagtaaattatgcaagacaatttcaaggaagagtaagtttttatagaacaagagaattaggaatagcatatatggatttaagagatttaaaatttgatgatacagcagtatatttttgtgcaagaaaaacaaaaggagatgtaagtggagatgatagaggatttttttttgatttatggggaagaggaacaagagtaatagtaagtagcgcaagtacaaaaggaccaagtgtatttccacatgatttaaga

SEQ ID NO: 49600 - RNA, 423 nt, synthetic construct
  misc_feature 1..423: note = derived and/or modified sequence opt6 from anti-HIV-1_HeavyChain
  source 1..423: mol_type = other RNA
caagtatatatggaacaagcaggaggaggaatgaaaaaaccaggagcaagtatgacagtaagttgtaaaacagcagatgaagatatatttgatgcagcatatatgcattgggtaagacaagcaagaggacaaacatttgaatggttaggatggatgaaaccagtaacaggagcagtaaattatgcaagacaatttcaaggaagagtaagtttttataggacaagagaattaggaatagcatatatggatttaagagatttaaaatttgatgatacggcagtatatttttgtgcaagaaaaacaaaaggagatgtaagtggagatgatagaggatttttttttgatttatggggaagaggaacaagagtaatagtaagtagtgcaagtacaaaaggaccaagtgtatttccaacaatatatgta

SEQ ID NO: 49601 - RNA, 423 nt, synthetic construct
  misc_feature 1..423: note = derived and/or modified sequence opt6 from anti-HIV-1_HeavyChain
  source 1..423: mol_type = other RNA
caagtatatatggaacaagcaggagcaggagtaaaaaaaccaggagcaagtgtaacactaagttgtaaaacagcagatgaagatgtatttgatgcagcatatatgcattgggtaagacaagcaccaggacaaacatttgaatggttaggatggatgaaaccagtaacaggagcggtaagttatgcaagaaaatttcaaggaagagtaagtttttatatgacaagagaattaggaatggcatatatggatttaagaaatttaagatttgatgatacagcagtatatttttgtgcaagaaaaacagcaggagatgtaagtggagataatagaggatatttttttgatctatggggaagaggaagtagagtaatagtaagcagcgcaagtacaaaaggaccaagtgtatttccaacaatatatgta

SEQ ID NO: 49602 - RNA, 423 nt, synthetic construct
  misc_feature 1..423: note = derived and/or modified sequence opt6 from anti-HIV-1_HeavyChain
  source 1..423: mol_type = other RNA
caagtatatagtggagcaggaagaggaggagtaaaaaaaccaggagcaagcgtaacattaagttgtaaaacagcagatgaagatgtatttgatgcagcatatatgcattgggtaagacaagcaccaggacaaacatttgaatggttaggatggatgaaaccagtaacaggagcagtaaattatgcgagaaaatttcaaggaagagtaagtttttatagaacaagagaattaggaatagcatatatggatctaagaaatttaagatttgatgatacggcagtatatttttgtgcaagaaaaacagcaggagatgtaagtggagataaaagaggatttttttttgatttatggggaagaggaagtagagtaatagtaagcagtgcaagtacaaaaggaccaagcgtatttccaacaatatatgta

SEQ ID NO: 49603 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaaccaggagcaagtgtaagagtaagttgttggacaagtgaagacatatttgaaagaacagaattaatacattgggtaagacaagcaccaggacaaggattagaatggataggatgggtaaaaacagtaagtggagcagtaaattttggaagtccaaattttagacatagagtatcattaacaagagatagagatctatttacagcacatatggatataagaggattaacacaaggagatacagcaacatatttttgtgcaagacaaaaatttgaaagaggaggacaaggatggtattttgatttatggggaagaggaacattaatagtagtaagtagtgcatttacaaaaggaccaagtgtatttccacatgatttaaga

SEQ ID NO: 49604 - RNA, 414 nt, synthetic construct
  misc_feature 1..414: note = derived and/or modified sequence opt6 from anti-HIV-1_HeavyChain
  source 1..414: mol_type = other RNA
caagtacaattaggacaaagcggagcagaaatgaaaaaaccaggatcaagtgtaaaagtaagttgtaaagcaagtggaggaacatttaggcatagtccaataagttgggtaagacaagcaccaggacaaggattagaatggataggatgggtaaaagcagtaagtggagcagtaaattatggatcattagatttcagacatagagtatcattaacaagagatagagatttaagtacagcacatatggatataagaggattaacacaagatgatacagcaacatatttttgtgcaagacaaaaatttgcaagaggagatcaaggatggttttttgatttatggggaagaggaacattaatagtagtaagttcagcatcaacaaaaggaccaagtgtatttccacatgatttaaga

SEQ ID NO: 49605 - RNA, 417 nt, synthetic construct
  misc_feature 1..417: note = derived and/or modified sequence opt6 from anti-HIV-1_HeavyChain
  source 1..417: mol_type = other RNA
caaagtcatttagaacaaagtggatcagcaatgaaaaaaccaggagcaagtgtaagagtaagttgttggacaagcgaagatatatttgatacaacagaattaatatattgggtaagacaagcaccaggacaaggattagaatggataggatgggtaaaaacagtaacaggagcagtaaattttggatcaccaaattttagacatagagtaagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagtgcaagcacaaaaggaccaagtgtatttccacatgatttaaga

SEQ ID NO: 49606 - RNA, 423 nt, synthetic construct
  misc_feature 1..423: note = derived and/or modified sequence opt6 from anti-HIV-1_HeavyChain
  source 1..423: mol_type = other RNA
caagtatatatggaacaagcaggagcaggagtaaaaaaaccaggagcaagcgtaacattaagttgtaaaacagcagatgaagatgtatttgatgcagcatatatgcattgggtaagacaagcaccaggacaaacatttgagtggttaggatggatgaaaccagtaacaggagcagtatcatatgcaagaaaatttcaaggaagagtaagtttttatatgacaagagaactaggaatggcatatatggatttaagaaatttaagatttgatgatacagcagtatatttttgtgcaagaaaaacggcaggagatgtaagtggagataatagaggatatttttttgatctatggggaagaggaagctgggtaatagtaagtagtgcaagtacaaaaggaccaagtgtatttccacatgatttaaga

SEQ ID NO: 49607 - RNA, 423 nt, synthetic construct
  misc_feature 1..423: note = derived and/or modified sequence opt6 from anti-HIV-1_HeavyChain
  source 1..423: mol_type = other RNA
caagtatatatggaacaagcaggaggaggagtaaaaaaaccaggagcaagtgtaacactaagttgtaaaacagcagatgaagatgtatttgatgcagcatatatgcattgggtaagacaagcaccaggacaaacatttgaatggttaggatggatgaaaccagtaacaggagcagtaaattatgcaagaaaatttcaaggaagagtaagtttttatagaacaagagaattaggaatagcatatatggatttaagaaatttaagatttgatgatacagcagtatatttttgtgcaagaaaaacagcaggagatgtaagtggagataaaagaggatttttttttgatttatggggaagaggatcaagagtaatagtaagtagtgcaagtacaaaaggaccaagtgtatttccaacaatatgtgta

SEQ ID NO: 49608 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaattaggagcaagtgtaagagtaagttgttggacaagtgaagatatatttgaaagaacagaactaatacattgggtaagacaagcaccaggaagaggattagaatggataggatgggtaaaagcagtaagtggagcagtaaattatggaagtttagattttagacatagagtaagtttaacaagagatagagatttatttacagcacatatggatataagaggattaacacaagatgatacagcaacatatttttgtgcaagacaaaaatttgcaagaggagatcaaggatggttttttgatttatggggaagaggaacattaatagtagtaagtagtgcaagtacaaaaggaccaagtgtatttccacatgatttaaga

SEQ ID NO: 49609 - RNA, 423 nt, synthetic construct
  misc_feature 1..423: note = derived and/or modified sequence opt6 from anti-HIV-1_HeavyChain
  source 1..423: mol_type = other RNA
caagtatatatggaacaagcaggaggaggagtaaaaaaaccaggagcaagtgtaacattaagttgtaaaacagcagatgaagatgtatttgatgcagcatatatgcattgggtaagacaagcaccaggacaaacatttgaatggttaggatggatgaaaccagtaacaggagcagtaaattatgcaagaaaatttcaaggaagagtaagtttttatagaacaagagaattaggaatagcatatatggatttaagaaatttaagatttgatgacacagcagtatatttttgtgcaagaaaaacagcaggagatgtaagtggagataaaagaggatttttttttgatttatggggaagaggaagtagagtaatagtaagtagtgcaagtacaaaaggaccaagtgtatttccaacaatatatgta

SEQ ID NO: 49610 - RNA, 423 nt, synthetic construct
  misc_feature 1..423: note = derived and/or modified sequence opt6 from anti-HIV-1_HeavyChain
  source 1..423: mol_type = other RNA
caagtatttatggaacaagcaggagcaggaatgaaaaaaccaggagcaagcatgacagtaagttgtaaaacagcagatgaagatgtatttgacgcagcatatatgcattgggtaagacaagcaccaggacaaacatttgaatggttaggatggatgaaaccagtaacaggagcagtaaattatgcaagaaaatttcaaggaagagtgagtttttatagaacaagagaattaggaatagcatatatggatttaagaaatttaagatttgatgatacagcagtatatttttgtgcaagaaaaacagcaggagatgtaagtggagataaaagaggatttttttttgatttatggggaagaggaagtagagtaatagtaagtagtgcaagtacaaaaggaccaagtgtatttccacatgatttaaga

SEQ ID NO: 49611 - RNA, 423 nt, synthetic construct
  misc_feature 1..423: note = derived and/or modified sequence opt6 from anti-HIV-1_HeavyChain
  source 1..423: mol_type = other RNA
caagtatatatggaacaagcaggagcaggagtaaaaaaaccaggagcaagtgtaacattaagttgtaaaacagcagatgaagatgtatttgatgcagcatatatgcattgggtaagacaagcaccaggacaaacatttgaatggttaggatggatgaaaccagtaacaggagcagtaaattatgcaagaaaatttcaaggaagagtaagtttttatagaacaagagaattgggaatagcatatatggatttaagaaatttaagattagatgatacagcagtatatttttgtgcaagaaaaacagcaggagatgtaagcggagataaaagaggatttttttttgatttatggggaagaggaagtagagtaatagtaagttcagcaagtacaaaagggccaagtgtatttccacatgatttaaga

SEQ ID NO: 49612 - RNA, 420 nt, synthetic construct
  misc_feature 1..420: note = derived and/or modified sequence opt6 from anti-HIV-1_HeavyChain
  source 1..420: mol_type = other RNA
caaagccatttagaacaatcaggatcagcaatgaaaaaaccaggagcatcagtaagagtatcatgctggacatcagaagatatatttgaaagaacagaactaatatactgggtaagacaagcaccaggaagaggactagaatggataggatgggtaaaaacagtaagcggaacagtaaactttggatcaagcgatttcagaaatagaatatcattaacaagagatagagatctatcaacagcacacatggacataagaggattaacacaagatgacacagcaacatacttttgcgcaagacaaaaatttgaatcactatatagcgatgaccaaggatcatactttgacttatggggaagaggaacattaataatagtatcaagcgcaagtacaaaaggaccatcagtatttccaacaata

SEQ ID NO: 49613 - RNA, 423 nt, synthetic construct
  misc_feature 1..423: note = derived and/or modified sequence opt6 from anti-HIV-1_HeavyChain
  source 1..423: mol_type = other RNA
caagtatatatggaacaagcaggaggaggagtaaaaaaaccaggagcaagtgtaacattaagttgtaaaacagctgatgaagatgtatttgatgcagcatatatgcattgggtaagacaagcaccaggacaaacatttgaatggttaggatggatgaaaccagtaacgggagcagtatcatatgcaagaaaatttcaaggaagagtaagtttttatatgacaagagaattaggaatggcatatatggatttaagaaatttaagatttgatgatacggcagtatatttttgtgcaagaaaaacagcaggagatgtaagtggagataatagaggatatttttttgatttatggggaagaggaagtagagtaatagtaagtagtgcaagtacaaaaggaccaagtgtatttccaacaatatgtgta

SEQ ID NO: 49614 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaatcaggatcaggagtaaaaaaaccaggagcatcagtaagagtaagttgttggacatcagaagatatatttgaaaaaagcgaattaatacattgggtaagacaagcaccaggacaaggattagaatggataggatgggtaaaaacagtaacaggagcagtaaattttggatcaagtgattttagacaaagagtatcactaacaagagatagagatttatttacagcacatatggatataagaggattaacacaaggagatacagcaacatatttttgtgcaagacaaaaatattatgcaggaggacaaggatggtattttgatttatggggaagaggaacattaatagtagtaagttcagcatcaacaaaaggaccaagtgtatttccacatgatttaaga

SEQ ID NO: 49615 - RNA, 426 nt, synthetic construct
  misc_feature 1..426: note = derived and/or modified sequence opt6 from anti-HIV-1_HeavyChain
  source 1..426: mol_type = other RNA
caagcacatttagaacaaagtggaagtggagtaaaaaaaccaggagcaagtgtaagagtaagttgttggagtagtgaagatatatttgaaagaacagaattaatacattgggtaaggcaagcaccaggacaaggactagaatggataggatgggtaaaaacagtaacaggagcagtaaattttggaagtttagattttagacatagaataagtttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagcagcgcaagtacaaaaggaccaagtgtatttccacatgacttaaga

SEQ ID NO: 49616 - RNA, 423 nt, synthetic construct
  misc_feature 1..423: note = derived and/or modified sequence opt6 from anti-HIV-1_HeavyChain
  source 1..423: mol_type = other RNA
caagtatatatgggagcaggaagaggaggagtaaaaaaaccaggagcaagtgtaacattaagttgtaaaacagcagatgaagatgtatttgatgcagcatatatgcattgggtaagacaagcaccaggacaaacatttgaatggttaggatggatgaaaccagtaacaggagcagtaaattatgcaagaaaatttcaaggaagagtaagtttttatagaacaagagaattaggaatagcatatatggatttaagaaatttaagatttgatgatacagcagtatatttttgtgcaagaaaaacagcaggagatgtaagtggagataaaagaggatttttttttgatttatggggaagaggaagtagagtaatagtaagtagtgcaagtacaaaaggaccaagtgtatttccaacaatatatgta

SEQ ID NO: 49617 - RNA, 423 nt, synthetic construct
  misc_feature 1..423: note = derived and/or modified sequence opt6 from anti-HIV-1_HeavyChain
  source 1..423: mol_type = other RNA
caagtatatatggaacaagcaggaggaggaatgaaaaaaccaggagcaagtatgacagtaagttgtaaaacagcagatgaagatatatttgatgcagcatatatgcattgggtaagacaagcaccaggacaaacatttgaatggttaggatggatgaaaccagtaacaggagcagtaaattatgcaagacaatttcaaggaagagtaagcttttatagaacaagagaattaggaatagcatatatggatttaagagatttaaaatttgatgatacagcagtatatttttgtgcaagaaaaacaaaaggagatgtaagtggagatgatagaggatttttttttgatctatggggaagaggaacaagagtaatagtaagtagtgcaagtacaaaaggaccaagtgtatttccaacaatatgtgta

SEQ ID NO: 49618 - RNA, 423 nt, synthetic construct
  misc_feature 1..423: note = derived and/or modified sequence opt6 from anti-HIV-1_HeavyChain
  source 1..423: mol_type = other RNA
caagtatatatggaacaagcaggaggaggaatgaaaaaaccaggagcaagtatgacagtaagttgtaaaacagcagatgaagatatatttgatgcagcatatatgcattgggtaagacaagcaccaggacaaacatttgaatggttaggatggatgaaaccagtaacaggagcagtaaattatgcaagacaatttcaaggaagagtaagtttttatagaacaagagaattaggaatagcatatatggatttaagagatttaaaatttgatgatacagcagtatatttttgtgcaagaaaaacaaaaggagatgtaagtggagatgatagaggatttttttttgatttatggggaaggggaacaagagtaatagtaagtagtgcaagtacaaaaggaccaagtgtatttccacatgatttaaga

SEQ ID NO: 49619 - RNA, 423 nt, synthetic construct
  misc_feature 1..423: note = derived and/or modified sequence opt6 from anti-HIV-1_HeavyChain
  source 1..423: mol_type = other RNA
caagtatatatggaacaagcaggagcaggagtaaaaaaaccaggagcaagtgtaacattaagttgtaaaacagcagatgaagatgtatttgatgcagcatatatgcattgggtaagacaagcaccaggacaaacatttgaatggttaggatggatgaaaccagtaacaggagcagtaaattatgcaagaaaatttcaaggaaaagtaagtttttatagaacaagagaattaggaatagcatatatggatttaagaaatttaagatttgatgatacagcagtatatttttgcgcaagaaaaacagcaggagatgtaagtggagataaaagaggatttttttttgatttatggggaagaggaagcagagtaatagtaagtagtgcaagtacaaaaggaccaagtgtatttccacatgatttaaga

SEQ ID NO: 49620 - RNA, 423 nt, synthetic construct
  misc_feature 1..423: note = derived and/or modified sequence opt6 from anti-HIV-1_HeavyChain
  source 1..423: mol_type = other RNA
caagtatatatggaacaagcaggagcaggagtaaaaaaaccaggagcaagtgtaacactaagttgtaaaacagcagatgaagatgtatttgatgcagcatatatgcattgggtaagacaagcaccaggacaaacatttgaatggttaggatggatgaaaccagtaacaggagcagtaaattatgcaagaaaatttcaaagtagagtaagtttttatggaacaagagaattaggaatagcatatatggatttaagaaatttaagatttgatgatacagcagtatatttttgtgcaagaaaaacagcaggagatgtaagtggagataaaagaggatttttttttgatttatggggaagaggaagtagagtaatagtaagtagcgcaagtacaaaaggaccaagtgtatttccacatgatttaaga

SEQ ID NO: 49621 - RNA, 420 nt, synthetic construct
  misc_feature 1..420: note = derived and/or modified sequence opt6 from anti-HIV-1_HeavyChain
  source 1..420: mol_type = other RNA
caaggacatacagtagaacaaagcggaagtggagtaaaaaaattaggagcaagtgtaagagtaagctgttggacaagtgaagatatatttgaaacaacagaattaatacattgggtaaggcaagcaccaggacaaggattagaatggataggatgggtaaaaacagtaagtggagcagtaaattttggaagtttaaattttagacatagagtaagtttaacaagagatagagatttatttacagcacatatggatataagaggattaacacaaggagatacagcaacatatttttgtgcaagacaaaaatttgcaagaggagatcaaggatggttttttgatttatggggaagaggaacattaatagtagtaagttcagcaagtacaaaaggaccaagtgtatttccacatgatttaaga

SEQ ID NO: 49622 - RNA, 420 nt, synthetic construct
  misc_feature 1..420: note = derived and/or modified sequence opt6 from anti-HIV-1_HeavyChain
  source 1..420: mol_type = other RNA
caagcaacaccatggtcaaatttaggaagaggagtaaaaaaattaggagcaagtgtaagagtaagttgttggacaagtgaagatatatttgaaagaacagaactaatacattgggtaagacaagcaccaggacaaggattagaatggataggatgggtaaaaacagtaacaggagcagtaaattttggaagtccaaattttagacatagagtaagtttaacaagagatagagatttatttacagcacatatggatataagaggattaacacaaggagatacagcaacatatttttgtgcaagacaaaaatttgaaagaggaggacaaggatggtattttgatctatggggaagaggaacattaatagtagtaagtagtgcaagtacaaaaggaccaagtgtatttccacatgatttaaga

SEQ ID NO: 49623 - RNA, 423 nt, synthetic construct
  misc_feature 1..423: note = derived and/or modified sequence opt6 from anti-HIV-1_HeavyChain
  source 1..423: mol_type = other RNA
caagtatttatggaacaagcaggagcaggaatgaaaaaaccaggagcaagtatgacagtaagctgtaaaacagcagatgaagatgtatttgatgcggcatatatgcattgggtaagacaagcaccaggacaaacatttgaatggttaggatggatgaaaccagtaacaggagcagtaagttatgcaagaaaatttcaaggaagagtaagtttttatatgacaagagaattaggaatggcatatatggatttaagaaatttaagatttgatgatacagcagtatatttttgtgcaagaaaaacagcaggagatgtaagtggagataatagaggatatttttttgatttatggggaagaggaagtagagtaatagtgagtagtgcatcaacaaaaggaccaagtgtatttccacatgatttaaga

SEQ ID NO: 49624 - RNA, 423 nt, synthetic construct
  misc_feature 1..423: note = derived and/or modified sequence opt6 from anti-HIV-1_HeavyChain
  source 1..423: mol_type = other RNA
caagtatatatggaacaaagtggaggaggagtaaaaaaaccaggagcaagtgtaacattaagttgtaaaacagcagatgaagatgtatttgatgcagcatatatgcattgggtaagacaagcaccaggacaaacatttgaatggttaggatggatgaaaccagtaacaggagcagtatcatatgcaagaaaatttcaaggaagagtaagtttttatagaacgagagaattaggaatagcatatatggatttaagaaatttaagatttgatgatacagcagtatatttttgtgcaagaaaaacagcaggagatgtaagtggagataaaagaggatttttttttgatttatggggaagaggaagtagagtaatagtaagtagtgcaagtacaaaaggaccaagtgtatttccacatgatttaagg

SEQ ID NO: 49625 - RNA, 423 nt, synthetic construct
  misc_feature 1..423: note = derived and/or modified sequence opt6 from anti-HIV-1_HeavyChain
  source 1..423: mol_type = other RNA
caagtatatatggaaagaggaagaggaggagtaaaaaaaccaggagcatcagtaacattaagttgtaaaacagcagatgaagatgtatttgatgcagcatatatgcattgggtaagacaagcaccaggacaaacatttgaatggttaggatggatgaaaccagtaacaggagcagtaaattatgcaagaaaatttcaaggaagagtaagtttttatagaacaagagaattaggaatagcatatatggatttaagaaatttaagatttgatgatacagcagtatatttttgtgcaagaaaaacggcaggagatgtaagtggagataaaagaggatttttctttgatttatggggaagaggaagtagagtaatagtaagtagtgcaagtacaaaaggaccaagtgtatttccacatgatttaaga

SEQ ID NO: 49626 - RNA, 423 nt, synthetic construct
  misc_feature 1..423: note = derived and/or modified sequence opt6 from anti-HIV-1_HeavyChain
  source 1..423: mol_type = other RNA
caagtatatatggaacaagcaggaggaggagtaaaaaaaccaggagcaagtgtaacattaagttgtaaaacagcagatgaagatgtatttgatgcagcatatatgcattgggtaagacaagcaccaggacaaacatttgaatggttaggatggatgaaaccagtaacaggagcagtaagttatgcaagaagatttcaaggaagagtaagtttttatatgacaagagaattaggaatggcatatatggatttgagaaatttaagatttgatgatacagcagtatatttttgtgcaagaaaaacagcaggagatgtaagtggagataatagaggatatttttttgatttatggggaagaggaagtagagtaatagtaagtagtgcaagtacaaaaggaccaagtgtatttccaacaatatgtgta

SEQ ID NO: 49627 - RNA, 423 nt, synthetic construct
  misc_feature 1..423: note = derived and/or modified sequence opt6 from anti-HIV-1_HeavyChain
  source 1..423: mol_type = other RNA
caagtatatatggaacaagcaggaggaggagtaaaaaaaccaggagcaagtgtaacattaagttgtaaaacagcagatgaagatgtatttgatgcagcatatatgcattgggtaagacaagcaccaggacaaacatttgaatggttaggatggatgaaaccagtaacaggagcagtaagttatgcaagaaaatttcaaggaagagtaagtttttatatgacaagagaattaggaatggcatatatggatctaagaaatttaagatttgatgatacagcagtatatttttgtgcaagaaaaacagcaggagatgtaagtggagataatagaggatatttttttgatttatggggaagaggaagtagagtaatagtaagtagtgcaagtacgaaaggaccaagtgtatttccacatgatttaaga

SEQ ID NO: 49628 - RNA, 423 nt, synthetic construct
  misc_feature 1..423: note = derived and/or modified sequence opt6 from anti-HIV-1_HeavyChain
  source 1..423: mol_type = other RNA
caagtatttatggaacaagcaggaggaggaatgaaaaaaccaggagcaagtatgacagtaagttgtaaaacagcagatgaagatatatttgatgcagcatatatgcattgggtaagacaagcaccaggacaaacatttgaatggttaggatggatgaaaccagtaacaggagcagtaaattatgcaagacaatttcaaggaagagtaagtttttatagaacaagagaattaggaatagcatatatggatttaagagatttaaaatttgatgatacagcagtatatttttgtgcaagaaaaacaaaaggagatgtaagtggagatgatagaggatttttttttgatttatggggaagaggaacaagagtaatagtaagtagtgcaagtacaaaaggaccaagtgtatttccacatgatttaaga

SEQ ID NO: 49629 - RNA, 423 nt, synthetic construct
  misc_feature 1..423: note = derived and/or modified sequence opt6 from anti-HIV-1_HeavyChain
  source 1..423: mol_type = other RNA
caagcacatttagaacaaagtggaagcggagtaaaaaaaccaggagcaagtgtaagagtaagttgttggacaagtgaagatatatttgaaagaacagaattaatacattgggtaagacaagcaccaggacaaggactagaatggataggatgggtaaaaacagtaacaggagcagtaaattttggaagtctagattttagacatagaataagtttaacaagagatagagatttatttacagcacatatggatataagaggattaacacaaggagatacagcaacatatttttgtgcaagacaaaaatttgcaagtagatatagtggagatcaaggaagttattttgatttatggggaagaggaacattaatagtagtaagtagtgcaagtacaaaaggaccaagtgtatttccacatgattta

SEQ ID NO: 49630 - RNA, 423 nt, synthetic construct
  misc_feature 1..423: note = derived and/or modified sequence opt6 from anti-HIV-1_HeavyChain
  source 1..423: mol_type = other RNA
caagtatttatggaacaagcaggagcgggaatgaaaaaaccaggagcaagtatgacagtaagctgtaaaacagcagatgaagatgtatttgatgcagcatatatgcattgggtaagacaagcaccaggaccagatttagaatggctaggatggatgaaaccagtaacaggagcagtaaattatgcaagaaaatttcaaggaagagtaagtttttatagaacaagagaattaggaatagcatatatggatttaagagatttaagatttgatgatacagcagtatatttttgtgcaagaaaaacagcaggagatgtaagtggagataaaagaggatttttttttgatttatggggaagaggaagtagagtaatagtaagtagtgcaagtacaaaagcacatagaagtagtccaacaatatgtgta

SEQ ID NO: 49631 - RNA, 426 nt, synthetic construct
  misc_feature 1..426: note = derived and/or modified sequence opt6 from anti-HIV-1_HeavyChain
  source 1..426: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagtccaaattttagacatagaataagtttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagtgcaagtacaaaaggaccaagtgtatttccacatgatttaaga

SEQ ID NO: 49632 - RNA, 423 nt, synthetic construct
  misc_feature 1..423: note = derived and/or modified sequence opt6 from anti-HIV-1_HeavyChain
  source 1..423: mol_type = other RNA
caagtatatatggaacaagcaggaggaggagtaaaaaaaccaggagcaagtgtaacattaagttgtaaaacagcagatgaagatgtatttgatgcagcatatatgcattgggtaagacaagcaccaggacaaacatttgaatggttaggatggatgaaaccagtaacgggagcagtaagttatgcaagaaaatttcaaggaagagtaagtttttatatgacaagagaactaggaatggcatatatggatttaagaaatttaagatttaatgatacagcagtatatttttgtgcaagaaaaacagcaggagatgtaagtggagataatagaggatatttttttgatttatggggaagaggaagtagagtaatagtaagtagtgcaagtacaaaaggaccaagcgtatttccacatgatttaaga

SEQ ID NO: 49633 - RNA, 423 nt, synthetic construct
  misc_feature 1..423: note = derived and/or modified sequence opt6 from anti-HIV-1_HeavyChain
  source 1..423: mol_type = other RNA
caagtatatatggaacaagcaggaggaggagtaaaaaaaccaggagcaagtgtaacattaagttgtaaaacagcagatgaagatgtatttgacgcagcatatatgcattgggtaagacaagcaccaggacaaacatttgaatggttaggatggatgaaaccagtaacaggagcagtaaattatgcaagaaaatttcaaggaagagtaagcttttatagaacaagagaattaggaatagcatatatggatttaagaaatttaagatttgatgatacagcagtatatttttgtgcaagaaaaacagcaggagatgtaagtggagataatagaggatatttttttgatttatggggaagaggaagtagggtaatagtaagtagtgcaagtacaaaaggaccaagtggactaccacatgatttaagg

SEQ ID NO: 49634 - RNA, 423 nt, synthetic construct
  misc_feature 1..423: note = derived and/or modified sequence opt6 from anti-HIV-1_HeavyChain
  source 1..423: mol_type = other RNA
caagtatatatggaacaagcaggaggaggagtaaaaaaaccaggagcaagtgtaacattaagttgtaaaacagcagatgaagatgtatttgatgcagcatatatgcattgggtaagacaagcaccaggacaaacatttgaatggttaggatggatgaaaccagtaacaggagcagtaaattatgcaagaaaatttcaaggaagagtaagtttttatagaacaagagaattaggaatagcatatatggatttaagaaatttaagatttgatggaacagcagtatatttttgtgcaagaaaaacagcaggagatgtaagtggagataaaagaggatttttttttgatttatggggaagaggaagtagagtaatagtaagtagtgcaagtacaaaaggaccaagtgtatttccacatgatttaaga

SEQ ID NO: 49635 - RNA, 423 nt, synthetic construct
  misc_feature 1..423: note = derived and/or modified sequence opt6 from anti-HIV-1_HeavyChain
  source 1..423: mol_type = other RNA
caagtatatatggaacaagcaggaggaggagtaaaaaaaccaggagcaagcgtaacattaagttgtaaaacagcagatgaagatgtatttgatgcagcatatatgcattgggtaagacaagcaccaggacaaacatttgaatggttaggatggatgaaaccagtaacaggagcagtaaattatgcaagaaaatttcaaggaagagtaagtttttatagaacaagagaattaggaatagcatatatggatttaagaaatttaagatttgatgatacagcagtatatttttgtgcaagaaaaacagcaggagatgtaagtggagataaaagaggatttttttttgatttatggggaagaggaagcagagtaatagtaagtagtgcaagtacaaaaggaccaagtgtatttccacatgatttaaga

SEQ ID NO: 49636 - RNA, 423 nt, synthetic construct
  misc_feature 1..423: note = derived and/or modified sequence opt6 from anti-HIV-1_HeavyChain
  source 1..423: mol_type = other RNA
caagtacaattagtacaaagcggagcagaagtaaaaaaaccaggagcaagtttaaaagtaagctgtaaagcaagcggatacacattcacagactattacatacactgggtaagacaagcaccaggacaaggactagaatggataggatgggtaaaaatagtaagcggaacagtaaactttgcatcactagatttcagaaacagaatatcactatcaagagatagagatctctcaacagcatacatggacataagaggactaacacaagatgacacagcaacatacttttgcgcaagacaaaaatttgcatcaagatatagcggagaccaaggatcatactttgacttatggggaagaggaacattaatagtagtatcgagtgctagtacaaaaggaccatcagtatttccacatgacttaaga

SEQ ID NO: 49637 - RNA, 423 nt, synthetic construct
  misc_feature 1..423: note = derived and/or modified sequence opt6 from anti-HIV-1_HeavyChain
  source 1..423: mol_type = other RNA
caagcacatttagaacaatcaggatcaggagtaaaaaaaccaggagcatcagtaagagtatcatgttggagttcagaagatatatttgaaagaacagaactaatacattgggtaagacaagcaccaggacaaggattagaatggataggatgggtaaaaacagtaacaggagcagtaaattttggaagtttagattttagacatagaatatcattaacaagagacagagatttatttacagcacatatggatataagaggattaacacaaggagatacagcaacatatttttgtgcaagacaaaaatttgaatcaagatatacaggaggacaaggatggtattttgatttatggggaagaggaacactaatagtagtatcaagtgcaagtacaagagcacatagaagcccacatgatttaaga

SEQ ID NO: 49638 - RNA, 426 nt, synthetic construct
  misc_feature 1..426: note = derived and/or modified sequence opt6 from anti-HIV-1_HeavyChain
  source 1..426: mol_type = other RNA
caagcacatttagaacaaagtggaagtggagtgaaaaaaccaggagcaagtgtaagagtaagctgttggacaagtgaagatatatttgaaagaacagaattaatacattgggtaagacaagcaccaggacaaggattagaatggataggatgggtaaaaacagtaacaggagcagtaaattttggaagtccaaattttagacaaagagtaagtctaacaagagatagagatttatttacagcacatatggatataagaggattaacacaaggagatacagcaacatatttttgtgcaagacaaaaatttgaaagtagatatacaggaggacaaggatggtattttgatttatgggggagaggaacacatatagtagtaagtagtgcaagtacaaaaggaccaagtgtatttccacatgatttaaga

SEQ ID NO: 49639 - RNA, 426 nt, synthetic construct
  misc_feature 1..426: note = derived and/or modified sequence opt6 from anti-HIV-1_HeavyChain
  source 1..426: mol_type = other RNA
caagtacaattagtacaaagcggagcagaagtaaaaaaaccaggagcaagtgtaagagtaagttgttggacaagtgaagatatatttgatacaacagaattaatatattgggtaagacaagcaccaggacaaggattagaatggataggatgggtaaaaatagtatcaggaacagtaaattttgcaagtttagattttagaaatagaataagtttaagtagagatagagatttaagtacagcatatatggatataagaggattaacacaagatgatacagcaacatatttttgtgcaagacaaaaatttgcaagcagatattcaggagatcaaggaagttattttgatttatggggaagaggaacattaatagtagtaagtagtgcaagtacaaaaggaccaagtgtatttccacaaatatgtgta

SEQ ID NO: 49640 - RNA, 426 nt, synthetic construct
  misc_feature 1..426: note = derived and/or modified sequence opt6 from anti-HIV-1_HeavyChain
  source 1..426: mol_type = other RNA
caaagccatctagaacaatcaggatcagcaatgaaaaaaccaggagcatcagtaagagtatcatgctggacatcagaagatatatttgaaagaacagaactaatatactgggtaagacaagcaccaggaagaggattagaatggataggatggatgaaaacagtaagcggaacagtaaactttggatcaagcgatttcagaaacagaatatcactaacaagagatagagatctatcaacagcacacatggacataagaggactaacacaagatgacacagcaacatacttttgcgcaagacaaaaatttgaatcattatatagtgatgaccaaggatcatactttgacttatggggaagaggaacattaataatagtatcaagcgcaagcacaaaagcacacagaagctcaccaacaacattaaga

SEQ ID NO: 49641 - RNA, 423 nt, synthetic construct
  misc_feature 1..423: note = derived and/or modified sequence opt6 from anti-HIV-1_HeavyChain
  source 1..423: mol_type = other RNA
caaagccatctagaacaatcaggatcagcaatgaaaaaaccaggagcatcagtaagagtatcatgctggacatcagaagatatatttgacacaacagaactaatatactgggtaagacaagcaccaggacaaggactagaatggataggatgggtaaaaatagtaagcggaacagtaaactttgcatcactagatttcagaaacagaatatcactatcaagagatagagatttatcaacagcacacatggacataagaggactaacacaagatgacacagcaacatacttttgcgcaagacaaaaatttgcatcaagatatagtggagaccaaggatcatactttgacttatggggaagaggaacattaataatagtatcaagcgcaagcacaaaaggaccatcagtatttccaagaagcgca

SEQ ID NO: 49642 - RNA, 423 nt, synthetic construct
  misc_feature 1..423: note = derived and/or modified sequence opt6 from anti-HIV-1_HeavyChain
  source 1..423: mol_type = other RNA
caagcacacctagaacaaagcggaagtggagtaaaaaaaccaggagcaagtgtaagagtaagctgttggacaagcgaagacatattcgaaaaatcagaattgatacattgggtaagacaagcaccaggacaaggattagaatggataggatgggtaaaaacagtaacaggagcagtaaatttcggacaccaaatatcagacagagtatcactatcaagagatagagatctatcaacagcatacatggacataagaggattaacacaagatgacacagcaacatacttttgcgcaagacaaaaatttgcatcaagatatagcggagaccaaggatcatactttgacttatggggaagaggaacattaatagtagtatcaagcgcaagcacaaaaggaccatcagtatttccacatgatttaaga

SEQ ID NO: 49643 - RNA, 423 nt, synthetic construct
  misc_feature 1..423: note = derived and/or modified sequence opt6 from anti-HIV-1_HeavyChain
  source 1..423: mol_type = other RNA
caaagtcatctagaacaaagtggatcagcaatgaaaaaaccaggagcatcagtaagagtatcatgttggacatcagaagatatatttgacacaacagaattaatatactgggttagacaagcaccaggacaaggattagaatggataggatgggtaaaaatagtaagtggaacagtaaattttgcatcattagattttagaaacagaatatcactatcaagagatagagatttatcaacagcacatatggacataagaggactaacgcaagatgacacagcaacatacttttgcgcaagacaaaaatttgcatcaagatatagtggggaccaaggatcatactttgatttatggggaagaggaacattaataatagtatcaagtgcaagcacaagagcacatagaagttcaccaagaagcgca

SEQ ID NO: 49644 - RNA, 426 nt, synthetic construct
  misc_feature 1..426: note = derived and/or modified sequence opt6 from anti-HIV-1_HeavyChain
  source 1..426: mol_type = other RNA
caagcacatttagaacaaagtggaagtggagtaaaaaaaccaggagcgagtgtaagagtaagttgttggacaagtgaagatatatttgaaaaaagtgaattaatacattgggtaagacaagcaccaggacaaggattagaatggataggatgggtaaaaacagtaacaggagcagtaaattttggaagtagtgattttagacatagaataagtttaacaagagatagagatttatttacagcacatatggatataagaggattaacacaaggagatacagcaacatatttttgtgcaagacaaaaatttgaaagcagatatacaggaggacaaggatggtattttgatctatggggaagaggaacacatatagtagtaagtagcgcaagtacaaaaggaccaagtgtatttccacatgatttaaga

SEQ ID NO: 49645 - RNA, 426 nt, synthetic construct
  misc_feature 1..426: note = derived and/or modified sequence opt6 from anti-HIV-1_HeavyChain
  source 1..426: mol_type = other RNA
caatcacacctagaacaatcaggatcagcaatgaaaaaaccaggagcatcagtaagagtatcatgctggacatcagaagacatattcgacacaacagaattaatatactgggtaagacaagccccaggacaaggactagaatggataggatgggtaaaaatagtatcaggaacagtaaacttcggaagctcagacttcagaaacagaatatcactaacaagagacagagacctatcaacagcacacatggacataagaggactaacacaagacgacacagcaacatacttctgcgcaagacaaaaattcgaatcactatactcagacgaccaaggatcatacttcgacctatggggaagaggaacactaataatagtatcatcagcatcaacaaaaggaccatcagtattcccaacaatatacgta

SEQ ID NO: 49646 - RNA, 426 nt, synthetic construct
  misc_feature 1..426: note = derived and/or modified sequence opt6 from anti-HIV-1_HeavyChain
  source 1..426: mol_type = other RNA
caaagccatttagaacaaagtggatcagcaatgaaaaaaccaggagcatcagtaagagtatcatgctggacatcagaagatatatttgacacaacagaattaatatactgggtaagacaagcaccaggacaaggactagaatggataggatgggtaaaaatagtaagcggaacagtaaactttgcatcattagattttagaaacagaataagtctatcaagagatagagatttatcaacagcatacatggacataagaggactaacacaagatgacacagcaacatacttttgcgcaagacaaaaatttgcatcaagatatagcggagaccaaggatcatactttgacttatggggaagaggaacattaatagtagtatcaagcgcaagcacaaaaggaccatcagtatttccacatgacttaaga

SEQ ID NO: 49647 - RNA, 423 nt, synthetic construct
  misc_feature 1..423: note = derived and/or modified sequence opt6 from anti-HIV-1_HeavyChain
  source 1..423: mol_type = other RNA
caatcacacttagaacaaagcggaagtgcaatgaaaaaaccaggagcaagcgtaagagtaagctgttggacaagcgaagacatattcgatacaacagaattaatatattgggtaagacaagcaccaggacaaggactagaatggataggatgggtaaaaatagtatcaggaacagtaaatttcgcaagtttagattttagaaatagaataagcttaagcagagatagagacttaagcacagcacatatggatataagaggattaacacaagacgatacagcaacatatttctgtgcaagacaaaaattcgcaagcagatactcaggagatcaaggaagttatttcgatctatggggaagaggaacactaataatagtaagctcagcatcaacaaaaggaccaagcgtattcccaacaatatgc

SEQ ID NO: 49648 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaatttcggaagtccaaattttagacatagagtaagtttaacaagagacagagatttaagtacagcacatatggatataagaggattaacacaagatgatacagcaacatatttttgtgcaagacaaaaatttgcaagaggagatcaaggatggttttttgatttatggggaagaggaacattaatagtagtaagtagtgcattacatcaaggaccaataggattaccaccaagatcaaca

SEQ ID NO: 49649 - RNA, 423 nt, synthetic construct
  misc_feature 1..423: note = derived and/or modified sequence opt6 from anti-HIV-1_HeavyChain
  source 1..423: mol_type = other RNA
caagtatatatggaacaagcaggaggaggagtaaaaaagccaggagcaagtgtaacattaagctgtaaaacagcagatgaagatgtatttgatgcagcatatatgcattgggtaagacaagcaccaggacaaacatttgaatggttaggatggatgaaaccagtaacaggagcagtaaattatgcaagaaaatttcaaggaagagtaagtttttatagaacaagagaattagggatagcatatatggatttaagaaatctaagatttgatgatacagcggtatatttttgtgcaagaaaaacagcaggagatgtaagtggagataaaagaggatttttttttgatttatggggaagaggaagtagagtaatagtaagtagtgcaagtacaaaaggaccaagtgtattaccaccaagaagtgca

SEQ ID NO: 49650 - RNA, 423 nt, synthetic construct
  misc_feature 1..423: note = derived and/or modified sequence opt6 from anti-HIV-1_HeavyChain
  source 1..423: mol_type = other RNA
caagtccaactagttcaatcaggagcagaagtaaaaaaaccaggagcatcagtaaaaatatcatgcaaagcatcaggatacacatttataagacacggaatacactggctaagacaagtaccaggacaaagaccagaatggatgggatggataagaccaaaaacaggagcaagaaatcaagcaagacaattccaaccaagaatatcactagcaagagacagagcactatcaacagcatacttagacttaaactcactaacatcagcagactcaggaacatacttttgcgcaagacaaacatttaaaccagacttttactttgcagatcaaggatggtcattcaatctatggggcagaggagcacacttcatagtatcatcagcattacaccaaggaccaataggactaccaccaagatcaaca

SEQ ID NO: 49651 - RNA, 426 nt, synthetic construct
  misc_feature 1..426: note = derived and/or modified sequence opt6 from anti-HIV-1_HeavyChain
  source 1..426: mol_type = other RNA
caaagccatctagaacaatcaggatcagcaatgaaaaaaccaggagcatcagtaagagtatcatgctggacatcagaagatatatttgaaagaacagaactaatatactgggtaagacaagcaccaggacaaggactagaatggataggatgggtaaaaatagtaagtggaacagtaaactttgcatcactagatttcagaaacagaatatcactatcaagagatagagatttatcaacagcatacatggacataagaggattaacacaagatgacacagcaacatacttctgcgcaagacaaaaatttgcatcaagatatagtggggaccaaggatcatactttgacttatggggaagaggaacattaatagtagtatcaagcgcaagcacaaaaggaccatcagtatttccacatgacttaaga

SEQ ID NO: 49652 - RNA, 426 nt, synthetic construct
  misc_feature 1..426: note = derived and/or modified sequence opt6 from anti-HIV-1_HeavyChain
  source 1..426: mol_type = other RNA
caagcacatttagaacaaagtggaagtggagtaaaaaaaccaggagcaagcgtaagagtaagttgttggacaagtgaagatatatttgaaagaacagaattaatacattgggtaagacaagcaccaggacaaggattagaatggataggatgggtaaaaacagtaacaggagcagtaaattttggaagcttagattttagacatagaataagtttaacgagagatagagatttatttacagcacatatggatataagaggattaacacaaggagatacagcaacatatttatgtgcaagacaaaaatttgaaagtagatatacaggaggacaaggatggtattttgatttatggggaagaggaacacatatagtagtaagtagtgcaagtacaaaaggaccaagtgtatttccaacaatatgtgta

SEQ ID NO: 49653 - RNA, 426 nt, synthetic construct
  misc_feature 1..426: note = derived and/or modified sequence opt6 from anti-HIV-1_HeavyChain
  source 1..426: mol_type = other RNA
caagcacatttagaacaaagtggaagtggagtaaaaaaaccaggagcaagtgtaagagtaagttgttggacaagtgaagacatatttgatacaacagaattaatatattgggtaagacaagcaccaggacaaggattagaatggataggatgggtaaaaatagtaagtggaacagtaaattttgcaagtttagattttagaaatagaataagtctaagtagagatagagatttaagtacagcatatatggatataagaggattaacacaagatgatacagcaacatatttttgtgcaagacaaaaatttgcaagtagatatagtggagatcaaggaagttattttgatttatggggaagaggaacattaatagtagtaagtagtgcaagtacaaaaggaccaagtgtatttccacaaatatgtgta

SEQ ID NO: 49654 - RNA, 426 nt, synthetic construct
  misc_feature 1..426: note = derived and/or modified sequence opt6 from anti-HIV-1_HeavyChain
  source 1..426: mol_type = other RNA
caagcacacttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagtttagattttagacatagaataagtttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagtgcaagtactaaaggaccaagtgtatttccaacaatatgtgta

SEQ ID NO: 49655 - RNA, 426 nt, synthetic construct
  misc_feature 1..426: note = derived and/or modified sequence opt6 from anti-HIV-1_HeavyChain
  source 1..426: mol_type = other RNA
caagcacatttagaacaatcaggaagcggagtaaaaaaaccaggagcaagtgtaagagtaagttgttggacaagtgaagatatatttgaaaaaagtgaattaatacattgggtaagacaagcaccaggacaaggattagaatggataggatgggtaaaaacagtaacaggagcagtaaattttggaagttcagattttagacaaagagtaagtttaacaagagatagagatttatttacagcacatatggatataagaggattaacacaaggagatacagcaacatatttttgtgcaagacaaaaatttgaaagtttatatagtgatgatcaaggaagttattttgatttatggggaagaggaacattaataatagtaagtagtgcaagcacaaaaggaccaagtgtatttccaacgatatgtgta

SEQ ID NO: 49656 - RNA, 426 nt, synthetic construct
  misc_feature 1..426: note = derived and/or modified sequence opt6 from anti-HIV-1_HeavyChain
  source 1..426: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaagtggagcagtaaattttggatcaccaaattttagacatagagtaagtttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagtgcaagtacaaaaggaccaagcgtatttccacatgatttaaga

SEQ ID NO: 49657 - RNA, 426 nt, synthetic construct
  misc_feature 1..426: note = derived and/or modified sequence opt6 from anti-HIV-1_HeavyChain
  source 1..426: mol_type = other RNA
caaagccatctagaacaatcaggatcagcaatgaaaaaaccaggagcatcagtaagagtatcatgctggacatcggaagatatatttgacacaacagaactaatatactgggtaagacaagcaccaggacaaggactagaatggataggatgggtaaaaatagtaagcggaacagtaaactttgcatcactagatttcagaaacagaatatcactatcaagagatagagatctatcaacagcacacatggacataagaggactaacacaagatgacacagcaacatacttttgcgcaagacaaaaatttgcatcacgatatagcggagaccaaggatcatactttgacttatggggaagaggaacattaataatagtatcaagcgcaagcacaaaaggaccatcagtatttccaacaatatgtgta

SEQ ID NO: 49658 - RNA, 426 nt, synthetic construct
  misc_feature 1..426: note = derived and/or modified sequence opt6 from anti-HIV-1_HeavyChain
  source 1..426: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggaacagtaaattttggaagcttaaattttagacaaagagtaagtttaacaagagatagagatttatttacagcacatatggatataagaggattaacacaagatgatacagcaacatatttttgtgcaagacaaaaatttgcaagtagatattcaggagatcaaggaagttattttgatttatggggaagaggaacactaatagtagtaagtagtgcaagtacaaaaggaccaagtgtatttccaacaatatgtgta

SEQ ID NO: 49659 - RNA, 426 nt, synthetic construct
  misc_feature 1..426: note = derived and/or modified sequence opt6 from anti-HIV-1_HeavyChain
  source 1..426: mol_type = other RNA
caaagtcatttagaacaatcaggatcagcaatgaaaaaaccaggagcatcggtaagagtatcatgctggacatcagaagatatatttgacacaacagaattaatatactgggtaagacaagcaccaggacaaggactagaatggataggatgggtaaaaatagtaagtggaacagtaaactttgcatcactagatttcagaaacagaatatcactatcaagagatagagatttatcaacagcacacatggacataagaggattaacacaagatgacacagcaacatacttttgtgcaagacaaaaatttgcatcaagatatagcggagaccaaggatcatactttgatttatggggaagaggaacattaataatagtatcaagtgcaagcacaaaaggacacagaagttcaccaacaatatgtgta

SEQ ID NO: 49660 - RNA, 423 nt, synthetic construct
  misc_feature 1..423: note = derived and/or modified sequence opt6 from anti-HIV-1_HeavyChain
  source 1..423: mol_type = other RNA
caagtgtatatggaacaagcaggagcaggaatgaaaaaaccaggagcaagcatgacagtaagttgtaaaacagcagatgaagatgtatttgatgcagcatatatgcattgggtaagacaagcaccaggacaaacatttgaatggttaggatggatgaaaccagtaacgggggcagtaaattatgcaagaaaatttcaaggaagagtaagtttttatagaacaagagaattaggaatagcatatatggatttaagaaatttaagatttgatgatacagcagtatatttttgtgcaagaaaaacagcaggagatgtaagcggagataaaagaggatttttttttgatttatggggaagaggaagtagagtaatagtaagtagtgcaagcacaaaaggaccaagtgtatttccaacaatatatgta

SEQ ID NO: 49661 - RNA, 423 nt, synthetic construct
  misc_feature 1..423: note = derived and/or modified sequence opt6 from anti-HIV-1_HeavyChain
  source 1..423: mol_type = other RNA
caatcacacctagaacaaagcggaagcgcaatgaaaaaaccaggagcaagcgtaagagtaagctgttggacgagtgaagacatattcgatacaacagaattatactgggtaagacaagcaccaggacaaggactagaatggataggatgggtaaaaatagtaagcggaacagtaaactttgcatcactagatttcagaaacagaatatcactatcaagagatagagatttatcaacagcatacatggacataagaggactaacacaagatgacacagctacatacttttgcgcaagacaaaaatttgcatcaagatatagtggagaccaaggatcatactttgacctatggggaagaggaacattaatagtagtatcaagtgcaagtacaaaaggaccatcagtatttccacatgacttaaga

SEQ ID NO: 49662 - RNA, 423 nt, synthetic construct
  misc_feature 1..423: note = derived and/or modified sequence opt6 from anti-HIV-1_HeavyChain
  source 1..423: mol_type = other RNA
caaagtcatttagaacaaagtggaagtgcaatgaaaaaaccaggagcaagtgtaagagtaagttgttggacaagcgaagatatatttgatacaacagaattaatatattgggtaagacaagcaccaggacaagggttagaatggataggatgggtaaaaatagtaagtggaacagtaaattttgcaagacaatttcaaggaagagtaagtttttatagaacaagagaattaggaatagcatatatggatttaagagatttaaaatttgatgatacagcagtatatttttgtgcaagaaaaacaaaaggagatgtaagtggagatgatagaggatttttttttgatttatggggaagaggaacaagagtaatagtaagtagtgcaagtacaaaaggaccatcagtatttccacatgatccagca

SEQ ID NO: 49663 - RNA, 426 nt, synthetic construct
  misc_feature 1..426: note = derived and/or modified sequence opt6 from anti-HIV-1_HeavyChain
  source 1..426: mol_type = other RNA
caagcacatttagaacaaagtgggagtggagtaaaaaaaccaggagcaagtgtaagagtaagttgttggacaagtgaagatatattcgaaaaaagtgaattaatacattgggtaagacaagcaccaggacaaggattagaatggataggatgggtaaaaacagtaacaggagcagtaaattttggaagtagtgattttagacaaagagtaagtctaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagtgcaagtacaaaaggaccaagtgtatttccaacaatatgtgta

SEQ ID NO: 49664 - RNA, 426 nt, synthetic construct
  misc_feature 1..426: note = derived and/or modified sequence opt6 from anti-HIV-1_HeavyChain
  source 1..426: mol_type = other RNA
caagcacacctagaacaaagcggaagcggagtaaaaaaaccaggagcaagtgtaagagtaagctgttggacaagcgaagatatattcgaaagatcagaattaatacattgggtaagacaagcaccaggacaaggattagaatggataggatgggtaaaaacagtaacaggagcagtaaatttcggaagcccaaactttagacaaagagtaagcttaacaagagacagagacttaagcacagcacatatggatataagaggattaacacaagacgatacagcaacctatttctgtgcaagacaaaaattcgaaagcttatactcagacgatcaaggaagctatttcgatttatggggaagaggaacactaataatagtaagttcagcatcaacaaaaggaccaagcgtattcccaacaatatgcgta

SEQ ID NO: 49665 - RNA, 426 nt, synthetic construct
  misc_feature 1..426: note = derived and/or modified sequence opt6 from anti-HIV-1_HeavyChain
  source 1..426: mol_type = other RNA
caagcacatttagaacaaagtgcaagcggagtaaaaagaccaggagcaagtgtgagagtaagttgttggacaagtgaagatatatttgaaagaacagaattaatatattgggtaagacaagcaccaggacaaggattagaatggataggatgggtaaaaacagtatcaggagcagtaaattttggaagtcaagattttagagatagatttagtttaacaagagatagagatttatttacagcacatatggatataagaggattaacacaaggagatacagcaacatatttttgtgcgagacaaaaatttgcaagtaggtatagtggagatcaaggaagttattttgatttatggggaagaggaacattaatagtagtaagtagtgcaagtacaaaaggaccaagtgtatttccaacaatatgtgta

SEQ ID NO: 49666 - RNA, 426 nt, synthetic construct
  misc_feature 1..426: note = derived and/or modified sequence opt6 from anti-HIV-1_HeavyChain
  source 1..426: mol_type = other RNA
caagcacatttagaacaaagtggaagtggagtaaaaaaattaggagcgagtgtaagagtaagttgttggacaagtgaagatatatttgaaagaacagaattaatacattgggtaagacaagcaccaggacaaggactagaatggataggatgggtaaaagcagtaagcggagcagtaaattatggaagtttagattttagacatagagtaagtttaacaagagatagagatttatttacagcacatatggatataagaggattaacacaagatgatacagcaacatatttttgtgcaagacaaaaatttgaaagtagatatacaggaggacaaggatggtattttgatttatggggaagaggaacacatatagtagtaagtagcgcaagtacaaaaggaccaagtgtatttccaacaatatgtgta

SEQ ID NO: 49667 - RNA, 423 nt, synthetic construct
  misc_feature 1..423: note = derived and/or modified sequence opt6 from anti-HIV-1_HeavyChain
  source 1..423: mol_type = other RNA
caagtacatatggaacaagcaggaggaggaatgaaaaaaccaggagcatcaatgacagtaagttgtaaaacagcagatgaagatatatttgatgcagcatatatgcattgggtaagacaagcaccaggacaaacatttgaatggttaggatggatgaaaccagtaacaggagcagtaaattatgcaagacaatttcaaggaagagtaagttttctacaagatcaaggaataagaatagcatatatggatttaagagatttaaaatttgatgatacagcagtatatttttgtgcaagaaaaacaaaaggagatgtaagcggagatgatagaggatttttttttgatttatggggaagaggaacaagagtaatagtaagtagtagtttacatcaaggaccaataggattaccaccaagaagtgca

SEQ ID NO: 49668 - RNA, 426 nt, synthetic construct
  misc_feature 1..426: note = derived and/or modified sequence opt6 from anti-HIV-1_HeavyChain
  source 1..426: mol_type = other RNA
caagcacatttagaacaaagtggaagtggagtaaaaaaaccaggagcaagtgtaagagtaagttgttggacaagtgaagatatatttgaaaaaagtgaattaatacattgggtaagacaagcaccaggacaaggattagaatggataggatgggtaaaaacagtaacaggagcagtaaattttggaagcagtgattttagacatagaataagcttaacaagagatagagatctatttacagcacatatggatataagaggattaacacaaggagatacagcaacatatttttgtgcgagacaaaaatttgaaagtagatatacaggaggacaaggatggtattttgatttatggggaagaggaacacatatagtagtaagtagtgcaagtacaaaaggaccaagtgtatttccaacaatatatgta

SEQ ID NO: 49669 - RNA, 426 nt, synthetic construct
  misc_feature 1..426: note = derived and/or modified sequence opt6 from anti-HIV-1_HeavyChain
  source 1..426: mol_type = other RNA
caagtatatatggaacaagcaggaggaggagtaaaaaaaccaggagcaagtgtaacgttaagttgtaaaacagcagatgaagatgtatttgatgcagcatatatgcattgggtaaggcaagcaccaggacaaacatttgaatggttaggatggatgaaaccagtaacaggagcagtaaattatgcaagaaattttcaaggaagagtaagtttttatagaacaagagaattaggaatagcatatatggatttaagaaatttaagatttgatgatacagcagtatatttttgtgcaagaaaaacaaaaggagatgtaagtggagatgatagaggatttttttttgatttatggggaagaggaacaagagtaatagtaagtagtggattacatcaaagagcacatagaagtagtccaacaatatgtgta

SEQ ID NO: 49670 - RNA, 426 nt, synthetic construct
  misc_feature 1..426: note = derived and/or modified sequence opt6 from anti-HIV-1_HeavyChain
  source 1..426: mol_type = other RNA
caaagtcatttagaacaaagcggaagtgcaatgaaaaaaccaggagcaagtgtaagagtaagttgttggacaagtgaagatatatttgatacaacagaattaatatattgggtaaggcaagcaccaggacaaggattagaatggataggatgggtaaaaatagtaagtggaacagtaaattttgcaagtttagattttagaaatagaataagcttaagtagagatagagatttaagtacagcatatatggatataagaggattaacacaagatgatacagcaacatatttttgtgcaagacaaaaatttgcaagtagatatagtggagatcaaggaagttattttgatttatggggaagaggaacattaatagtagtaagcagtgcaagtacaaaaggaccaagtgtatttccaacaatatgtgta

SEQ ID NO: 49671 - RNA, 423 nt, synthetic construct
  misc_feature 1..423: note = derived and/or modified sequence opt6 from anti-HIV-1_HeavyChain
  source 1..423: mol_type = other RNA
caagtatatatggaacaagcaggagtaggagtaaaaaaaccaggagcaagtgtaacattaagttgtaaaacggcagatgaagatgtatttgatgcagcatatatgcattgggtaagacaagcaccaggaccagatttagaatggttaggatggatgaaaccagtaacaggagcagtaaattatgcaagaaaatttcaaggaagagtaagtttttatagaacaagagaattaggaatagcatatatggatttaagaaatttaagatttgatgatacagcagtatatttttgtgcaagaaaaacagcaggagatgtaagcggagataaaagaggatttttttttgatttatggggaagaggaagtagagtaatagtaagtagtgcaagtacaaaaggaccaagtgtatttccaacaatatgtgta

SEQ ID NO: 49672 - RNA, 426 nt, synthetic construct
  misc_feature 1..426: note = derived and/or modified sequence opt6 from anti-HIV-1_HeavyChain
  source 1..426: mol_type = other RNA
caatcacatctagaacaatcaggatcagcaatgaaaaaaccaggagcatcagtaagagtaagttgctggacatcagaagatatatttgacacaacagaattaatatactgggtaagacaagctccaggacaaggactagaatggataggatgggtaaaaatagtaagcggaacagtaaactttgcatcactagatttcagaaacaggatatcactatcaagagatagagatttaagtacagcacacatggacataagaggattaacacaagatgacacagcaacgtacttttgtgcaagacaaaaatttgcatcaagatatagcggagaccaaggatcatactttgacttatggggaagaggaacattaataatagtaagtagtgcaagcacaaaaggaccatcagtatttccacatgacttaaga

SEQ ID NO: 49673 - RNA, 426 nt, synthetic construct
  misc_feature 1..426: note = derived and/or modified sequence opt6 from anti-HIV-1_HeavyChain
  source 1..426: mol_type = other RNA
caagcacatttagaacaaagtggaagtggagtaaaaaaattaggagcaagtgtaagagtaagttgttggacaagtgaagatatatttgaaagaacagaattaatacattgggtaagacaagcaccaggacaaggattagaatggataggatgggtaaaagcagtaacaggagcagtaaattttggaagtttagattttagacataggataagtttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagcagtgcaagtacaaaaggaccaagtgtatttccacatgatttaaga

SEQ ID NO: 49674 - RNA, 426 nt, synthetic construct
  misc_feature 1..426: note = derived and/or modified sequence opt6 from anti-HIV-1_HeavyChain
  source 1..426: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaaagaataggatgggtaaaaacagtaacaggagcagtgaattttggaagtctagattttagacatagaataagtctaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagtgcaagtacaaaaggaccaagcgtatttccaacaatatgtgta

SEQ ID NO: 49675 - RNA, 423 nt, synthetic construct
  misc_feature 1..423: note = derived and/or modified sequence opt6 from anti-HIV-1_HeavyChain
  source 1..423: mol_type = other RNA
gaagtatatatggaaagaggaagaggaggagtaaaaaaaccaggagcaagtgcaacattaagttgtaaaacagcagatgaagatgtatttgatgcagcatatatgcattgggtaagacaagcaccaggacaaacatttgaatggttaggatggatgaaaccagtaacaggagcagtaagctatgcaagaaaatttcaaggaagagtaagtttttatatgacaagagaattaggaatggcatatatggatttaagaaatttaagatttgatgatacagcagtatatttttgtgcaagaaaaacagcaggagatgtaagcggagataatagaggatatttttttgatctatggggaaggggaagtagagtaatagtaagtagtgcaagtacaaaaggaccaagtgtatttccacatgatttaaga

SEQ ID NO: 49676 - RNA, 426 nt, synthetic construct
  misc_feature 1..426: note = derived and/or modified sequence opt6 from anti-HIV-1_HeavyChain
  source 1..426: mol_type = other RNA
caagcacatttagaacaaagtggaagtggagtaaaaaaaccaggagcaagtgcaagagtaagttgttggagtagtgaagatatatttgaaagaatagaactaatacattgggtaagacaagcaccagggcaaggattagaatggataggatgggtaaaaacagtagcaggagcagtaaattttggaagcctagattttagacatagaataagtttaacaagagatagagatttatttacagcacatatggatataagaggattaacacaaggagatacagcaacatatttttgtgcaagacaaaaatttgaaagcagatatacaggaggacaaggatggtattttgatttatggggaagaggaacacatatagtagtaagtagtgcaagtacaaaaggaccaagtgtatttccacatgatttaaga

SEQ ID NO: 49677 - RNA, 426 nt, synthetic construct
  misc_feature 1..426: note = derived and/or modified sequence opt6 from anti-HIV-1_HeavyChain
  source 1..426: mol_type = other RNA
caatcacacttagaacaaagcggaagcgcaatgaaaaaaccaggagcaagtgtaagagtaagctgttggacaagtgaagacatatttgatacaacagaattaatatattgggtaagacaagcaccaggacaaggattagaatggataggatgggtaaaaatagtatcaggaacagtaaatttcgcaagcttagactttagaaatagaataagcttaagcagagacagagacttaagtacagcacatatggatataagaggattaagacaagacgatacagcaacatatttctgtgcaagacaaaaattcgaaagtagatactcaggagatcaaggaagttatttcgatctatggggaagaggaacactaataatagtaagctcagcatcaacaaaaggaccaagcgtattcccaacaatatacgta

SEQ ID NO: 49678 - RNA, 426 nt, synthetic construct
  misc_feature 1..426: note = derived and/or modified sequence opt6 from anti-HIV-1_HeavyChain
  source 1..426: mol_type = other RNA
caaagtcatttagaacaatcgggatcagcaatgaaaaaaccaggagcatcagtaagagtatcatgttggacaagtgaagatatatttgacacaacagaattaatatactgggtaagacaagcacccggacaaggactagaatggataggatgggtaaaaatagtaagtggaacagtaaactttgcatcactagatttcagaaacggaatatcactatcaagagatagagatttatcaacagcatacatggacataagaggactaacacaagatgacacagcaacatacttttgcgcaagacaaaaatttgcatcaagatatagtggagaccaaggatcatactttgacttatggggaagaggaacattaatagtagtatcaagtgcaagcacaaaaggaccatcagtatttccacatgacttaaga

SEQ ID NO: 49679 - RNA, 426 nt, synthetic construct
  misc_feature 1..426: note = derived and/or modified sequence opt6 from anti-HIV-1_HeavyChain
  source 1..426: mol_type = other RNA
caaagccatctagaacaatcaggatcagcaatgaaaaaaccaggagcatcagtaagagtatcatgctggacatcagaagatatatttgacacaacagaactaatatactgggtaagacaagcaccaggacaaggactagaatggataggatgggtaaaaatagtaagcggaacagtaaactttgcatcactagatttcagaaacagaatatcactatcgagagatagagatctatcaacagcacacatggacataagaggactaacacaagatgacacagcaacatacttttgcgcaagacaaaaatttgcatcaagatatagtggagaccaaggatcatactttgacttatggggaagaggaacattaatagtagtatcaagtgcaagcacaaaaggaccatcagtatttccacatgacttaaga

SEQ ID NO: 49680 - RNA, 426 nt, synthetic construct
  misc_feature 1..426: note = derived and/or modified sequence opt6 from anti-HIV-1_HeavyChain
  source 1..426: mol_type = other RNA
caagcacatttagaacaaagtggaagtggagtaaaaaaaccaggagcaagcgtaagagtaagttgttggacaagcggagatatattaagaaaaagcgaattaatacattgggtaagacaagcaccaggacaaggattagaatggataggatgggtaaaaacagtaacaggagcagtaaattttggaagtttagattttagacatagaataagtttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagcgcaagtacaaaaggaccaagtgtatttccacatgatttaaga

SEQ ID NO: 49681 - RNA, 426 nt, synthetic construct
  misc_feature 1..426: note = derived and/or modified sequence opt6 from anti-HIV-1_HeavyChain
  source 1..426: mol_type = other RNA
caagtacatttagaacaaagtggaagtggagtaaaaaaaccaggagcaagtgtaagagtaagttgttggagtagtgaagatatatttgaaagaacagaattaatacattgggtaagacaagcaccaggacaaggattagaatggataggatgggtaaaaacagtgacaggggcagtaaattttggaagtttagattttagacatagaataagtttaacaagagatagagatctatttacagcgcatatggatataagaggattaacacaaggagatacagcaacatatttttgtgcaagacaaaaatttgaaagtagatatacaggaggacaaggatggtattttgatttatggggaagaggaacacatatagtagtaagtagtgcatgtacaaaaggaccaagtgtatttccacatgatttaaga

SEQ ID NO: 49682 - RNA, 426 nt, synthetic construct
  misc_feature 1..426: note = derived and/or modified sequence opt6 from anti-HIV-1_HeavyChain
  source 1..426: mol_type = other RNA
caagcacatttagaacaaagttggagtggagtaaaaaaaccaggagcaagtgtaagagtaagttgttggagtagtgaagatatatttgaaagaacagaattaatacattgggtaaggcaagcaccaggacaaggattagaatggataggatgggtaaaaacagtaacaggagcagtaaattttggaagtttagattttagacatagaataagtttaacaagagatagagatttatttacagcacatatggatataagaggattaacacaaggagatacagcaacatatttttgtgcaagacaaaaatttgaaagtagatatacaggaggacaaggatggtattttgacttatggggaagaggaacacatatagtagtaagtagtgcaagtacaaaaggaccatcagtatttccacatgatttaaga

SEQ ID NO: 49683 - RNA, 426 nt, synthetic construct
  misc_feature 1..426: note = derived and/or modified sequence opt6 from anti-HIV-1_HeavyChain
  source 1..426: mol_type = other RNA
caaagccatctagaacaatcaggatcagcaatgaaaaaaccaggagcaagtgtaagagtaagttgctggacatcagaagatatatttgaaagaacagaactaatatactgggtaagacaagcaccaggaagaggaccagaatggataggatgggtaaaaacagtaagcggaacagtaaactttggatcaagcgatttcaggaacagaatatcactaacaagagatagagatctatcaacagcacacatggacataagaggactaacacaagatgacacagcaacatacttttgcgcaagacaaaaatttgaatcattatatagcgatgaccaaggatcatattttgacttatggggaagaggaacattaataatagtaagcagcgcaagcacaaaaggaccatcagtatttccacatgacctaaga

SEQ ID NO: 49684 - RNA, 426 nt, synthetic construct
  misc_feature 1..426: note = derived and/or modified sequence opt6 from anti-HIV-1_HeavyChain
  source 1..426: mol_type = other RNA
caagcacatttagaacaaagtggaagcggagtaaaaaaaccaggagcaagtgtaagagtaagttgttggagtagtgaagatatatttgaaagaacagaattaatacattgggtaagacaagcaccaggacaaggactagaatggataggatgggtaaaaacagtaacaggagcagtaaattttggaagtttagattttagacatagaataagtttaacaagagatagagatttatttacagcacatatggatataagaggactaacacaaggagatacagcaacatatttttgtgcaagacaaaaatttgaaagtagatatacaggaggacaaggatggtattttgatttatggggaagaggaacacatatagtagtaagtagtgcaagtacaaaaggaccaagtgtatttccaacaatattaaga

SEQ ID NO: 49685 - RNA, 426 nt, synthetic construct
  misc_feature 1..426: note = derived and/or modified sequence opt6 from anti-HIV-1_HeavyChain
  source 1..426: mol_type = other RNA
caaagtcatttagaacaaagtggaagtgcaatgaaaaaaccaggagcatcagtaagagtaagttgttggacaagtgaagatatatttgaaagaacagaattaatatattgggtaagacaagcaccaggaagaggattagaatggataggatgggtaaaaacagtaagtggaacagtaaattttggaagtagtgattttagaaatagaatatcattaacaagagacagagatttaagtacagcacatatggatataagaggattaacacaagatgatacagcaacatatttttgtgcaagacaaaaatttgaaagtttatatagtgatgatcaaggaagttattttgatttatggggaagaggaacattaatagcagtaagtagtgcaagtacaaaaggaccaagtgtatttccacatgatttaagg

SEQ ID NO: 49686 - RNA, 426 nt, synthetic construct
  misc_feature 1..426: note = derived and/or modified sequence opt6 from anti-HIV-1_HeavyChain
  source 1..426: mol_type = other RNA
caaagtcatttaaaacaaagtggaagtgcaatgaaaaaaccaggagcaagtgtaagagtaagttgttggacaagtgaagatatatttgaaagaacagaattaatatattgggtaagacaagcaccaggaagaggattagaatggataggatgggtaaaaacagtaagtggaacagtaaattttggaagttcagattttagaaatagaataagtttaacaagagatagagatttaagtacagcacatatggatataagaggattaacacaagatgatacagcaacatatttttgtgcaagacaaaaatttgaaagtttatattcagatgatcaaggaagttattttgatttatggggaagaggaacattaataatagtaagtagtgcaagcacaaaaggaccaagtgtatttccacatgatttaaga

SEQ ID NO: 49687 - RNA, 426 nt, synthetic construct
  misc_feature 1..426: note = derived and/or modified sequence opt6 from anti-HIV-1_HeavyChain
  source 1..426: mol_type = other RNA
caagcacatttagaacaaagtggaagtggagtaaaaaaattaggagcaagtgtaagagtaagttgttggacaagtgaagatatatttgaaagaacagaattaatacattgggtaaggcaagcaccaggacaaggattagaatggatagaatgggtaaaagcagtatcaggagcagtaaattatggaagtttagattttaggcatagagtaagtttaacaagagatagagatttatttacagcacatatggatataagaggattaacacaagatgatacagcaacatatttttgtgcaagacaaaaatttgaaagcagatatacaggaggacaaggatggtattttgatttatggggtagaggaacacatatagtagtaagttcagcatcaacaaaaggaccaagtgtatttccacatgatttaaga

SEQ ID NO: 49688 - RNA, 426 nt, synthetic construct
  misc_feature 1..426: note = derived and/or modified sequence opt6 from anti-HIV-1_HeavyChain
  source 1..426: mol_type = other RNA
caaagccatctagaacaatcaggatcagcaatgaaaaaaccaggagcatcagtaagggtatcatgctggacatcagaagatatatttgacacaacagaactaatatactgggtaagacaagcaccaggacaaggactagaatggataggatgggtaaaaatagtaagcggaacagtaaactttgcatcactagatttcagaaacagaatatcactatcgagagatagagatttatcaacagcacacatggacataagaggactaacacaagatgacacagcaacatacttttgcgcaagacaaaaatttgaatcaagatatagcggagaccaaggatcatactttgacttatggggaagaggaacattaataatagtatcaagcgcaagcacaaaaggaccatcagtatttccacatgacttaaga

SEQ ID NO: 49689 - RNA, 426 nt, synthetic construct
  misc_feature 1..426: note = derived and/or modified sequence opt6 from anti-HIV-1_HeavyChain
  source 1..426: mol_type = other RNA
caagcacatttagaacaaagtggaagtggagtaaaaaaaccaggagcaagtgtaagagtaagttgttggacaagtgaagatatatttgaaaaaagtgaattaatacattgggtaagacaagcaccaggacaaggattagaatggataggatgggtaaaaacagtaacaggagcagtaaattttggaagtctagattttagaaatagaataagtctaagtagagatagagatctaagtacagcatatatggatataagaggattaacacaagatgatacagcaacatatttttgtgcaagacaaaaatttgcaagtagatatagtggagatcaaggaagttattttgatttatggggaagaggaacattaatagtagtaagcagtgcaagtacaaaaggaccaagtgtatttccacatgatttaaga

SEQ ID NO: 49690 - RNA, 426 nt, synthetic construct
  misc_feature 1..426: note = derived and/or modified sequence opt6 from anti-HIV-1_HeavyChain
  source 1..426: mol_type = other RNA
caagcacatttagaacaaagtggaagtggagtaaaaaaaccaggagcaagtgtaagagtaagttgttggacaagcgaagatatatttgaaagaagtgaattaatacattgggtaagacaagcaccgggacaaggattagaatggataggatgggtaaaaacagtaacaggagcagtaaattttggaagtccaaattttagacaaagagtaagtttaagtagagatagagatttaagtacagcacatatggatataagaggattaacacaagatgatacagcaacatatttttgtgcaagacaaaaatttgcaagtagatatagtggagatcaaggaagttattttgatttatggggaagaggaacattaataatagtaagtagtgcaagtacaaaaggaccaagtgtatttccacatgatttaaga

SEQ ID NO: 49691 - RNA, 426 nt, synthetic construct
  misc_feature 1..426: note = derived and/or modified sequence opt6 from anti-HIV-1_HeavyChain
  source 1..426: mol_type = other RNA
caaagtcatttagaacaaagtggaagtgcaatgaaaaaaccaggagcaagtgtaagagtaagttgttggacaagtgaagatatatttgaaagaacggaactaatatattgggtaagacaagcaccaggaagaggattagaatggataggatgggtaaaaacagtaagtggaacagtaaattttggaagtagtgattttagaaatagaataagtttaacaagagatagagatttaagtacagcacatatggatataagaggattaacacaagatgatacagcaacatatttttgtgcgagacaaaaatttgaaagtttatatagtgatgatcaaggaagttattttgatttatggggaagaggaacattaataatagtaagtagtgcaagtacaaaaggaccaagtgtatttccacatgatttaaga

SEQ ID NO: 49692 - RNA, 426 nt, synthetic construct
  misc_feature 1..426: note = derived and/or modified sequence opt6 from anti-HIV-1_HeavyChain
  source 1..426: mol_type = other RNA
caagcacatttagaacaatcaggatcaggagtaaaaaaaccaggagcatcagtaagagtatcatgctggacatcagaagatatatttgaaagaacagaactaatacactgggtaagacaagcaccaggaagaggactagaatggataggatgggtaaaaacagtaagcggaacagtaaactttggatcaagcgatttcagaaacagaataagtctaacaagagatagagatttatcaacagcacacatggatataagaggactaacacaagatgatacagcaacatacttttgtgcaagacaaaaatttgaatcactatatagcgatgaccaaggaagttactttgacttatggggaagaggaacattaataatagtatcaagcgcaagcacaaaaggaccatcagtatttccacatgacttaaga

SEQ ID NO: 49693 - RNA, 426 nt, synthetic construct
  misc_feature 1..426: note = derived and/or modified sequence opt6 from anti-HIV-1_HeavyChain
  source 1..426: mol_type = other RNA
caagtacatttagaacaaagcggaagcggagtaaaaaaaccaggagcaagtgtaagagtaagttgttggtcaagtgaagatatatttgaaagaacagaattaatacattgggtaagacaagcaccaggacaaggattagaatggataggatgggtaaaaacagtaacaggagcagtaaattttggaagtttagattttagacatagaataagtttaacaagagatagagacttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagtgcaagcacaaaaggaccaagcgtattcccacatgatttaaga

SEQ ID NO: 49694 - RNA, 426 nt, synthetic construct
  misc_feature 1..426: note = derived and/or modified sequence opt6 from anti-HIV-1_HeavyChain
  source 1..426: mol_type = other RNA
caaagtcatttagaacaaagtggaagcgcaatgaaaaaaccaggagcaagtgtaagagtaagttgttggacaagtgaagatatatttgatacaacagaattaatatattgggtaagacaagcaccaggacaaggattagaatggataggatgggtaaaaatagtaagtggaacagtaaattttgcaagcttagattttagaaatagaataagtctaagtagagatagagatttaagtacagcacatatggatataagaggattaagacaagatgatacagcaacatatttttgtgcaagacaaaaatttgaaagtagatatagtggagatcaaggaagttattttgatttatggggaagaggaacattaataatagtaagcagtgcaagtacaaaaggaccaagtgtatttccacatgatttaaga

SEQ ID NO: 49695 - RNA, 423 nt, synthetic construct
  misc_feature 1..423: note = derived and/or modified sequence opt6 from anti-HIV-1_HeavyChain
  source 1..423: mol_type = other RNA
caagtatatatggaacaagcaggagcaggagtaaaaaaaccaggagcaagtgtaacattaagttgtaaaacagcagatgaagatgtatttgatgcagcatatatgcattgggtaagacaagcaccaggacaaacatttgaatggttaggatggatgaaaccagtaacaggagcagtaagttatgcaagaaaatttcaaggaagagtaagtttttatatgacaagagaattaggagtagcatatatggatttaagaaatttaagatttgatgatacagcagtatatttttgtgcaagaaaaacagcaggagatgtaagtggagataatagaggatatttttttgatttatggggaagaggaagtagagtaatagtaagttcagcatcaacaaaaggaccaagtgtatttccacatgatttaaga

SEQ ID NO: 49696 - RNA, 426 nt, synthetic construct
  misc_feature 1..426: note = derived and/or modified sequence opt6 from anti-HIV-1_HeavyChain
  source 1..426: mol_type = other RNA
caatcacacttagaacaaagcggaagtgcaatgaaaaaaccaggagcaagcgtaagagtaagctgttggacaagcgaagacatattcgacacaacagaattaatatattgggtaagacaagcaccaggacaaggattagaatggataggatgggtaaaaatagtatcaggaacagtaaatttcgcaagcttagactttagaaatagaataagcttatcaagagacagaaacctaagcacagcacatatggatataagaggattaagacaagacgatacagcaacatatttctgtgcaagacaaaaattcgaaagcagatactcaggagatcaaggaagttatttcgatctatggggaagaggaacattaataatagtaagctcagcatcaacaaaaggaccaagcgtattcccacacgatctaaga

SEQ ID NO: 49697 - RNA, 423 nt, synthetic construct
  misc_feature 1..423: note = derived and/or modified sequence opt6 from anti-HIV-1_HeavyChain
  source 1..423: mol_type = other RNA
caagtacaactagtacaaagtggagcagaagtaaaaaaaccaggagcaagtgtaacattaagttgtaaaacagcagatgaagatgtatttgatgcagcatatatgcattgggtaagacaagcaccaggacaaacatttgaatggctaggatggatgaaaccagtaacaggagcagtaagttatgcaagaaaatttcaaggaagagtaagtttttatatgacaagagaattaggaatggcatatatggatttaagaaatttaagatttgatgatacagcagtatatttttgtgcaagaaaaacagcaggagatgtaagcggagataatagaggatatttttttgatttatggggaagaggaagtagagtaatagtaagtagtgcaagtacaaaaggaccaagtgtatttccaacaatatatgta

SEQ ID NO: 49698 - RNA, 426 nt, synthetic construct
  misc_feature 1..426: note = derived and/or modified sequence opt6 from anti-HIV-1_HeavyChain
  source 1..426: mol_type = other RNA
caagcacatttagaacaatcaggatcaggagtaaaaaaaccaggagcatcagtaagagtaagttgttggacaagtgaagatatatttgaaagaacagaattagtacactgggtaagacaagcaccaggacaaggattagaatggataggatgggtaaaaacagtaacaggagcagtaaattttggatcaccaaattttagacaaagagtatcattaacaagagatagagatttatttacagcacatatggatataagaggattaacacaagatgacacagcaacatatttttgtgcaagacaaaaatttgcatcaagatatagtggagatcaaggatcatattttgatttatggggaagaggaacattaatagtagtatcaagtgcaagcacaaaaggaccatcagtatttccacatgatttaaga

SEQ ID NO: 49699 - RNA, 426 nt, synthetic construct
  misc_feature 1..426: note = derived and/or modified sequence opt6 from anti-HIV-1_HeavyChain
  source 1..426: mol_type = other RNA
caaagtcatttagaacaatcaggatcagcaatgaaaaaaccaggagcaagtgtaagagtatcatgttggacatcagaagatatatttgacacaacagaattaatatactgggtaagacaagcaccaggacaaggactagaatggataggatgggtaaaaatagtaagcggaacagtaaactttgcaagtctagatttcagaaacagaatatcactatcaagagatagagatttaagtacagcatacatggacataagaggactaacacaagatgacacagcaacatatttttgtgcaagacaaaaatttgcatcaagatatagcggagaccaaggatcatactttgacttatggggaagaggaacattaataatagtatcaagtgcaagcacaaaaggaccattaggattaccacatgacttaaga

SEQ ID NO: 49700 - RNA, 426 nt, synthetic construct
  misc_feature 1..426: note = derived and/or modified sequence opt6 from anti-HIV-1_HeavyChain
  source 1..426: mol_type = other RNA
caagcacatttagaacaaagcggaagtggagtaaaaaaactaggagcaagtgtaagagtaagttgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagtttaacaagagatagagatttaagtacagcacatatggatataagaggattaacacaagatgatacagcaacatatttttgtgcaagacaaaaatttgcaagtagatattcaggagatcaaggaagctattttgatttatggggaagaggaacattaatagttgtaagttcagcatcaacaaaaggaccaagtgtatttccacatgatttaaga

SEQ ID NO: 49701 - RNA, 426 nt, synthetic construct
  misc_feature 1..426: note = derived and/or modified sequence opt6 from anti-HIV-1_HeavyChain
  source 1..426: mol_type = other RNA
caagcacatctagaacaatcaggatcaggagtaaaaaaaccaggagcatcagtaagagtatcatgctggacatcagaagatatatttgaaagaacagaactaatatactgggtaagacaagcaccaggacaaggactagaatggataggatgggtaaaaatagtaagcggaacagtaaactttgcatcactagatttcagaaacagaatatcattatcaagagatagagatctatcaacagcacacatggacataagaggattaacacaagatgacacagcaacatacttttgcgcaagacaaaaatttgcatcaagatatagcggagaccaaggatcatactttgacttatggggaagaggaacattaataatagtatcaagcgcaagcacaaaaggaccatcagtatttccacatgacttaaga

SEQ ID NO: 49702 - RNA, 426 nt, synthetic construct
  misc_feature 1..426: note = derived and/or modified sequence opt6 from anti-HIV-1_HeavyChain
  source 1..426: mol_type = other RNA
caagcacacttagaacaaagcggaagcggagtaaaaaaaccaggagcaagcgtaagagtaagctgttggacaagtgaagacatattcgaaagaacagaattaatacattgggtaagacaagcaccaggacaaggattagaatggataggatgggtaaaaacagtaacaggagcagtaaatttcggaagcccaaactttagaaatagaataagcttaacaagagacagagacttaagcacagcacatatggatataagaggattaacacaagatgatacagcaacatatttctgtgcaagacaaaaattcgaaagcttatactcagacgatcaaggaagttatttcgatctatggggaagaggaacattaataatagtaagctcagcatcaacaaaaggaccaagtgtattcccacacgatctaaga

SEQ ID NO: 49703 - RNA, 426 nt, synthetic construct
  misc_feature 1..426: note = derived and/or modified sequence opt6 from anti-HIV-1_HeavyChain
  source 1..426: mol_type = other RNA
caagcacatcttgaacaatcaggatcaggagtaaaaaaaccaggagcatcagtaagagtatcatgttggacatcagaagatatatttgaaaaaagtgaattaatacattgggtaagacaagcaccaggacaaggattagaatggataggatgggtaaaaacagtaacaggagcagtaaattttggaagtagtgattttagacaaagagtatcattaacaagagatagagatttatttacagcacatatggatataagaggattaacacaaggagatacagcaacatatttttgcgcaagacaaaaatttgaatcattatatagtgatgatcaaggatcatattttgatctatggggaagaggaacattaataatagtatcaagtgcaagtacaaaaggaccaagcgtatttccacatgatttaaga

SEQ ID NO: 49704 - RNA, 426 nt, synthetic construct
  misc_feature 1..426: note = derived and/or modified sequence opt6 from anti-HIV-1_HeavyChain
  source 1..426: mol_type = other RNA
caagcacatctagaacaatcaggatcaggagtaaaaaaaccaggagcatcagtaagagtatcatgctggacatcagaagatatatttgaaagaacagaattaatacactgggtaagacaagcaccaggacaaggactagaatggataggatgggtaaaaacagtaacaggagcagtaaactttggatcaagcgatttcagaaacagaatatcactaacaagagatagagatctatcaacagcacacatggacataagaggactaacacaagatgacacagcaacatacttttgcgcacgacaaaaatttgaatcactatatagcgatgaccaaggatcatactttgacttatggggaagaggaacactaataatagtatcaagtgcaagcacaaaaggaccatcagtatttccacatgacctaaga

SEQ ID NO: 49705 - RNA, 426 nt, synthetic construct
  misc_feature 1..426: note = derived and/or modified sequence opt6 from anti-HIV-1_HeavyChain
  source 1..426: mol_type = other RNA
caaagccatctagaacaatcaggatcagcaatgaaaaaaccaggagcatcagcaagagtatcatgctggacatcagaagatatatttgacacaacagaactaatatattgggtaagacaagcaccaggacaaggactagaatggataggatgggtaaaaatagtaagcggaacagtaaactttgcatcattagatttcagaaacagaatatcactatcaagagatagagatctatcaacagcacacatggacataagaggactaacacaagatgacacagcaacatacttttgtgcaagacaaaaatttgcatcaagatatagcggagaccaaggatcatactttgacttatggggaagaggaacacatatagtagtatcatcagcaagcacaaaaggaccatcagtatttccacatgacctaaga

SEQ ID NO: 49706 - RNA, 426 nt, synthetic construct
  misc_feature 1..426: note = derived and/or modified sequence opt6 from anti-HIV-1_HeavyChain
  source 1..426: mol_type = other RNA
caagcacatttagaacaaagtggaagtggagtaaaaaaattaggagcaagcgtaagagtaagttgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagtttaacaagagatagagatttatttacagcacatatggatataagaggattaacacaagatgatacggcaacatatttttgtgcaagacaaaaatttgaaagtagatatacaggaggacaaggatggtattttgatttatggggaagaggaacacatatagtagtaagtagtgcaagtacaaaaggaccaagtgtatttccacatgatttaaga

SEQ ID NO: 49707 - RNA, 426 nt, synthetic construct
  misc_feature 1..426: note = derived and/or modified sequence opt6 from anti-HIV-1_HeavyChain
  source 1..426: mol_type = other RNA
caagcacatttagaacaaagtggaagtggagtaaaaaaattaggagcaagtgtgagagtgagttgttggacaagtgaagatatatttgaaagaacagaattaatacattgggtaagacaagcaccaggacaaggattagaatggataggatgggtaaaagcagtaagtggagcagtaaattatggaagtttagattttagacacagagtaagtttaacaagagatagagatttaagtacagcacatatggatataagaggattaacacaagatgatacagcaacatatttttgtgcaagacaaaaatttgaaagtagatatacaggaggacaaggatggtattttgatttatggggaagaggaacacatatagtagtaagtagtgcaagtacaaaaggaccaagtgtatttccacatgatttaaga

SEQ ID NO: 49708 - RNA, 426 nt, synthetic construct
  misc_feature 1..426: note = derived and/or modified sequence opt6 from anti-HIV-1_HeavyChain
  source 1..426: mol_type = other RNA
caaagccatctagaacaatcaggaagtgcaatgaaaaaaccaggagcatcagtaagagtatcatgctggacatcagaagatatatttgaaagaacagaactaatatactgggtaagacaagcaccaggaagaggactagaatggataggatgggtcaaaacagtaagcggaacagtaaactttggatcaagcgatttcagaaacagaatatcactaacaagagatagagatctaagtacagcacacatggacataagaggattaacacaagatgacacagcaacatacttttgcgcaagacaaaaatttgcatcaagatatagcggagaccaaggatcatactttgacttatgggggagaggaacattaataatagtatcaagcgcaagcacaaaaggaccatcagtatttccacatgacttaaga

SEQ ID NO: 49709 - RNA, 426 nt, synthetic construct
  misc_feature 1..426: note = derived and/or modified sequence opt6 from anti-HIV-1_HeavyChain
  source 1..426: mol_type = other RNA
caaagccatctagaacaatcgggatcagcaatgaaaaaaccaggagcatcagtaagagtatcatgctggacatcagaagatatatttgaaagaacagaactaatatactgggtaaggcaagcaccaggaagaggactagaatggataggatgggtaaaaacagtaagtggaacagtaaactttggaagtagcgatttcagaaacagaatatcactaacaagagatagagatttatcaacagcaagaatggacataagaggactaacacaagatgacacagcaacatacttttgcgcaagacaaaaatttgaatcactatatagcgatgaccaaggatcatactttgacttatggggaagaggaacattaataatagtaagtagcgcaagcacaaaaggaccatcagtatttccaacagacttaaga

SEQ ID NO: 49710 - RNA, 426 nt, synthetic construct
  misc_feature 1..426: note = derived and/or modified sequence opt6 from anti-HIV-1_HeavyChain
  source 1..426: mol_type = other RNA
caagcacatttagaacaaagtggaagtggagtaaaaaaaccaggagcaagtgtaagagtaagctgttggacaagtgaagatatatttgaaaaaagtgaactaatacattgggtaagacaagcaccaggacaaggattagaatggataggatgggtaaaaacagtgacaggagcagtaaattttggaagtagtgattttagacaaagagtaagcttaacaagagatagagatttatttacagcacatatggatataagaggattaacacaagatgatacagcaacatatttttgtgcaagacaaaaatttgcaagtagatatagtggagatcaaggaagttattttgatttatggggaagaggaacattaatagtagtaagtagcgcaagtacaaaaggaccaagcgtatttccacatgatttaaga

SEQ ID NO: 49711 - RNA, 426 nt, synthetic construct
  misc_feature 1..426: note = derived and/or modified sequence opt6 from anti-HIV-1_HeavyChain
  source 1..426: mol_type = other RNA
caaagccatttagaacaaagtggaagtgcaatgaaaaaaccaggagcaagtgtaagagtaagttgttggacaagcgaagatatatttgaaagaacagaattaatatattgggtaagacaagcaccaggaagaggattagaatggataggatgggtaaaaacagtaagtggaacagtaaattttggaagtagtgattttagaaatagaataagtttaacaagagatagagatttaagtacagcacatatggatataagaggattaacacaagatgatacagcaacatatttttgtgcaagacaaaaatttgaaagtttatatagtgatgatcaaggaagttattttgatttatggggaagaggaacattaataatagtaagcagtgcaagcacaaatggaccaataggattaccacatgatttaaga

SEQ ID NO: 49712 - RNA, 426 nt, synthetic construct
  misc_feature 1..426: note = derived and/or modified sequence opt6 from anti-HIV-1_HeavyChain
  source 1..426: mol_type = other RNA
caagcacatttagaacaaagtggaagtggagtaaaaaaaccaggagcaagtgtaagagtaagttgttggacaagtgaagatatatttgaaaaaagtgaattaatacattgggtaagacaagcaccaggacaaggattagaatggataggatgggtaaaaacagtaacaggagcagtaaattttggaagtagtgattttagacaaagagtaagtttaacaagagatagagatttatttacagcacatatggatataagaggattaacacaaggagacacagcaacatatttttgtgcaagacaaaaatttgaaagtagatatacaggaggacaaggatggtattttgatttatggggaagaggaacacatatagtagtaagtagtgcaagtacaaaaggaccaagtgtatttccacatgatttaaga

SEQ ID NO: 49713 - RNA, 426 nt, synthetic construct
  misc_feature 1..426: note = derived and/or modified sequence opt6 from anti-HIV-1_HeavyChain
  source 1..426: mol_type = other RNA
caagcacatttagaacaaagtggaagtggagtaaaaaaaccaggagcaagtgtaagagtaagttgttggacaagcgaagatatatttgaaagaacagaattaatacattgggtaagacaagcaccaggacaaggattagaatggataggatgggtaaaaacagtaacaggagcagtaaattttggaagtccaaattttagacatagagtaagtttaacaagagatagagatttatttacagcacatatggatataagaggattaacacaagatgatacagcaacatatttttgtgcaagacaaaaatttgcaagtaggtatagtggagatcaaggaagttattttgatctatggggaagaggaacattaatagtagtaagtagtgcaagtacaaaaggaccaagtgtatttccacatgatttaaga

SEQ ID NO: 49714 - RNA, 426 nt, synthetic construct
  misc_feature 1..426: note = derived and/or modified sequence opt6 from anti-HIV-1_HeavyChain
  source 1..426: mol_type = other RNA
caaagtcatctagaacaatcgggatcagcaatgaaaaaaccaggagcatcagtaagagtatcatgctggacatcagaagatatatttgaaagaacaggattaatatactgggtaagacaagcaccaggaagaggactagaatggataggatgggtaaaaacagtaagcggaacagtaaactttggatcaagcgatttcagaaacagaatatcactaacaagagatagagatctatcgacagcacacatggacataagaggattaacacaagatgacacagcaacatacttttgcgcaagacaaaaatttgaatcactatatagcgatgaccaaggatcatactttgacttatggggaagaggaacattaataatagtatcaagcgcaagcacaaaaggaccatcagtatttccacatgacttaaga

SEQ ID NO: 49715 - RNA, 426 nt, synthetic construct
  misc_feature 1..426: note = derived and/or modified sequence opt6 from anti-HIV-1_HeavyChain
  source 1..426: mol_type = other RNA
caagcacatttagaacaaagtggaagtggagtaaaaaaaccaggagcaagcgtgagagtaagttgttggacaagtgaagatatatttgaaagaacagaattaatacattgggtaagacaagcaccaggacaaggactagaatggataggatgggtaaaaacagtaacaggagcagtaaattttggaagtcaaatatttagacatagaataagtttaacaagagatagagatttatttacagcacatatggatataagaggattaacacaaggagatacagcaacatatttttgtgcaagacaaaaatttgaaagcagatatacaggaggacaaggatggtattttgatttatggggaagaggaacacatatagtagtaagtagtgcaagtacaaaaggaccaagtgtatttccacatgatttaaga

SEQ ID NO: 49716 - RNA, 426 nt, synthetic construct
  misc_feature 1..426: note = derived and/or modified sequence opt6 from anti-HIV-1_HeavyChain
  source 1..426: mol_type = other RNA
caaagtcatttagaacaatcaggatcagcaatgaaaaaaccaggagcaagtgtaagagtatcatgttggacatcagaagatatatttgatacaacagaattaatacattgggtaagacaagcaccaggacaaggattagaatggataggatgggtaaaaacagtaacaggagcagtaaattttggatcattagattttagacatagaataagtctaacaagagatagagatttatttacagcacatatggatataagaggattaacacaaggagatacagcaacatatttttgcgcaagacaaaaatttgaaagtcgatatacaggaggacaaggatggtattttgatttatggggaagaggaacacatatagtagtatcaagtgcaagtacaaaaggaccatcagtatttccacatgatctaaga

SEQ ID NO: 49717 - RNA, 426 nt, synthetic construct
  misc_feature 1..426: note = derived and/or modified sequence opt6 from anti-HIV-1_HeavyChain
  source 1..426: mol_type = other RNA
caaagccatctagaacaatcaggatcagaagtaaaaaaaccaggagcatcagtaagagtatcatgctggacatcagaagatatatttgaaagaacagaactaatatactgggtaagacaagcaccaggaagaggactagaatggataggatgggtaaaaacagtaagcggaacagtaaactttggatcaagcgatttcagaaacagaatatcactaacaagagatagagatctatcaacagcacacatggacataagaggattaacacaagatgacacagcaacatacttttgcgcaagacaaaaatttgaatcactatatagcgatgaccaaggatcatactttgacttatggggaagaggaacactaataatagtatcaagcgcaagcacaaaaggaccatcagtatttccacatgacttaaga

SEQ ID NO: 49718 - RNA, 423 nt, synthetic construct
  misc_feature 1..423: note = derived and/or modified sequence opt6 from anti-HIV-1_HeavyChain
  source 1..423: mol_type = other RNA
caagtatatatggaacaagcaggaggaggagtaaaaaaaccaggagcaagtgtaacactaagttgtaaaacagcagatgaagatatatttgatgcagcatatatgcattgggtaagacaagcaccaggacaaacatttgaatggttaggatggatgaaaccagtaacaggagcagtaaattatgcaagacaatttcaaggaagagtaagtttttatagaacaagagaattaggaatagcatatatggatttaagagatttaaaatttgatgatacagcagtatatttttgtgcaagaaaaacaaaaggagatgtaagtggagatgatagaggatttttttttgatttatggggaagaggaacaagagtaatagtaagtagtgcaagtacaaaaggaccaagtgtatttccacatgatttaaga

SEQ ID NO: 49719 - RNA, 426 nt, synthetic construct
  misc_feature 1..426: note = derived and/or modified sequence opt6 from anti-HIV-1_HeavyChain
  source 1..426: mol_type = other RNA
caaagccatctagaacaatcaggatcagaagtaaaaaaaccaggagcatcagtaagagtatcatgctggacatcagaagatatatttgatacaacagaactaatatactgggtaagacaagcaccaggacaaggattagaatggataggatgggtaaaaatagtaagcggaacagtaaactttgcatcactagatttcagaaacagaatatcactatcaagagatagagatctatcaacagcacacatggacataagaggactaacacaagatgacacagcaacatacttttgcgcaagacaaaaatttgcaagtagatatagtggagaccaaggatcatactttgacttatggggaagaggaacactaataatagtaagtagcgcaagcacaaaaggaccatcagtatttccacatgacctaaga

SEQ ID NO: 49720 - RNA, 426 nt, synthetic construct
  misc_feature 1..426: note = derived and/or modified sequence opt6 from anti-HIV-1_HeavyChain
  source 1..426: mol_type = other RNA
caagcacatttagaacaaagtggaagcggagtaaaaaaaccaggagcaagtgtaagagtaagttgttggacaagcgaagatatatttgaaagaacagaattaatacattgggtaagacaagcaccaggacaaggattagaatggataggatgggtaaaaacagtaagtggagcagtaaattttggaagtccaaattttagacatagagtaagtttaagtagagatagagatttaagtacagcatatatggatataagaggattaacacaagatgatacagcaacatatttttgtgcaagacaaaaatttgcaagtagatatagtggagatcaaggaagttattttgatttatggggaagaggaacattaatagtagtaagtagtgcaagtacaaaaggaccaagtgtatttccacatgatttaaga

SEQ ID NO: 49721 - RNA, 426 nt, synthetic construct
  misc_feature 1..426: note = derived and/or modified sequence opt6 from anti-HIV-1_HeavyChain
  source 1..426: mol_type = other RNA
caagcacatttagaacaaagtggaagtggagtaaaaaaaccaggagcaagtgtaagagtatcatgttggagtagtgaagatatatttgaaagaacagaattaatacattgggtaagacaagcaccaggacaaggattagaatggataggatgggtaaaaacagtaacaggagcagtaaattttggaagcttagattttagacatagaataagtttaacaagagatagagatttatttacagcacatatggatataagaggattaacacaaggagatacagcaacatatttttgtgcaagacaaaaatttgaaagtagatatacaggaggacaaggatggtattttgatctatggggaagagggacacatatagtagtaagtagtgcaagtgcaaaaggaccaagtgtgtttccacatgatttaaga

SEQ ID NO: 49722 - RNA, 426 nt, synthetic construct
  misc_feature 1..426: note = derived and/or modified sequence opt6 from anti-HIV-1_HeavyChain
  source 1..426: mol_type = other RNA
caaagccatctagaacaatcaggatcagcaatgaaaaaaccaggagcatcagtaagagtaagttgctggacaagtgaagatatatttgaaagaacagaactaatatactgggtaagacaagcaccaggaagaggactagaatggataggatgggtaaaaacagtaagtggaacagtaaactttggatcaagcgatttcagaaacagaatatcactaacaagagatagagatttatcaacagcacatatggacataagaggactaacacaagatgacacagcaacatacttttgcgcaagacaaaaatttgaatcactatatagtgatgaccaaggatcatactttgacttgtggggaagagggacactaatagtagtatcaagcgcaagcacaaaaggaccatcagtatttccaccaagaagtgca

SEQ ID NO: 49723 - RNA, 426 nt, synthetic construct
  misc_feature 1..426: note = derived and/or modified sequence opt6 from anti-HIV-1_HeavyChain
  source 1..426: mol_type = other RNA
caagtacatatggaacaagcaggaggaggagtaaaaaaaccaggagcaagtgtaacattaagttgtaaaacagcagatgaagatgtatttgatgcggcatatatgcactgggtaagacaagcaccaggacaaacatttgaatggttaggatggatgaaaccagtaacaggagcagtaaattatgcaagaaaatttcaaggaagagtaagtttttatagaacaagagaattaggaatagcatatatggatttaagaaatctaagatttgatgatacagcagtatatttttgtgcaagaaaaacaaaaggagatgtaagcggagatgatagaggatttttttttgatttatggggaagaggaacaagagtaatagtaagtagtgcaagtacaaaaggaccattaagaagttttccaagaagaagtgca

SEQ ID NO: 49724 - RNA, 426 nt, synthetic construct
  misc_feature 1..426: note = derived and/or modified sequence opt6 from anti-HIV-1_HeavyChain
  source 1..426: mol_type = other RNA
caagcacatttagaacaaagtggaagtggagtaaaaaaaccaggagcaagtgtaagagtaagttgttggagtagtgaagatatatttgaaagaacagaattaatacattgggtaagacaagcaccaggacaaggattagaatggataggatgggtaaaaacagtaacaggagcagtaaattttggaagcttagattttagacatagaataagtctaacaagagatagagatttatttacagcacatatggatataagaggactaacacaaggagatacagcaacatatttttgtgcaagacaaaaatttgaaagtagatatacaggaggacaaggatggtattttgacttatggggaagaggaacacatatagtagtaagtagtgcaagtacaaaaggaccaagtgtatttccaacaatatatgta

SEQ ID NO: 49725 - RNA, 426 nt, synthetic construct
  misc_feature 1..426: note = derived and/or modified sequence opt6 from anti-HIV-1_HeavyChain
  source 1..426: mol_type = other RNA
gaaagtcatctagaacaatcaggatcagcaatgaaaaaaccaggagcatcagtaagagtatcatgctggacatcagaagatatatttgacacgacagaactaatatactgggtaagacaagcaccaggacaaggactagaatggataggatgggtaaaaatagtaagcggaacagtaaactttgcatcactagatttcagaaacagaatatcactatcaagagatagagatttatcaacagcacacatggacataagagggctaacacaagatgacacagcaacatacttttgcgcaagacaaaaatttgcatcaagatatagcggagaccaaggatcatactttgacttgtggggaagaggaacattaataatagtatcaagcgcaagcacaaaaggaccatcggtatttccacatgacctaaga

SEQ ID NO: 49726 - RNA, 429 nt, synthetic construct
  misc_feature 1..429: note = derived and/or modified sequence opt6 from anti-HIV-1_HeavyChain
  source 1..429: mol_type = other RNA
caagcacatttagaacaaagtggaagcggagtaaaaaaaccaggagcaagtgtaagagtaagttgttggacaagtgaagacatatttgaaagaacagaattaatacattgggtaagacaagcaccaggacaaggattagaatggataggatgggtaaaaatagtaagtggagcagtaaattttggatcaccaaattttagacaaagagtaagtttaacaagagatagagatttatttacagcacatatggatataagaggattaacacaagatgacacagcaacatatttttgtgcaagacaaaaatttgcaagtagatatagtggagatcaaggaagttattttgatttatggggaagaggaacattaatagtagtaagtagcgcaagtacaaaaggaccaagtggattaccaccaagaagttgtgta

SEQ ID NO: 49727 - RNA, 423 nt, synthetic construct
  misc_feature 1..423: note = derived and/or modified sequence opt6 from anti-HIV-1_HeavyChain
  source 1..423: mol_type = other RNA
caagtacatctagtacaatcaggagcagaagtaaaaaaaccaggagcatcagtaaaagtatcatgcaaagcatcaggatatacatttacaacaagcggaatacattggttaagacaagtaccaggacaaagaccagaatggatgggatggataagaccaaaaacaggagcaagaaatcaagcaagacaattccaaccaagaatatctctaacaagagatagagcattatcaacagcatacttagacttaaactcactaacatcagcagactcaggaacatacttttgcgcaagacaaacatttaaaccagacttttactttgcagatcaaggatggtcattcaatctatggggaagaggagctcactttatagtaagctcagcatcaacaaaaggaccatcagtattcccacacgatctaaga

SEQ ID NO: 49728 - RNA, 429 nt, synthetic construct
  misc_feature 1..429: note = derived and/or modified sequence opt6 from anti-HIV-1_HeavyChain
  source 1..429: mol_type = other RNA
caagcacatctagaacaaagtggaagtggagtaaaaaaaccaggagcaagtgtaagagtatcatgttggagtagtgaagatatatttgaaagaacagaattaatacattgggtaagacaagcaccaggacaaggattagaatggataggatgggtaaaaacagtaacaggagcagtaaattttggatcattagattttagacatagaatatcattaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtatcaagtgcaagcacacaaggaccaataggattaccaccaagattatgtgta

SEQ ID NO: 49729 - RNA, 426 nt, synthetic construct
  misc_feature 1..426: note = derived and/or modified sequence opt6 from anti-HIV-1_HeavyChain
  source 1..426: mol_type = other RNA
caaagccatctagaacaatcaggatcagcaatgaaaaaaccaggagcatcggtaagagtatcatgctggacatcagaagatatatttgacacaacagaactaatatactgggtaagacaagcaccaggacaaggattagaatggataggatgggtaaaaatagtaagcggaacagtaaactttgcatcactagatttcagaaacagaatatcattatcaagagatagagatctatcaacagcacacatggacataagaggattaacacaagatgacacagcaacatacttttgcgcaagacaaaaatttgcatcaagatatagcggagaccaaggatcatactttgacttatggggaagaggaacattaataatagtatcaagcgcaagcacaaaaggaccaataggattaccaccaagatcaaca

SEQ ID NO: 49730 - RNA, 426 nt, synthetic construct
  misc_feature 1..426: note = derived and/or modified sequence opt6 from anti-HIV-1_HeavyChain
  source 1..426: mol_type = other RNA
caagcacatttagaacaatcaggaagtggagtaaaaaaaccaggagcaagtgtaagagtaagttgttggacaagtgaagacatatttgaaaaaagtgaattaatacattgggtaagacaagcaccaggacaaggattagaatggataggatgggtaaaaacagtaacaggagcagtaaattttggaagtttagattttagacatagaataagtttaacaagagatagagatttatttacagcacatatggatataagaggattaacacaaggagatacagcaacatatttttgtgcaagacaaaaatttgaaagtagatatacaggaggacaaggatggtattttgatctatggggaagagggacacatatagtagtaagcagcgcaagtacaaaagggccaagtgtatttccaacaatatgtgta

SEQ ID NO: 49731 - RNA, 426 nt, synthetic construct
  misc_feature 1..426: note = derived and/or modified sequence opt6 from anti-HIV-1_HeavyChain
  source 1..426: mol_type = other RNA
caagcacatttagaacaaagtggaagtggagtaaaaaaattaggagcaagtgtaagagtaagttgttggacaagtgaagatatatttgaaagaacagaattaatacattgggtaagacaagcaccaggacaaggattagaatggataggatgggtaaaagcagtaagtggagcagtaaattatggaagcttagattttagacatagagtaagtttaacaagagatagagatttatttacagcacatatggatataagaggattaacacaaggggatacagcaacatatttctgtgcaagacaaaaatttgaaagtagatatacaggaggacaaggatggtattttgatttatggggaagaggaacacatatagtagtaagtagtgcattacatcaaggaccaataggattaccaccaagaagtaca

SEQ ID NO: 49732 - RNA, 429 nt, synthetic construct
  misc_feature 1..429: note = derived and/or modified sequence opt6 from anti-HIV-1_HeavyChain
  source 1..429: mol_type = other RNA
caaagtcatttagaacaaagtggaagtgcaatgaaaaaaccaggagcaagtgtaagagtaagttgttggacaagcgaagatatatttgatacaacagaattaatatattgggtaagacaagcaccaggacaaggattagaatggatagggtgggtaaaaatagtaagtggaacagtaaattttgcaagtttagattttagaaatagagtaagtttaagcagagatagagatttaagtacagcatatatggatataagaggattaacacaagatgatacagcgacatatttttgtgcaagacaaaaatttgcaagtagatatagtggagatcaaggaagttattttgatttatggggaagaggaacattaatagtagtaagcagtgcattacatcaaggaccaataggaccatcaccaacaatattaaga

SEQ ID NO: 49733 - RNA, 426 nt, synthetic construct
  misc_feature 1..426: note = derived and/or modified sequence opt6 from anti-HIV-1_HeavyChain
  source 1..426: mol_type = other RNA
caaagccatctagaacaaagtggatcagcaatgaaaaaaccaggagcatcagtaagagtaagctgctggacatcagaagatatatttgacacaacagaactaatatactgggtaagacaagcaccaggacaaggactagaatggataggatgggtaaaaatagtaagcggaacagtaaattttgcatcattagatttcagaaacagaatatcactatcaagagacagagatctatcaacagcacacatggacataagaggactaacacaagatgacacagcaacatacttttgcgcaagacaaaaatttgcatcaagatatagcggagaccaaggatcatactttgacttatggggaagaggaacattaataatagtatcaagtgcaagcacaaaaggaccatcagtatttccaacaatatatgta

SEQ ID NO: 49734 - RNA, 426 nt, synthetic construct
  misc_feature 1..426: note = derived and/or modified sequence opt6 from anti-HIV-1_HeavyChain
  source 1..426: mol_type = other RNA
caaagtcatttagaacaaagtggaagtgcaatgaaaaaaccaggagcaagtgtaagagtaagttgttggacaagtgaagatatatttgatacaacagaattaatatattgggtaagacaagcaccaggacaaggattagaatggataggatgggtgaaaatagtaagtggaacagtaaattttgcaagtttagattttagaaatagaataagtttaagtagagatagagatttaagtacagcatatatggatataagaggattaacacaagatgatacagcaacatatttttgtgcaagacaaaaatttgaaagcagatatacaggaggacaaggatggtattttgatttatggggaagaggaacacatatagtagtaagcagtgcatcaacaaaaggaccaagtgtatttccaacaatatgtgta

SEQ ID NO: 49735 - RNA, 426 nt, synthetic construct
  misc_feature 1..426: note = derived and/or modified sequence opt6 from anti-HIV-1_HeavyChain
  source 1..426: mol_type = other RNA
caagtacaattagtacaaagtggagcagaagtaaaaaaaccaggagcaagtgtaagagtaagttgttggacaagtgaagatatatttgatacaacagaattaatatattgggtaagacaagcaccaggacaaggattagaatggataggatgggtaaaaatagtaagtggaacagtaaattttgcaagtttagattttagaaatagaataagtttaagtagggatagagatttaagtacagcacatatggatataagaggattaacacaagatgatacagcaacatatttttgtgcaagacaaaaatttgaaagtagatatacaggaggacaaggatggtattttgatttatggggaagaggaacacacatagtagtaagtagtgcaagtacaaaaggaccaagtgtatttccaacaatatgtgta

SEQ ID NO: 49736 - RNA, 426 nt, synthetic construct
  misc_feature 1..426: note = derived and/or modified sequence opt6 from anti-HIV-1_HeavyChain
  source 1..426: mol_type = other RNA
agaagacatttagaacaaagtggaagtggagtaaaaaaaccaggagcaagtgtaagagtaagctgttggagcagtgaagatatatttgaaagaacagaattaatacattgggtaagacaagcaccaggacaaggattagaatggataggatgggtaaaaacagtaacaggagcagtaaattttggatcattagattttagacatagaataagtttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagtgcaagtacaaaaggaccaagtgtatttccacatgatttaaga

SEQ ID NO: 49737 - RNA, 426 nt, synthetic construct
  misc_feature 1..426: note = derived and/or modified sequence opt6 from anti-HIV-1_HeavyChain
  source 1..426: mol_type = other RNA
caaagccatctagaacaatcaggatcagcaatgaaaaaaccaggagcatcagtaagagtatcatgctggacatcagaagatatatttgacacaacagaactaatatactgggtaagacaagcaccaggacaaggactagaatggataggatgggtaaaaatagtaagcggaacagtaaactttgcatcgttagatttcagaaacagaatatcactatcaagagatagagatctatcaacagcatacatggacataagaggactaacacaagatgacacggcaacatacttttgcgcaagacaaaaatttgaatcaagatatagcggagaccaaggatcatactttgacttatggggaagaggaacattaataatagtatcaagcgcaagcacaaaaggaccatcagtatttccaacaatatgtgta

SEQ ID NO: 49738 - RNA, 429 nt, synthetic construct
  misc_feature 1..429: note = derived and/or modified sequence opt6 from anti-HIV-1_HeavyChain
  source 1..429: mol_type = other RNA
caagcacatttagaacaatcaggatcaggagtaaaaaaaccaggagcatcagtaagagtatcatgctggacatcagaagatatatttgaaagaacagaattaatacactgggtaagacaagcaccaggacaaggactagaatggataggatgggtaaaaacagtaacaggagcagtaaattttggatcattagattttagacacagaataagtctaacaagagatagagatttatttacagcacacatggacataagaggattaacacaaggagatacagcaacatatttttgcgcaagacaaaaatttgaatcaagatatacaggaggacaaggatggtattttgatttatggggaagaggaacacatatagtagtatcaagcgcaagtacaaaaggaccacatccagtattcccacatgatttacca

SEQ ID NO: 49739 - RNA, 426 nt, synthetic construct
  misc_feature 1..426: note = derived and/or modified sequence opt6 from anti-HIV-1_HeavyChain
  source 1..426: mol_type = other RNA
caagcacatttagaacaaagcggaagtggggtaaaaaaattaggagcaagtgtaagagtaagctgttggacaagtgaagacatatttgaaagaacagaattaatatattgggtaagacaagcaccaggacaaggattagaatggataggatgggtaaaaatagtatcaggaacagtaaattttgcaagtttagattttagaaatagaataagtctaagtagagatagagatttaagtacagcttatatggatataagaggattaacacaagatgatacagcaacatatttttgtgcaagacaaaaatttgcaagtagatatagtggagatcaaggaagttattttgatctatggggaaggggaacactaatagtagtaagttcagcatcaacaaaaggaccaagtgtatttccgacaatatatgta

SEQ ID NO: 49740 - RNA, 429 nt, synthetic construct
  misc_feature 1..429: note = derived and/or modified sequence opt6 from anti-HIV-1_HeavyChain
  source 1..429: mol_type = other RNA
caagcacatttagaacaaagtggaagtggagtaaaaaaaccaggagcaagcgtaagagtaagttgttggacaagcgaagatatatttgaaagaacagaattaatacattgggcaagacaagcaccaggacaaggattagaatggataggatgggtaaaaacagtaacaggagcagtaaattttggaagtctagattttagacatagaataagtttaacaagagatagggatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagtgcaagtacaaaaggaccattaggattaccaccaagattaagtaga

SEQ ID NO: 49741 - RNA, 426 nt, synthetic construct
  misc_feature 1..426: note = derived and/or modified sequence opt6 from anti-HIV-1_HeavyChain
  source 1..426: mol_type = other RNA
caatcacacctagaacaatcaggatcagcaatgaaaaaaccaggagcatcagtaagagtatcatgctggacatcagaagatatatttgacacaacagaattaatatactgggtaagacaagcaccaggacaaggactagaatggataggatgggtaaaaatagtatcaggaacagtaaactttgcatcactagacttcagaaacagaatatcactatcaagagacagagacttatcaacagcacacatggatataagaggactaacacaagatgacacagcaacatacttctgcgcaagacaaaaatttgcatcaagatattcaggagaccaaggaagttactttgacttatggggaagaggcacattaataatagtatcatcagcatcaacaaaaggaccatcaggattaccaccaagatcagca

SEQ ID NO: 49742 - RNA, 426 nt, synthetic construct
  misc_feature 1..426: note = derived and/or modified sequence opt6 from anti-HIV-1_HeavyChain
  source 1..426: mol_type = other RNA
caagtacaactagtacaatcaggagcagaagtaaaaaaaccaggagcatcagtaagagtatcatgctggacatcagaagatatatttgacacaacagaattaatatactgggtaagacaagcaccaggacaaggattagaatggataggatgggtaaaaatagtaagcggaacagtaaactttgcatcactagattttagaaacagaatatcattatcaagagatagagatttatcaacagcacacatggacataagaggactaagacaagatgacacagcaacatatttttgtgcaagacaaaaatttgaaagtagatatagtggagatcaaggatcatattttgacttatggggaagaggaacattaataatagtatcaagtgcaagtacaaaaggaccatcagtatttccacatgacttaaga

SEQ ID NO: 49743 - RNA, 426 nt, synthetic construct
  misc_feature 1..426: note = derived and/or modified sequence opt6 from anti-HIV-1_HeavyChain
  source 1..426: mol_type = other RNA
gaagcacatctagaacaaagtggaagtggagtaaaaaaaccaggagcaagtgtacgagtaagttgttggacaagtgaagatatatttgaaagaacagaattaatacattgggtaagacaagcaccaggacaaggattagaatggataggatgggtaaaaatagtaagtggaacagtaaattttgcaagtttagattttagaaatagaataagtttaagtagagatagagatttaagtacagcatatatggatataagaggattaacacaagatgatacagcaacatatttttgtgcaagacaaaaatttgcaagtagatatagcggagatcaaggaagttattttgatttatggggaagaggaacattaatagtagtaagtagtgcaagtacaaaaggaccatcagtatttccacatgatttaaga

SEQ ID NO: 49744 - RNA, 423 nt, synthetic construct
  misc_feature 1..423: note = derived and/or modified sequence opt6 from anti-HIV-1_HeavyChain
  source 1..423: mol_type = other RNA
caagtacaactagtacaatcaggagcagaagtaaaaaaaccaggagcatcagtaaaagtatcatgcagagcatcaggatatacatttggaaatcacgcaatatcatgggtaagacaagcaccaggacaaggattagaatggatgggatggataagaccaaaaacaggagcaagaaatcaagcaagacaattccaaccaagaatatcattaacaagagatagagcactatcaacagcatacttagacttaaactcattaacaagtgcagactcaggaacatacttttgcgcaagacaaacatttaaaccagacttttactttgcagatcaaggatggtcattcaatctatggggaagaggagcacactttatagtaagttcagcatcaacaaaaggaccaagcgtattcccacacgatctaaga

SEQ ID NO: 49745 - RNA, 429 nt, synthetic construct
  misc_feature 1..429: note = derived and/or modified sequence opt6 from anti-HIV-1_HeavyChain
  source 1..429: mol_type = other RNA
caaggacataatttagaacaaagtggaagtgaagtaaaaaaaccaggagcaagcgtaagagtaagttgttggacaagtgaagatatatttgaaagaacagaattaatacattgggtaagacaagcaccaggacaaggattagaatggataggatgggtaaaaacagtaacaggagcagtaaattttggaagtttagattttagacatagaataagtttaacaagagatagagatttatttacagcacatatggatataagaggattaacacaaggagatacagcaacatatttttgtgcaagacaaaaatttgaaagcagatatacaggaggacaaggatggtattttgatttatggggaagaggaacacatatagtagtaagtagtgcaagtacaaaaggaccaagcgtatttccacatgatttaaga

SEQ ID NO: 49746 - RNA, 426 nt, synthetic construct
  misc_feature 1..426: note = derived and/or modified sequence opt6 from anti-HIV-1_HeavyChain
  source 1..426: mol_type = other RNA
ccaacaacatggaacaaaagcggaagcgatgtaaaaaaaccaggagcaagcgtaagagtaagctgttggacaagcgaagacatattcgaaagaacagaattaatacattgggtaagacaagcaccaggacaaggattagaatggataggatgggtaaaaacagtaacaggagcagtaaatttcggaagtccaaactttagacatagagtaagcttaacaagagacagagacttaagtacagcacatatggatataagaggattaacacaagacgatacagcaacctatttctgtgcaagacaaaaattcgaaagcttatactcagacgatcaaggaagctatttcgatttatggggaagaggaacactaataatagtaagctcagcatcaacaaaaggaccaagcgtattcccacacgatctaaga

SEQ ID NO: 49747 - RNA, 432 nt, synthetic construct
  misc_feature 1..432: note = derived and/or modified sequence opt6 from anti-HIV-1_HeavyChain
  source 1..432: mol_type = other RNA
catgtaacaccatggaatgaatatgtaggaagagcaatgaaaaaaccaggaagatcagtaagagtaagttgttggacaagtgaagatatatttgatacaacagaattaatatattgggtaagacaagcaccaggacaaggattagaatggataggatgggtaaaaatagtgagtggaacagtaaattttgcaagtttagattttagaaacagaataagcttaagcagagatcgagatttaagtacagcatatatggatataagaggattaacacaagatgatacagcaacatatttttgtgcaagacaaaaatttgcaagtagatatagcggagatcaaggaagttattttgatttatggggaagaggaacattaatagtagtaagttcagcaagtactaaaggaccaagtgtatttccacatgatttaaga

SEQ ID NO: 49748 - RNA, 372 nt, synthetic construct
  misc_feature 1..372: note = derived and/or modified sequence opt6 from anti-HIV-1_HeavyChain
  source 1..372: mol_type = other RNA
caagtacaattagtacaaagtggagcagaagtaagaagaccaggagcaagtgtaaaagtaagttgtaaagcaagtggattttcatttttaggacattatatacattgggtaagacaagcaccaggacaaggattagaatggataggatgggtaaaagcagtaagtggagcagtaaattatggatcattagattttagacatagagtatcattaacaagagatagagatctatcaacagcacatatggatataagaggattaacacaagatgatacagcaacatatttttgtgcaagacaaaaatttgcaagaggagatcaaggatggttttttgatttatggggaagaggaacactaatagtagtaagttca

SEQ ID NO: 49749 - RNA, 372 nt, synthetic construct
  misc_feature 1..372: note = derived and/or modified sequence opt6 from anti-HIV-1_HeavyChain
  source 1..372: mol_type = other RNA
caagtacaattagtacaaagtggagcagaagtaaaaaaaccaggagcgagtgtaaaagtaagttgtaaagcaagtggatatacatttacaagttatggaataagttgggtaagacaagcaccagggcaaggattagaatggataggatgggtaaaaatagtaagtggagcagtaaattttggaagtccaaattttagacaaagagtatcattaacaagagatagagatttatttacagcacatatggatataagaggattaacacaaggagatacagcaacatatttttgtgcaagacaaaaatttgaaagaggaggacaaggatggatatttgatttatggggaagaggaacattaatagcagtaagttca

SEQ ID NO: 49750 - RNA, 372 nt, synthetic construct
  misc_feature 1..372: note = derived and/or modified sequence opt6 from anti-HIV-1_HeavyChain
  source 1..372: mol_type = other RNA
caagtacaattagtacaaagtgaagcagaagtaaaaaaaccaggagcaagtgtaaaaataagttgtgctacaagtggatatgcatttacattatattatttacattgggtaagacaagcaccaggacaaggattagaatggataggatgggtaaaaacagtaacaggagcagtaaattttggatcagcatattttagacatagagtatcattaacaagagatagagatttatttacagcacatatggatataagaggattaacacaaggagatacagcaacatatttttgtgcaagacaaaaattttataaaggaggacaaggatggtattttgacttatggggaaggggaacattaatagtagtaagttca

SEQ ID NO: 49751 - RNA, 372 nt, synthetic construct
  misc_feature 1..372: note = derived and/or modified sequence opt6 from anti-HIV-1_HeavyChain
  source 1..372: mol_type = other RNA
caagcacatttagaacaaagtggaagtggagtaaaaaaaccaggagcaagtgtacgagtaagttgttggacaagtgaagatatatttaaaacagaattaatacattgggtaagacaagcaccaggacaaggattagaatggataggatgggtaaaaacagtaacaggagcagtaaattttggatcaccaaattttagacatagagtatcattaacaagagatagagatttatttacagcacatatggatataagaggattaacacaaggagatacagcaacatatttttgcgcaagacaaaaatttgaaagaggaggacaaggatggtattttgatttatggggaagaggaacattaatagtagtaagttca

SEQ ID NO: 49752 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagcggaagcggagtaaaaaaattaggagcaagtgtaagagtaagttgttggacaagtgaagatatatttgaaagaacagaattaatacattgggtaagacaagcaccaggaagaggattagaatggataggatgggtaaaagcagtaagtggagcagtaaattatggaagtttagattttagacatagagtaccattaacaagagatagagatttatttacagcacatatggatataagaggattaacacaagatgatacagcaacatatttttgtgcaagacaaaaatttgcaagaggagatcaaggatggttttttgatttatggggaagaggaacattaatagtagtaagtagc

SEQ ID NO: 49753 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaccagaagatatatttgaaagaacagaattaatacattgggtaagacaagcaccaggacaaggattagaatggataggatgggtaaaaatagtaagtggagcagtaaattttggaagtccaaattttagacaaagagtaagcttaacaagagatagagatttatttacagcacatatggatataagaggattaacacaaggagatacagcaacatatttttgtgcaagacaaaaatttgaaagaggaggacaaggatggatatttgatttatggggaagaggaacattaatagcagtaagtagt

SEQ ID NO: 49754 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtgcaagtggagtaaaaagaccaggagcaagtgtaagagtaagctgttggacaagtgaagatatatttgaaggaagtgaattaatacattgggtaagacaagcaccaggacaaggattagaatggataggatgggtaaaaacagtaacaggagcagtaaattttggaagtgcatattttaggcatagagtaagtttaacaagagatagagatttatttacagcacatatggatataagaggattaacacaaggagatacagcaacatatttttgtgcaagacaaaaattttataaaggaggacaaggatggtattttgatttatggggaagaggaacattaatagtagtaagcagt

SEQ ID NO: 49755 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaagtggagcagtaaattttggaagtccaaattttagacatagagtaagcttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 49756 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggagcagtgaagatatatttgaaagagcagaactaatacattgggtaagacaagcaccaggacaaggattagaatggataggatgggtaaaaacagtaacaggagcagtaaattttggaagtccaaattttagacaaagagtaagcttaacaagagatagagatttatttacagcacatatggatataagaggattaacacaaggagatacagcaacatatttttgtgcaagacaaaaatttgaaagaggaggacaaggatggatatttgatttatggggaagaggaacattaatagcagtaagtagt

SEQ ID NO: 49757 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagtttagattttagacatagaataagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagt

SEQ ID NO: 49758 - RNA, 375 nt, synthetic construct
  misc_feature 1..375: note = derived and/or modified sequence opt6 from anti-HIV-1_HeavyChain
  source 1..375: mol_type = other RNA
caagtacatttagaacaaagtggaagtggagtaaaaaaattaggagcaagtgtaagagtaagttgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagtttaacaagagatagagatttaagcacagcacatatggatataagaggattaacacaagatgatacagcaacatatttttgtgcaagacaaaaatttgcaagaggagatcaaggatggttttttgatttatggggaagaggaacattaatagtagtaagtagc

SEQ ID NO: 49759 - RNA, 375 nt, synthetic construct
  misc_feature 1..375: note = derived and/or modified sequence opt6 from anti-HIV-1_HeavyChain
  source 1..375: mol_type = other RNA
caagcatatttagaacaaagtggaagcataatgaaaaaaccaggagcaagcgtaagagtaagttgttggacaagtgaagatatatttgatagaacagaattaatatattgggtaagacaagcaccaggacaaggattagaatggataggatgggtaaaaatagtaagtggagcagtaaattttggaagtttagattttagaaatagagtaagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagt

SEQ ID NO: 49760 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagcggaagtggagtaaaaaaaccaggagcaagtgtaagagtaagttgttggacaagtgaagatatatttgaaagaacagaattaataaattgggtaagacaagcaccaggacaaggattagaatggataggatgggtaaaagcagtaagtggagcagtaaattatggaagtttagattttagacatagagtaagtttaacaagagatagagatttaagtacagcacatatggatataagaggattaacacaagatgatacagcaacatatttttgcgcaagacaaaaatttgcaagaggagatcaaggatggttttttgatttatggggaagaggaacattaatagtagtaagtagt

SEQ ID NO: 49761 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggagtagtgaagatatatttgaaagaacagaattaatacattgggtaagacaagcaccaggacaaggactagaatggataggatgggtaaaaacagtaacaggagcagtaaattttggaagtttagattttagacatagaataagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagt

SEQ ID NO: 49762 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggaacaagtgtaagagtaagttgttggacaagtgaagatatatttgaaagaacagaattaatacattgggtaagacaagcaccaggacaaggattagaatggataggatgggtaaaaatagtaagtggagcagtaaattttggaagtccaaattttagacaaagagtaagtttaacaagagatagagatttatttacagcacatatggatataagaggattaacacaaggagatacagcaacgtatttttgtgcaagacaaaaatttgaaagaggaggacaaggatggatatttgatttatggggaagaggaacattaatagcagtaagtagt

SEQ ID NO: 49763 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaattaggagcaagtgtaagagtaagttgttggacaagtggagatatatttgaaagaacagaattaatacattgggtaagacaagcaccaggacaaggattagaatggataggatgggtaaaagcagtaagtggagcagtaaattatggaagtttagattttagacatagagtaagtttaacaagagatagagatttatttacagcacatatggatataagaggattaacacaagatgatacagcaacatatttttgtgcaagacaaaaatttgcaagaggagatcaaggatggttttttgatttatggggaagaggaacattaatagtagtaagtagt

SEQ ID NO: 49764 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagcggagtaaaaaaaccaggagcaagtgtaagagtaagttgttggacaagtgaagatatatttgaaagaacagaattaatacattgggtaagacaagcaccaggacaaggattagaatggataggatgggtaaaaatagtaagtggagcagtaaattttggaagtccaaattttagacaaagagtaagtttaacaagagatagagatttatttacagcacatacagatataagaggattaacacaaggagatacagcaacatatttttgtgcaagacaaaaatttgaaagaggaggacaaggatggtattttgatttatggggaagaggaacattaatagtagtaagcagt

SEQ ID NO: 49765 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgtttagcaagtgaagatatatttgaaagaacagaattaatacattgggtaagacaagcaccaggacaaggattagaatggataggatgggtaaaaacagtaacaggagcagtaaattttggaagtccaaattttagacatagagtaagtttaacaagagacagagatttatttacagcacatatggatataagaggattaacacaaggagatacagcaacatatttttgtgcaagacaaaaatttgaaagaggaggacaaggatggtattttgatttatggggaagaggaacattaatagtagtaagtagc

SEQ ID NO: 49766 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggagcaggagtaaaaagaccaggagcaagtgtaagagtatcatgttggacaagtgaagatatatttgaaacaacagaattaatacattgggtaagacaagcaccaggacaaggattagaatggataggatgggtaaaaacagtaagtggagcagtaaattttggaagtttaaattttagacatagagtaagtttaacaagagatagagatttatttacagcacatatggatataagaggattaacacaaggagatacagcaacatatttttgtgcaagacaaaaatttgcaagaggagatcaaggatggttttttgatttatggggaagaggaacattaatagtagtaagtagt

SEQ ID NO: 49767 - RNA, 375 nt, synthetic construct
  misc_feature 1..375: note = derived and/or modified sequence opt6 from anti-HIV-1_HeavyChain
  source 1..375: mol_type = other RNA
agacatacatggaataaaagcggaagtggagtaaaaaaaccaggagcaagtgtaagagtaagttgttggacaagtgaagatatatttgaaaaaagtgaattaatacattgggtaagacaagcaccaggacaaggattagaatggataggatgggtaaaaacagtaacaggagcagtaaattttggaagcagtgattttagacaaagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagt

SEQ ID NO: 49768 - RNA, 375 nt, synthetic construct
  misc_feature 1..375: note = derived and/or modified sequence opt6 from anti-HIV-1_HeavyChain
  source 1..375: mol_type = other RNA
ggaacaccaggaagtgaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaatagtaagcggagcagtaaattttggaagtccaaattttagacaaagagtaagcttaacaagagatagagatttatttacagcgcatatggatataagaggattaacacaaggagatacagcaacatatttttgtgcaagacaaaaatttgaaagaggaggacaaggatggatatttgatttatggggaagaggaacattaatagcagtaagtagt

SEQ ID NO: 49769 - RNA, 378 nt, synthetic construct
  misc_feature 1..378: note = derived and/or modified sequence opt6 from anti-HIV-1_HeavyChain
  source 1..378: mol_type = other RNA
caagtacaactagtacaatcaggaacagaagtacaaaaaccaggagcatcagtaaaagtatcatgcaaagcattcggatactcattcacagactactacgtatactgggtaagacaagcaccaggacaaggactagaatacgtagcatggataaacccatcaaacggatacacaaaatacgcacaaaaattccaagactgggtaacactaacaagagactcatcaataaacacagcatacctacaactagcaagagtaacatcagacgacacagcaatatactactgcgcaagacaaaaattcgcatcaagatactcaggagaccaaggatcatacttcgacctatggggaagaggaacactaatagtagtatcatca

SEQ ID NO: 49770 - RNA, 378 nt, synthetic construct
  misc_feature 1..378: note = derived and/or modified sequence opt6 from anti-HIV-1_HeavyChain
  source 1..378: mol_type = other RNA
caagtacaactagtacaaagtggagcagcagtaaaaaaaccaggaagtagtgtaaaagtaagctgtaaagcaagtggatatatatttacaggatattatatacattggataagacaagcaccaggacaaggattagaatggatgggatggataaatccaagtacaggagatacaaaatttgcaagacaatttcaaggaagagtaagtttttatagaacaagagaattaggaatagcatatatggatttaagagatttaaaatttgatgatacagcagtatatttttgtgcaagaaaaacaaaaggagatgtaagtggagatgatagaggatttttttttgatttatggggaagaggaacaagagtaatagtaagtagt

SEQ ID NO: 49771 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggagcaggaatgaaaaaaccaggagcaagcatgacagtaagttgtaaaacagcagatgaagatatatttgatgcagcatatatgcattgggtaagacaagcaccaggacaaacatttgaatggttaggatggatgaaaccagtaacaggagcagtaaattatgcaagacaatttcaaggaagagtaagtttttatagaacaagagaattaggaatagcatatatggatttaagagatttaaaatttgatgatacagcagtatatttttgtgcaagaaaaacaaaaggagatgtaagtggagatgatagaggatttttttttgatttatggggaagaggaacaagagtaatagtaagtagt

SEQ ID NO: 49772 - RNA, 381 nt, synthetic construct
  misc_feature 1..381: note = derived and/or modified sequence opt6 from anti-HIV-1_HeavyChain
  source 1..381: mol_type = other RNA
caagtatttatggaacaagcaggaggaggaatgaaaaaaccaggagcgagtatgacagtaagttgtaaaacagcagatgaagatgtatttgatgcagcatatatgcattgggtaagacaagcaccaggacaaacatttgaatggttaggatggatgaaaccagtaacaggagcagtaaattatgcaagaaaatttcaaggaagagtaagtttttataggacaagagaattaggaatagcatatatggatttaagagatctaaaatttgatgatacagcagtatatttttgtgcaagaaaaacaaaaggagatgtaagtggagatgatagaggatttttttttgatttatggggaagaggaacaagagtaatagtaagtagt

SEQ ID NO: 49773 - RNA, 381 nt, synthetic construct
  misc_feature 1..381: note = derived and/or modified sequence opt6 from anti-HIV-1_HeavyChain
  source 1..381: mol_type = other RNA
caagtatttatggaacaagcaggaggaggaatgaaaaaaccaggagcaagtatgacagtaagttgtaaaacagcagatgaagatgtatttgatgcagcatatatgcattgggtaagacaagcaccaggacaaacatttgaatggttaggatggatgaaaccagtaacaggagcagtaaattatgcaagacaatttcaaggaagagtaagtttttatagaacaagagaattaggaatagcatatatggatttaagagatttaaaatttgatgatacagcagtatatttttgtgcaagaaaaacaaaaggagatgtaagtggagatgatagaggatttttttttgatttatggggaagaggaacaagagtaatagtaagtagt

SEQ ID NO: 49774 - RNA, 381 nt, synthetic construct
  misc_feature 1..381: note = derived and/or modified sequence opt6 from anti-HIV-1_HeavyChain
  source 1..381: mol_type = other RNA
caagtacatatggaacaagcaggaggaggagtaaaaaaaccaggagcaagtgtaacattaagttgtaaaacagcagatgaagatgtatttgatgcagcatatatgcattgggtaagacaagcaccaggacaaacatttgaatggttaggatggatgaaaccagtgacaggagcagtaagttatgcaagaaaatttcaaggaagagtaagtttttatatgacaagagaattaggaatggcatatatggatttaagaaatttaagatttgatgatacagcagtatatttttgtgcaagaaaaacagcaggagatgtaagtggagataataggggatatttttttgatttatggggaagaggaagtagagtaatagtaagtagt

SEQ ID NO: 49775 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggaggaggaatgaaaaaaccaggagcaagtatgacagtaagttgtaaaacagcagatgaagatatatttgatgcagcatatatgcattgggtaagacaagcaccaggacaaacatttgaatggttaggatggatgaaaccagtaacaggagcagtaaattatgcaagacaatttcaaggaagagtaagtttttatagaacaagagaattaggaatggcatatatggatctaagaaatttaagatttgatgatacagcagtatatttttgtgcaagaaaaacagcaggagatgtaagtggagataatagaggatatttttttgatttatggggaagaggaagtagagtaatagtaagtagt

SEQ ID NO: 49776 - RNA, 381 nt, synthetic construct
  misc_feature 1..381: note = derived and/or modified sequence opt6 from anti-HIV-1_HeavyChain
  source 1..381: mol_type = other RNA
caagtatatatggaacaagcaggaggaggagtaaaaaaaccaggagcaagtgtaacattaagttgtaaaacagcagatgaagatgtatttgatgcagcatatatgcattgggtaagacaagcaccaggacaaacatttgaatggttaggatggatgaaaccagtaacaggagcagtaagttatgcaagaaaatttcaaggaagagtaagtttttatatgacaagagaattaggaatggcatatatggatttaagaaatttaagatttgatgatacagcagtatatttttgtgcaagaaaaacagcaggagatgtaagtggagataatagaggatatttttttgatttatggggaagaggaagttgggtaatagtaagtagt

SEQ ID NO: 49777 - RNA, 381 nt, synthetic construct
  misc_feature 1..381: note = derived and/or modified sequence opt6 from anti-HIV-1_HeavyChain
  source 1..381: mol_type = other RNA
caagtacaattagtacaaagtggagcagaagtaaaaaaaccaggagcaagtgtaacactaagttgtaaaacagcagatgaagatgtatttgatgcagcatatatgcattgggtaagacaagcaccaggacaaacatttgaatggttaggatggatgaaaccagtaacaggagcagtaaattatgcaagaaaatttcaaggaagagtaagtttttatagaacaagagaattaggaatagcatatatggatttaagaaatttaagatttgatgatacagcagtatatttttgtgcaagaaaaacagcaggagatgtaagtggagataaaagaggattttttttcgatttatggggaagaggaagtagagtaatagtatcaagt

SEQ ID NO: 49778 - RNA, 384 nt, synthetic construct
  misc_feature 1..384: note = derived and/or modified sequence opt6 from anti-HIV-1_HeavyChain
  source 1..384: mol_type = other RNA
caaagtcatttagaacaaagtggaagtgcaatgaaaaaaccaggagcaagtgtaagagtaagttgttggacaagcgaagatatatttgatacaacagaactaatatattgggtaagacaagcaccaggacaaggattagaatggataggatgggtaaaaatagtaagtggaacagtaaattttgcaagcttagattttagaaatagaataagtttaagtagagatagaggattaagtacagcatatatggatataagaggattaacacaagatgatacagcaacatatttttgtgcaagacaaaaatttgcaagtagatatagtggagatcaaggaagttattttgatttatggggaagaggaacattaatagtagtaagtagt

SEQ ID NO: 49779 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtgcaagtggagtaagaagaccaggagcaagtgtaagagtaagttgttggacaagtgaagatatatttgaaagaagtgaattaatatattgggtaagacaagcaccaggaagaggactagaatggataggatggataaaattagtaagtggagcagtaaattttggaagtgtagattttagagatagagtaagtctaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagt

SEQ ID NO: 49780 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagtgtaagagtaagttgttggacaagtgaagatatatttgaaagaacagaactaatacattgggtaagacaagcaccaggacaaggattagaatggataggatgggtaaaaacagtaacaggagcagtaaattatggaagtttaaattttagaagtagaataagtttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagt

SEQ ID NO: 49781 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagtgtaagagtaagctgttggacaagcgaagatatatttgaaagaacagaattaatacattgggtaagacaagcaccaggacaaggattagaatggataggatgggtaaaaacagtaagtggagcagtaaattttggaagtccaaattttagacatagagtaagtttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagt

SEQ ID NO: 49782 - RNA, 384 nt, synthetic construct
  misc_feature 1..384: note = derived and/or modified sequence opt6 from anti-HIV-1_HeavyChain
  source 1..384: mol_type = other RNA
caagtacatttagaacaaagtggaagtggagtaaaaaaaccaggagcaagtgtaagagtaagttgttggagtagtgaagatatatttgaaaggacagaattaatacattgggtaagacaagcaccaggacaaggattagaatggataggatgggtaaaaacagtaacaggagcagtaaattttggaagtttagattttagacatagaataagtttaacaagagatagagatttatttacagcacatatggatataagagggctaacacaaggagatacagcaacatatttttgtgcaagacaaaaatttgaaagtagatatacaggaggacaaggatggtattttgatttatggggaagaggaacacatatagtagtaagtagt

SEQ ID NO: 49783 - RNA, 384 nt, synthetic construct
  misc_feature 1..384: note = derived and/or modified sequence opt6 from anti-HIV-1_HeavyChain
  source 1..384: mol_type = other RNA
caaagtcatttagaacaaagcggaagtgcaatgaaaaaaccaggagcaagcgtaagagtaagttgttggacaagtgaagatatatttgatacaacagaattaatatattgggtaagacaagcaccaggacaaggattagaatggataggatgggtaaaaatagtaagtggaacagtaaattttgcaagtttagattttagaaatagaataagtttaggaagagatagagatttaagcacagcatatatggatataagaggattaacacaagatgatacagcaacatatttttgtgcaagacaaaaatttgcaagtagatatagtggagatcaaggaagttattttgatttatggggaagaggaacattaatagtagtaagtagt

SEQ ID NO: 49784 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagtgtaagagtaagttgttggacaagtgaagatatatttgaaaggacagaattaatacattgggtaagacaagcaccaggacaaggattagaatggataggatgggtaaaaacagtaacaggaacagtaaattttggaagtttaaattttagacaaagagtaagtttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagt

SEQ ID NO: 49785 - RNA, 384 nt, synthetic construct
  misc_feature 1..384: note = derived and/or modified sequence opt6 from anti-HIV-1_HeavyChain
  source 1..384: mol_type = other RNA
caaagtcatttagaacaaagtggaagcgcaatgaaaaaaccaggagcaagtgtaagagtaagttgttggacaagtgaaggaatatttgatacaacagaattaatatattgggtaagacaagcaccaggacaaggattagaatggataggatgggtaaaaatagtaagtggaacagtaaattttgcaagtttagattttagaaatagaataagtctaagtagagatagagatttaagtacagcatatatggatataagaggattaacacaagatgatacagcaacatatttttgtgcaagacaaaaatttgcaagtagatatagtggagatcaaggaagttattttgatttatggggaagaggaacattaatagtagtaagtagt

SEQ ID NO: 49786 - RNA, 384 nt, synthetic construct
  misc_feature 1..384: note = derived and/or modified sequence opt6 from anti-HIV-1_HeavyChain
  source 1..384: mol_type = other RNA
caaagtagattagaacaaagtggaagtgcaatgaaaaaaccaggagcaagtgtaagagtaagttgttggacaagtgaagatatatttgatacaacagaattgatatattgggtaagacaagcaccaggacaaggattagaatggataggatgggtaaaaatagtaagcggaacagtaaattttgcaagtttagattttagaaatagaataagtttaagtagagatagagatttaagtacagcacatatggatataagaggattaacacaagatgatacagcaacatatttttgtgcaagacaaaaatttgcaagtagatatagtggagatcaaggaagctattttgatctatggggaagaggaacattaataatagtaagtagt

SEQ ID NO: 49787 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaaccaggagcaagtgtaagagtaagttgttggacaagtgaagatatatttgaaaaaagtgaattaatacattgggtaagacaagcaccaggacaaggattagaatggataggatgggtaaaaacagtaacaggagcagtaaattttggaagtagtgattttagacaaagagtgagtttaacaagagatagagatttatttacagcacatatggatataagaggattaacacaaggagatacagcaacatatttttgtgcaaggcaaaaatttgaaagtagatatacaggaggacaaggatggtattttgatttatggggaagaggaacacatatagtagtaagtagt

SEQ ID NO: 49788 - RNA, 384 nt, synthetic construct
  misc_feature 1..384: note = derived and/or modified sequence opt6 from anti-HIV-1_HeavyChain
  source 1..384: mol_type = other RNA
caatcacatttagaacaaagcggaagcgcaatgaaaaaaccaggagcgagtgtaagagtaagctgttggacaagtgaagacatatttgatacaacagaattaatatattgggtaagacaagcaccaggacaaggattagaatggataggatgggtaaaaatagtatcaggaacagtaaatttcgcaagttcagactttagaaatagaataagtttaagcagagacagagatttaagtacagcatatatggatataagaggattaacacaagatgatacagcaacatatttctgtgcaagacaaaaatttgcaagcagatattcaggagatcaaggaagttattttgatttatggggaagaggaacactaataatagtaagttca

SEQ ID NO: 49789 - RNA, 384 nt, synthetic construct
  misc_feature 1..384: note = derived and/or modified sequence opt6 from anti-HIV-1_HeavyChain
  source 1..384: mol_type = other RNA
caagcacatctagaacaatcaggatcaggagtaaaaaaaccaggagcatcagtaagagtatcatgctggacatcagaagatatatttgaaagaacagaattaatacactgggtaagacaagcaccaggacaaggactagaatggataggatgggtaaaaatagtaagcggaacagtaaactttgcatcactagatttcagaaacagaatatcactatcaagagatagagatttatcaacagcatacatggacataagaggactaacacaagatgacacagcaacatacttttgcgcaagacaaaaatttgcatcaagatatagtggagaccaaggatcatactttgacttatggggaagaggaacattaatagtagtatcaagt

SEQ ID NO: 49790 - RNA, 384 nt, synthetic construct
  misc_feature 1..384: note = derived and/or modified sequence opt6 from anti-HIV-1_HeavyChain
  source 1..384: mol_type = other RNA
agacatacatgggaacaaagtggaagtggagtaaaaaaaccaggagcaagtgtaagagtaagctgttggagtagtgaagatatatttgaaagaacagaattaatacattgggtaagacaagcaccaggacaaggattagaatggataggatgggtaaaaacagtaacaggagcagtaaattttggaagtttagatttcagacatagaataagtttaacaagagatagagatttatttacagcacatatggatataagaggattaacacaaggagatacagcaacatatttttgtgcaagacaaaaatttgaaagtaggtatacaggaggacaaggatggtattttgatttatggggaagaggaacacatatagtagtaagtagc

SEQ ID NO: 49791 - RNA, 384 nt, synthetic construct
  misc_feature 1..384: note = derived and/or modified sequence opt6 from anti-HIV-1_HeavyChain
  source 1..384: mol_type = other RNA
agacatacatgggaacaaagtggaagtggagtaaaaaaaccaggagcaagcgtaagagtaagttgttggacaagtgaagatatatttgaaagaacagaattaatacattgggtaagacaagcaccaggacaaggattagaatggataggatgggtaaaaacagtaacaggagcagtaaattttggaagtttagattttagacatagaataagtttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagt

SEQ ID NO: 49792 - RNA, 414 nt, synthetic construct
  misc_feature 1..414: note = derived and/or modified sequence opt6 from anti-HIV-1_HeavyChain
  source 1..414: mol_type = other RNA
caagcacatttagaacaatcaggatcaggagtaaaaaaaccaggagcaagtgtaagagtaagttgttggacaagtgaagatatatttgaaagaagtgaattaatacattgggtaagacaagcaccaggacaaggattagaatggataggatgggtaaaaacagtaacaggagcagtaaatttcggatcaccaaattttagacatagagtaagtctaacaagagatagagatttatttacagcacatatggatataagaggattaacacaaggagatacagcaacatatttttgtgcaagacaaaaatattatgcaggaggacaaggatggtattttgatttatggggaagaggaacattaatagtagtaagttcagcaagtacaaaaggaccaagtgtatttcatgatttaaga

SEQ ID NO: 49793 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaaccaggagcaagcgtaagagtgagttgttggacaagtgaagatatatttgaaagaacggaattaatacattgggtaagacaagcaccaggacaaggattagaatggataggatgggtaaaaatagtaagtggagcggtaaattttggaagtccaaattttagacaaagagtaagtttaacaagagatagagatttatttacagcacatatggatataagaggattaacacaaggagatacagcaacatatttttgtgcaagacaaaaatttgaaagaggaggacaaggatggatatttgatttatggggaagaggaacattaatagcagtatcaagtgcaagcacaaaaggaccaagtgtatttccaacaatatgtgta

SEQ ID NO: 49794 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagcggagtaaaaaaaccaggagcaagcgtaagagtaagttgttggacaagtgaagatatatttgaaaaaagtgaattaatacattgggtaagacaagcaccaggacaaggattagaatggataggatgggtaaaagcagtaagtggagcagtaaattatggaagtttagattttagacatagagtaagcttaacaagagatagagatttatttacagcacatatggatataagaggattaacacaagatgatacagcaatatatttttgtgcaagacaaaaatttgcaaggggagatcaaggatggttttttgatttatggggaagaggaacattaatagtagtaagtagtgcaagcacaaaaggaccaagtgtatttccacatgatttaaga

SEQ ID NO: 49795 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaagtaggagcaagtgtaagagtaagttgttggacaagtgaagatatatttgaaagaacagaattaatacattgggtaaggcaagcaccaggacaaggattagaatggataggatgggtaaaagcagtaagtggagcagtaaattatggaagtttagattttagacatagagtaagtttaacaagagatagagatttatttacagcacatatggatataagaggattaacacaagatgatacagcaatatatttttgtgcaagacaaaaatttgcaagaggagatcaaggatggttttttgatttatggggaagaggaacattaatagtagtaagtagtgcaagtacaaaaggaccaagcgtatttccacatgatttaaga

SEQ ID NO: 49796 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaattaggagcaagtgtaagagtaagttgttggacaagtgaagatatatttgaaagaacagaattaatacattgggtaaggcaagcgccaggacaaggattagaatggataggatgggtaaaagcagtaagtggagcagtaaattatggaagtttagattttagacatagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagtagtgcaagtacaaaaggaccaagtgtatttccacatgatttaaga

SEQ ID NO: 49797 - RNA, 423 nt, synthetic construct
  misc_feature 1..423: note = derived and/or modified sequence opt6 from anti-HIV-1_HeavyChain
  source 1..423: mol_type = other RNA
caagtatatatggaacaagcaggagcaggagtaaaaaaaccaggagcaagtgtaacattaagttgtaaaacagcagatgaagatgtatttgatgcagcatatatgcattgggtaagacaagcaccaggacaaacatttgaatggttaggatggatgaaaccagtaacaggagcagtaagttatgcaagaaaatttcaaggaagagtatcattttatatgacaagagaattaggaatggcatatatggatttaagaaatttaagatttgatgatacagcagtatatttttgtgcaagaaaaacagcaggagatgtaagtggagataatagaggatatttttttgatttatggggaagaggaagtagagtaatagtaagcagtgcaagtacaaaaggaccaagtgtatttccacatgatttaaga

SEQ ID NO: 49798 - RNA, 426 nt, synthetic construct
  misc_feature 1..426: note = derived and/or modified sequence opt6 from anti-HIV-1_HeavyChain
  source 1..426: mol_type = other RNA
caaagtcatttagaacaatcaggatcagcaatgaaaaaaccaggagcatcagtaagagtatcatgctggacatcagaagatatatttgacacaacagaattaatatactgggtaagacaagcaccaggacaaggactagaatggataggatgggtaaaaatagtaagtggaacagtaaactttgcatcactagatttcagaaacagaatatcactatcaagagatagagatttatcaacagcatacatggacataagaggactaacgcaagatgacacagcaacatacttttgcgcaagacaaaaatttgcatcaagatatagcggagaccaaggatcatactttgatttatggggaagaggaacattaatagtagtatcaagtgcaagtacaaaaggaccatcagtatttccaacaatatatgta

SEQ ID NO: 49799 - RNA, 372 nt, synthetic construct
  misc_feature 1..372: note = derived and/or modified sequence opt6 from anti-HIV-1_HeavyChain
  source 1..372: mol_type = other RNA
caagtacaattagtacaaagtggagcagaagtaaaaaaaccaggagcaagtgtaaaagtaagttgtaaagcaagtggaggaacattaagtagttatgcaataagttgggtaagacaagcaccaggacaaggattagaatggataggatgggtaaaaacagtaacaggagcagtaaattttggaagtgcatgttttagacatagagtaagtttaacaagagatagagatttatttacagcacatatggatataagaggattaacacaaggagatacagcaacatatttttgtgcaagacaaaaattttataaaggaggacaaggatggtattttgatttatggggaagaggaacactaatagtagtaagtagt

SEQ ID NO: 49800 - RNA, 372 nt, synthetic construct
  misc_feature 1..372: note = derived and/or modified sequence opt6 from anti-HIV-1_HeavyChain
  source 1..372: mol_type = other RNA
catgtaagattagtacaaagtggagcagaagtagaaaaaccaggagcaagtgtaaaagtaagttgtgaaacaagtaattatccatttaatatgtatggaatgacatgggtaagacaagcaccaggacaaggattagaatggataggatgggtaaaaatagtaagtggagcagtaaattttggaagtccaaattttagacaaagagtaagtttaacaagagatagagatttatttacagcacatatggatataagaggattaacacaaggagatacagcaacatatttttgtgcaagacaaaaatttgaaagaggaggacaaggatggatatttgatttatggggaagaggaacattaatagcagtaagtagt

SEQ ID NO: 49801 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaattaggagcaagtgtaagagtaagttgttggacaagtgaagatgtatttgaaagaacagaattaatacattgggtaagacaagcaccaggacaaggattagaatggataggatgggtaaaagcagtaagtggagcagtaaattatggaagtttagattttagacatagagtaagtttaacaagagatagagatttatttacagcacatatggatataagaggattaacacaagatgatacagcaacatatttttgtgcaagacaaaaattttatgcaggaggacaaggatggtattttgatttatggggaagaggaacattaatagtagtaagtagt

SEQ ID NO: 49802 - RNA, 375 nt, synthetic construct
  misc_feature 1..375: note = derived and/or modified sequence opt6 from anti-HIV-1_HeavyChain
  source 1..375: mol_type = other RNA
agacatacatgggaacaaagtggaagtggagtaaaaaaaccaggagcaagtgtaagagtaagttgttggagtagtgaagatatatttgaaagaacagaattaatacattgggtaagacaagcaccaggacaaggattagaatggataggatgggtaaaaacagtaacaggagcagtaaattttggaagtttagattttagacatagaataagcttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagt

SEQ ID NO: 49803 - RNA, 375 nt, synthetic construct
  misc_feature 1..375: note = derived and/or modified sequence opt6 from anti-HIV-1_HeavyChain
  source 1..375: mol_type = other RNA
agacatacatgggaacaaagtggaagcggagtaaaaagaccaggagcaagtgtaagagtaagttgttggacaagtgaagatatatttgaaacaacagaattaatacattgggtaagacaagcaccaggacaaggattagaatggataggatgggtaaaaacagtaagtggagcagtaaattttggaagtttaaattttagacatagagtaagtttaacaagagatagagatttaagtacagcacatatggatataagaggattaacacaagatgatacagcaacatatttttgtgcaagacaaaaatttgcaagaggagatcaaggatggttttttgatttatggggaagaggaacattaatagtagtaagtagt

SEQ ID NO: 49804 - RNA, 381 nt, synthetic construct
  misc_feature 1..381: note = derived and/or modified sequence opt6 from anti-HIV-1_HeavyChain
  source 1..381: mol_type = other RNA
caagtatttatggaacaagcaggagcaggaatgaaaaaaccaggagcaagtatgacagtaagttgtaaaacagcagatgaagatgtatttgatgcagcatatatgcattgggtaagacaagcaccaggacaaacatttgaatggttaggatggatgaaaccagtaacaggagcagtaaattatgcaagacaatttcaaggaagagtaagtttttatagaacaagagaattaggaatagcatatatggatttaagagatttaaaatttgatgatacagcagtatatttttgtgcaagaaaaacaaaaggagatgtaagtggagatgatagaggatttttttttgatttatggggaagaggaacaagagtaatagtaagtagt

SEQ ID NO: 49805 - RNA, 384 nt, synthetic construct
  misc_feature 1..384: note = derived and/or modified sequence opt6 from anti-HIV-1_HeavyChain
  source 1..384: mol_type = other RNA
caagtacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagtttagattttagacatagaataagcttaacaagagatagagatctatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagt

SEQ ID NO: 49806 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaactaggagcaagtgtaagagtaagttgttggacaagtgaagatatatttgaaagaacagaattaatacattgggtaagacaagcaccaggacaaggactagaatggataggatgggtaaaagcagtaagtggagcagtaaattatggaagtctagattttagacatagagtaagtttaacaagagatagagatttaagtacagcacatatggatataagaggattaacacaagatgatacagcaacatatttttgtgcaagacaaaaatttgcaagaggagatcaaggatggttttttgatttatggggaagaggaacattaatagtagtaagtagtgcaagtacaaaaggaccaagcgtatttccaacaatatgtgta

SEQ ID NO: 49807 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaatcaggatcaggagtaaaaaaaccaggagcatcagtaagagtatcatgttggacaagtgaagatatatttgaaaaaagtgaattaatacattgggtaagacaagcaccaggacaaggattagaatggataggatgggtaaaaacagtaacaggagcagtaaattttggatcaagtgattttagacaaagagtatcattaacaagagatagagatttatttacagcacatatggatataagaggattaacacaaggagatacagcaacatatttttgtgcaagacaaaaattttatgcaggaggacaaggatggtattttgatttatggggaagaggaacattaatagtagtaagttcagcatcaacaaaaggaccaagtgtatttccaacaatatgtgta

SEQ ID NO: 49808 - RNA, 417 nt, synthetic construct
  misc_feature 1..417: note = derived and/or modified sequence opt6 from anti-HIV-1_HeavyChain
  source 1..417: mol_type = other RNA
caagcacatttagaacaaagtggaagtggagtaaaaaaattaggagcaagtgtaagagtaagttgttggacaagtgaagatgtatttgaaagaacagaattaatacattgggtaagacaagcaccaggacaaggattagaatggataggatgggtaaaagcagtaagtggagcagtaaattatggaagtctagattttagacatagagtaagtttaacaagagatagggatttatttacagcacatatggatataagaggattaacacaagatgatacagcaacatatttctgtgcaagacaaaaattttatgcaggaggacaaggatggtattttgatttatggggaagaggaacattaatagtagtaagtagtgcaagtacaaaaggaccaagcgtatttccacatgatttaaga

SEQ ID NO: 49809 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagcgtaagagtaagttgttggacaagtgaagatatatttgaaagaacagaattaatacattgggtaagacaagcaccaggacaaggattagaatggataggatgggtaaaaatagtaagtggagcagtaaattttggaagtccaaattttagacaaagagtaagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagt

SEQ ID NO: 49810 - RNA, 384 nt, synthetic construct
  misc_feature 1..384: note = derived and/or modified sequence opt6 from anti-HIV-1_HeavyChain
  source 1..384: mol_type = other RNA
caagcacatttagaacaaagtggaagtggagtaaaaaaattaggagcaagtgtaagagtaagttgttggacaagtgaagatatatttgaaagaacagaattaatacattgggtaaggcaagcaccaggacaaggattagaatggataggatgggtaaaaacagtaacaggagcagtaaattttggaagtttagattttagacatagaataagtttaacaagagatagagatttatttacagcacatatggatataagaggattaacacaaggagatacagcaacatatttttgtgcaagacaaaaatttgaaagtagatatacaggaggacaaggatggtattttgatttatggggaagaggaacacatatagtagtaagtagt

SEQ ID NO: 49811 - RNA, 426 nt, synthetic construct
  misc_feature 1..426: note = derived and/or modified sequence opt6 from anti-HIV-1_HeavyChain
  source 1..426: mol_type = other RNA
caagcacatttagaacaaagtggaagcggagtaaaaaaaccaggggcaagtgtaagagtaagttgttggagtagtgaagatatatttgaaagaacagaattaatacattgggtaagacaagcaccaggacaaggattagaatggataggatgggtaaaaacagtaacaggagcagtaaattttggaagtttagattttagacatagaataagtctaacaagagatagagatttatttacagcacatatggatataagaggattaacacaaggggatacagcaacatatttttgtgcaagacaaaaatttgaaagtagatatacaggaggacaaggatggtattttgatttatggggaagaggaacacatatagtagtaagtagtgcaagtacaaaaggaccaagtgtatttccaacgatatgtgta

SEQ ID NO: 49812 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggaacaagtgtaagagtaagttgttggacaagtgaagatatatttgaaagaacagaattaatacattgggtaagacaagcaccaggacaaggactagaatggataggatgggtaaaaacagtaacaggagcagtaaattttggaagcccaaattttagacatagagtaagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagt

SEQ ID NO: 49813 - RNA, 381 nt, synthetic construct
  misc_feature 1..381: note = derived and/or modified sequence opt6 from anti-HIV-1_HeavyChain
  source 1..381: mol_type = other RNA
caagtacaactagtacaatcaggagcagaagtaaaaaaaccaggagcatcagtaaaagtatcatgcaaagcatcaggatatacatatacaacatacggagtatcatggttaagacaagtaccaggacaaagaccagaatggatgggatggataagaccaaaaacaggagcaagaaatcaagcaagacaattccaaccaagaatatcactaacgagagatagagcactatcaacagcatacttagacttaaactcactaacaagcgcagactcaggaacatacttttgcgcaagacaaacatttaaaccagacttttactttgcagatcaaggatggtcattcaatctatggggaagaggagcacactttatagtaagctca

SEQ ID NO: 49814 - RNA, 384 nt, synthetic construct
  misc_feature 1..384: note = derived and/or modified sequence opt6 from anti-HIV-1_HeavyChain
  source 1..384: mol_type = other RNA
agagcacatttagaacaaagtggaagtggagtaaaaaaattaggagcaagtgtaagagtaagttgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagtttaacaagagatagagatttatttacagcacatatggatataagaggattaacacaagatgatacagcaacatatttttgtgcaagacaaaaatttgaaagtagatatacaggaggacaaggatggtattttgatttatggggaagaggaacacatataacagtaagtagt

SEQ ID NO: 49815 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagcggagtaaaaaaaccaggagcaagcgtaagagtaagttgttggacaagtgaagatatatttgaaagaacagaattaatacattgggtaagacaagcaccaggacaaggattagaatggataggatgggtaaaaatagtaagtggagcagtaaattttggaagcccaaattttagacaaagagtaagtttaacaagagatagagatttatttacagcacatatggatataagaggattaacacaaggagatacagcaacatattattgtgcaagacaaaaatttgaaagaggaggacaaggatggatatttgatttatggggaagaggaacattaatagcagtaagtagt

SEQ ID NO: 49816 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaactaggagcaagcgtaagagtaagttgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagtttaacaagagatagagatttatttacagcacatatggatataagagggttaacacaagatgatacagcaacatatttttgtgcaagacaaaaatttgcaagaggagatcaaggatggtttttcgatttatggggacatggaacattaatagtagtaagtagt

SEQ ID NO: 49817 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagcgtaagagtaagttgttggacaagtgaagatatatttgaaagaacagaattaatacattgggtaagacaagcaccaggacaaggattagaatggataggatgggtaaaaacagtaacaggagcagtaaattttggaagcccaaattttagacatagagtaagtttaacaagagatagagatctatttacagcacatatggatataagaggattaacacaaggagatacagcaacatatttttgtgcaagacaaaaatttgaaagaggaggacaaggatggtattttgatttatggggacatggaacattaatagtagtaagtagt

SEQ ID NO: 49818 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaaaaagtgaattaatacattgggtaagacaagcaccagggcaaggattagaatggataggatgggtaaaaacagtaacaggagcagtaaattttggaagtagcgattttagacaaagagtaagtttaacaagagatggagatctatttacagcacatatggatataagaggattaacacaaggagatacagcaacatatttttgtgcaagacaaaaattttatgcaggaggacaaggatggtattttgatttatggggaagaggaacattaataatagtaagtagt

SEQ ID NO: 49819 - RNA, 372 nt, synthetic construct
  misc_feature 1..372: note = derived and/or modified sequence opt6 from anti-HIV-1_HeavyChain
  source 1..372: mol_type = other RNA
caagcacatttagaacaaagtggaagcggagtaaaaaaaccaggagcaagtgtaagagtaagttgttggacaagtgaagacatatttgaaaaatcagaattaatacattgggtaagacaagcaccaggacaaggattagaatggataggatgggtaaaaacagtaacaggagcagtaaattttggacatcaaatatcagatagagtatcattaacaagagatagagatttatttacagcacatatggatataagaggactaacacaaggagatacagcaacatatttttgtgcaagacaaaaattttatgcaggaggacaaggatggtattttgatttatggggacatggaacattaatagtagtaagttca

SEQ ID NO: 49820 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaagtggagcagtaaattttggaagtccaaattttagacatagagtaagtttaacaagagatagagatttatttacagcacatatggatataagaggattaacacaaggagatacagcaacatatttttgtgcaagacaaaaatttgaaagaggaggacaaggatggtattttgatttatggggacatggaacattaatagtagtatcaagc

SEQ ID NO: 49821 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggagcaggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaagtggggcagtaaattttggaagtccaaattttagacatagagtaagtttaacaagagatagagatttatttacagcacatatggatataagaggattaacacaaggagatacagcaacatattattgtgcaagacaaaaatttgaaagaggaggacaaggatggtattttgatttatggggaagaggaacattaatagtagtaagtagt

SEQ ID NO: 49822 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaattaggagcaagtgtaagagtaagttgttggacaagtgaagatatatttgaaagaacagaattaatacattgggtaagacaagcaccaggaagaggattagaatggataggatgggtaaaagcagtaagtggagcagtaaattatggaagtttagattttagacatagagtaagtttaacaagagatagagatttatttacagcacatatggatataagaggactaacacaagatgatacagcaacatattattgtgcaagacaaaaattcgaaagaggaggacaaggatggatatttgatttatggggaagaggaacattaatagcagtaagtagt

SEQ ID NO: 49823 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagcggaagtggagtaaaaaaaccaggagcaagtgtaagagtaagctgttggacaagtgaagatatatttgaaaaaagtgaattaatacattgggtaagacaagcaccaggacaaggattagaatggataggatgggtaaaaacagtaacaggagcagtaaattttggaagtagtgattttagacaaagagtaagcttaacaagagatagagatctatttacagcacatatggatataagaggattaacacaaggagatacagcaacatattattgtgcaagacaaaaattttatgcaggaggacaaggatggtattttgatttatggggaagaggaacattaatagtagtaagtagt

SEQ ID NO: 49824 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagtccaaattttagacatagagtaagtttaacaagagatagagatttatttacagcacatatggatataagaggattaacacaaggagatacagcaacatatttttgtgcaagacaaaaattttataaaggaggacaaggatggtattttgatttatggggaagaggaacattaatagtagtaagtagt

SEQ ID NO: 49825 - RNA, 372 nt, synthetic construct
  misc_feature 1..372: note = derived and/or modified sequence opt6 from anti-HIV-1_HeavyChain
  source 1..372: mol_type = other RNA
tacgtagaattaggaacaaacacaggaccagaagtaagaaaaccaggagcatcagtaaaaatatcatgcaaaacatcaggatatatatttacagataactatttccattggttaagacaagcaccagcagtaggattagaatggatgggatggataaactcacacaatggatatacaaaaagcgcaaaaaaattccaaggaagaataacaatgacaagagatacagcagtagatacagcatacatggaattaatagatctaacaagcgatgacacagcaacatactattgcgcaagacaaaaattttacgcaggaggacaaggatggtatttcgatctatggggatgtggaacactaatagtagtaagctca

SEQ ID NO: 49826 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaaaaagtgaattaatacattgggtaagacaagcaccaggacaaggattagaatggataggatgggtaaaaacagtaacaggagcagtaaattttggaagtagtgattttagacaaagagtaagtttaacaagagatagagatttatttacagcacatatggatataagaggattaacacaaggagatacagcaacatatttttgtgcaagacaaaaattttatgcaggaggacaaggatggtattttgatttatggggaagaggaacattaatatgtgtaagtagt

SEQ ID NO: 49827 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagcgtaagagtaagctgttggacaagcgaagatatatttgaaagaacagaattaatacattgggtaagacaagcaccaggacaaggattagaatggataggatgggtaaaaacagtaacaggagcagtaaattttggaagtagtgattttagacaaagagtaagtttaacaagagatagagatttatttacagcacatatggatataagagggttaacacaaggagatacagcaacatattattgtgcaagacaaaaattttatgcaggaggacaaggatggtattttgatttatggggaaggggaacattaatagtagtaagtagt

SEQ ID NO: 49828 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagcggaagtggagtaaaaaaaccaggagcaagtgtaagagtaagctgttggacaagtgaagatatatttgaaagaacagaattaatacattgggtaagacaagcaccaggacaaggattagaatggataggatgggtaaaaccagtaacaggagcagtaaattttggaagtccaaattttagacatagagtaagtttaacaagagatagagatttatttacagcacatatggatataagaggattaacacaaggagatacagcaacatatttttgtgcaagacaaaaatttgaaagaggaggacaaggatggtattttgatttatggggaagaggaacattaatagtagtaagtagt

SEQ ID NO: 49829 - RNA, 375 nt, synthetic construct
  misc_feature 1..375: note = derived and/or modified sequence opt6 from anti-HIV-1_HeavyChain
  source 1..375: mol_type = other RNA
caagtacaattagtacaaagtggagcagaagtaaaaaaaccaggagcaagtgtaagagtaagttgttggacaagtgaagatatatttgaaaaaagtgaattaatacattgggtaagacaagcaccaggacaaggattagaatggataggatgggtaaaaacagtaacaggagcagtaaattttggaagtagtgattttagacaaagagtaagtttaacaagagatagagatttatttacagcacatatggatataagaggattaacacaaggagatacagcaacatattattgtgcaagacaaaaatttgaaagaggaggacaaggatggtattttgatttatggggaagaggaacattaatagtagtaagtagt

SEQ ID NO: 49830 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagcggaagtggagtaaaaaaattaggagcaagtgtaagagtaagttgttggacaagtgaagatatatttgaaagaacagaattaatacattgggtaagacaagcaccaggacaaggattagaatggataggatgggtaaaagcagtaagtggagcagtaaattatgggagtttagattttagacatagagtaagtttaacaagagatagagatttaagtacagcacatatggatataagaggattaacacaagatgatacagcaacatatagttgtgcaagacaaaaatttgcaagaggagatcaaggatggttttttgatttatggggaagaggaacattaatagtagtaagtagt

SEQ ID NO: 49831 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggaacaagtgtaagagtaagttgttggacaagtgaagatatatttgaaagaacagaactaatacattgggtaagacaagcaccaggacaaggattagaatggataggatgggtaaaaacagtaacaggagcagtaaattttggaagtccaaattttagacatagagtaagtttaacaagagatagagatttatttacagcacatatggatataagaggattaacacaaggagatacagcaacatattattgtgcaagacaaaaatttgaaagaggaggacaaggatggtattttgatttatggggaagaggaacattaatagtagtaagtagt

SEQ ID NO: 49832 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagcggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggaacagtaaattttggaagtttaaattttagacaaagagtaagtttaacaagagatagagatttatttacagcacatatggatataagaggattaacacaaggagatacagcaacatatttttgtgcaagacaaaaatttgcaagaggagatcaaggatggttttttgatttatggggacatggaacattaatagtagtaagtagt

SEQ ID NO: 49833 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaattttggaagtccaaattttagacatagagtaagtttaacaagagatagagatccatttacagcacatatggatataagaggattaacacaaggagatacggcaacatatttttgtgcaagacaaaaattcgaaagaggaggacaaggatggtattttgatttatggggacatggaacattaatagtagtatcaagt

SEQ ID NO: 49834 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagcgaagatatatttgaaagaacagaattaatacattgggtaagacaagcaccaggacaaggattagaatggataggatgggtaaaaacagtaacaggagcagtaaattttggaagtccaaattttagacatagagtaagtttaacaagagatagagatttatttacagcacatatggatatatgtggattaacacaaggagatacagcaacatatttttgtgcaagacaaaaatttgaaagaggaggacaaggatggtattttgatttatggggacatggaacactaatagtagtaagtagt

SEQ ID NO: 49835 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaattaggagcaagtgtaagagtaagttgttggacaagtgaagatatatttgaaagaacagaattaatacattgggtaagacaagcaccaggacaaggactagaatggataggatgggtaaaagcagtaagtggagcagtaaattatggaagcttagattttagacaaagagtaagtttaacaagagatagagatctatttacagcacatatggatataagaggattaacacaaggagatacagcaacatattattgtgcaagacaaaaattctatgcaggaggacaaggatggtattttgatttatggggaagaggaacattaatagtagtgagcagt

SEQ ID NO: 49836 - RNA, 372 nt, synthetic construct
  misc_feature 1..372: note = derived and/or modified sequence opt6 from anti-HIV-1_HeavyChain
  source 1..372: mol_type = other RNA
caagcgcatttagaacaaagtggaagtggagtaaaaaaaccaggagcaagtgtaagagtaagttgttggacaagtgaagatatatttaaaagtgaattaatacattgggtaagacaagcaccaggacaaggactagaatggataggatgggtaaaaacagtaacaggagcagtaaattttggatcaagcgattttagacaaagagtatcactaacgagagatagagatctatttacagcacatatggatataagaggattaacacaaggagatacagcaacatatttttgtgcaagacaaaaattttatgcaggaggacaaggatggtattttgatttatggggccatggaacattaatagtagtaagttca

SEQ ID NO: 49837 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggaacaagtgtaagagtaagttgttggacaagtgaagatatatttgaaagaacagaattaatacattgggtaagacaagcaccaggacaaggattagaatggataggatgggtaaaaacagtaacaggagcagtaaattttggaagtccaaattttagacatagagtaagtttaacaagagatagagatttatttacagcacatatggatataagaggattaacacaaggagatacagcaacatatttttgtgcaagacaaaaatttgcaagaggagatcaaggatggttttttgatttatggggacatggaacattaatagtagtaagtagt

SEQ ID NO: 49838 - RNA, 375 nt, synthetic construct
  misc_feature 1..375: note = derived and/or modified sequence opt6 from anti-HIV-1_HeavyChain
  source 1..375: mol_type = other RNA
caagcacatctagaacaaagcggaagtggagtaaaaaaattaggagcaagcgtaagagtaagttgttggacaagtgaagatatatttgaaagaacagaattaatacattgggtaagacaagcaccaggacaaggattagaatggataggatgggtaaaagcagtaagcggagcagtaaattatggaagtttagattttagacatagagtaagcttaacaagagatagagatttatttacagcacatatggatataagaggattaacacaagatgatacagcaacatattattgtgcaagacaaaaatttgcaagaggagatcaaggatggttttttgatctatggggaagaggaacattaatagtagtaagtagt

SEQ ID NO: 49839 - RNA, 381 nt, synthetic construct
  misc_feature 1..381: note = derived and/or modified sequence opt6 from anti-HIV-1_HeavyChain
  source 1..381: mol_type = other RNA
caagtacaattagtacaaagcggagcagaagtaaaaaaaccaggagcatcagtaaaagtaagctgtaaagcaagcggatacacattcacagattattacctacactgggtaagacaagcaccaggacaaggactagattgggtaggatggataaatccaaatagcggaggaacaaattatgcacaaaaatttcaaggaagagtagcaatgacaagagacacaagtttaagctcagtatatttagatctaaatagcttaacatcagcagatagcggaacatatttctgtgcaagacaaacattcaaaccagatttctatttcgcagaccaaggatggagttttaacttatggggacaaggaagccatttcatagtatcaagc

SEQ ID NO: 49840 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagctgttggacaagtgaagatatatttgaaaaaagtgaattaatacattgggtaagaagagcaccaggacaaggattagaatggataggatgggtaaaaacagtaacaggagcagtaaattttggaagtagtgattttagacaaagagtaagtttaacaagagatagagatttatttacagcacatatggatataagaggattaacacaaggagatacagcaacatattattgtgcaagacaaaaattttatgcaggaggacaaggatggtattttgatttatggggaagaggaacattaatagtagtaagttca

SEQ ID NO: 49841 - RNA, 372 nt, synthetic construct
  misc_feature 1..372: note = derived and/or modified sequence opt6 from anti-HIV-1_HeavyChain
  source 1..372: mol_type = other RNA
caagcacatttagaacaaagtggaagtggagtaaaaaaaccaggagcaagtgtaacagtaagttgttggacaagtgaagacatatttgaaaaatcagaattaatacattgggtaagacaagcaccaggacaaggattagaatggataggatgggtaaaaacagtaacaggagcagtaaatttagtatatcaaatatcagatagagtatcattaacaagagatagaggattatttacagcacatatggatataagaggattaacacaaggagatacagcaacatattattgtgcaagacaaaaattttatgcaggaggacaaggatggtattttgatttatggggaagaggtacattaatagtagtaagttca

SEQ ID NO: 49842 - RNA, 375 nt, synthetic construct
  misc_feature 1..375: note = derived and/or modified sequence opt6 from anti-HIV-1_HeavyChain
  source 1..375: mol_type = other RNA
caagcacatctagaacaaagcggaagtggagtaaaaaaaccaggagcaagtgtaagagtaagttgttggacaagtgaagatatatttgaaggaagtgaattaatacattgggtaagacaagcaccaggacaaggattagaatggataggatgggtaaaaacagtaacaggagcagtaaattttggaagcgcatattttagacatagagtaagtttaacaagagatagagatttatttacagcacatatggatataagaggattaacacaaggagatacagcaacatatttttgtgcaagacaaaaattttataaaggaggacaaggatggtattttgatctatggggacatggaacattaatagtagtaagtagt

SEQ ID NO: 49843 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaacaggagcagtaaattatggaagtttaaattttagaagtagaataagtttaacaagagatagagatttatttacagcacatatggatataagaggattaacagaaggagatacagcaacatatttttgtgcaagacaaaaattttatgcaggaggacaaggatggtattttgatctatggggacatggaacattaatagtagtaagcagt

SEQ ID NO: 49844 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagcggagtaaaaaaaccaggagcaagtgtaagagtaagttgttggacaagtgaagatatatttgaaagaacagaattaatacattgggtaagacaagcaccaggacaaggattagaatggataggatgggtaaaaacagtaagcggagcagtaaattttggaagtccaaattttagacatagagtaagtttaacaagagatagagatttatttacagcacatatggatataagaggattaacacaaggagatatggcaacatatttttgtgcaagacaaaaatttgaaagaggaggacaaggatggtattttgatttatggggacatggaacattaatagtagtaagtagt

SEQ ID NO: 49845 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaagaaccaggaacaagtgtaagagtaagttgttggacaagtgaagatatatttgaaagaacagaattaatacattgggtaagacaagcaccaggacaaggattagaatggataggatgggtgaaaacagtaacaggagcagtaaattttggaagcccaaattttagacatagagtaagtttaacaagagatagagatttatttacagcacatatggatataagaggattaacacaaggagatacagcaacatatttttgtgcaagacaaaaatttgaaagaggaggacaaggatggatatttgatctatggggaagaggaacattaatagcagtaagtagt

SEQ ID NO: 49846 - RNA, 375 nt, synthetic construct
  misc_feature 1..375: note = derived and/or modified sequence opt6 from anti-HIV-1_HeavyChain
  source 1..375: mol_type = other RNA
caagtacaattagaacaaagtggaagtggagtaaaaaaattaggagcaagtgtaagagtaagctgttggacaagtgaagatatatttggaagaacagaattaatacattgggtaagacaagcaccaggacaaggattagaatggataggatgggtaaaagcagtaagtggagcagtaaattatggaagtttagattttagacatagagtaagtttaacaagagatagagatttatttacagcacatatggatataagaggattaacacaagatgatacagcaacatattattgtgcaagacaaaaatttgcaagaggagatcaaggatggttttttgatttatggggaagaggaacattaatagtagtaagtagt

SEQ ID NO: 49847 - RNA, 372 nt, synthetic construct
  misc_feature 1..372: note = derived and/or modified sequence opt6 from anti-HIV-1_HeavyChain
  source 1..372: mol_type = other RNA
caagcacatttagaacaaagtggaagtggagtaaaaaaaccaggagcaagtgtaagagtaagttgttggacaagtgatgatatatttaaaacagaattaatacattgggtaagacaagcaccaggacaaggattagaatggataggatgggtaaaaacagtaacaggagcagtaaattttggatcaccaaattttagacaaagagtatcattaacaagagatagagatttatttacagcacatatggatataagaggattaacacaagatgatacagcaacatatttttgtgcaagacaaaaatttgcaagaggagatcaaggatggttttttgatttatggggaagaggaacactaatagtagtaagttca

SEQ ID NO: 49848 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttgaaagaacagaattaatacattgggtaagacaagcaccagggcaaggattagaatggataggatgggtaaaaacagtaacaggagcagtaaattttggaagtccaaattttagacatagagtaagtttaacaagagatagagatttatttacagcacatatggatataagaggattaacacaaggagatacagcaacatattattgtgtaagacaaaaatttgaaagaggaggacaaggatggtattttgatttatggggaagaggaacattaatagtagtaagtagt

SEQ ID NO: 49849 - RNA, 375 nt, synthetic construct
  misc_feature 1..375: note = derived and/or modified sequence opt6 from anti-HIV-1_HeavyChain
  source 1..375: mol_type = other RNA
caagtacaattagtacaaagtggagcagaagtaaaaaaaccaggagcaagtgtaaaagtaagttgttggacaagtgaagatatatttgaaaaaagtgaattaatacattgggtaagacaagcaccagggcaaggattagaatggataggatgggtaaaaacagtaacaggagcagtaaattttggaagtagtgattttagacaaagagtaagtttaacaagagatagagatttatttacagcacatatggatataagaggattaacacaaggagatacagcaacatattattgtgcaagacaaaaattttatgcaggaggacaaggatggtattttgatttatggggaagaggaacattaatagtagtaagcagt

SEQ ID NO: 49850 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagcggaagtggagtaaaaaaattaggagcaagtgtaagagtaagttgttggacaagtgaagatatatttgaaagaacagaattaatacattgggtaagacaagcaccaggacaaggattagaatggataggatgggtaaaagcagtaagtggagcagtaaattatggaagtttagattttagacatagagtaagtttaacaagagatagagatttatttacagcacatatggatataagaggattaacacaaggagatacagcaacatatttttgtgcaagacaaaaattttataaaggaggacaaggatggtattttgatttatggggaagaggaacattaatagtagtaagtagt

SEQ ID NO: 49851 - RNA, 372 nt, synthetic construct
  misc_feature 1..372: note = derived and/or modified sequence opt6 from anti-HIV-1_HeavyChain
  source 1..372: mol_type = other RNA
caagcacatttagaacaaagtggaagtggagtaaaaaaaccaggagcaagtgtaagagtaagttgttggacaagtgaagatatatttgaaaaatcagaattaatacattgggtaagacaagcaccaggacaaggattagaatggataggatgggtaaaaacagtaacaggagcagtaaattttgcacatcaaatatcagatagagtatcattaacaagagatagagatttatttacagcacatatggatataagaggattaacacaaggagatacagcaacatattattgtgcaagacaaaaattttatgcaggaggacaaggatggtattttgatttatggggaagaggaacattaatagtagtaagttca

SEQ ID NO: 49852 - RNA, 375 nt, synthetic construct
  misc_feature 1..375: note = derived and/or modified sequence opt6 from anti-HIV-1_HeavyChain
  source 1..375: mol_type = other RNA
caagcacatttagaacaaagtggaagtggagtaaaaaaaccaggagcaagtgtaagagtaagttgttggacaagtgaagatatatttggaagaacagaattaatacattgggtaagacaagcaccaggacaaggattagaatggataggatgggtaaaaacagtaagtggagcagtaaattttggaagtccaaattttagacatagagtaagtttaacaagagatagagatttatttacagcacatatggatataagaggattaacacaaggagatacagcaacatatttttgtgcaagacaaaaatttgaaagaggaggacaaggatggtattttgatctatggggaagaggaacattaatatgtgtaagcagt

SEQ ID NO: 49853 - RNA, 636 nt, synthetic construct
  misc_feature 1..636: note = derived and/or modified sequence opt6 from anti-HIV_5CIN_LightChain
  source 1..636: mol_type = other RNA
gaaatagtactaacacaatcaccaggaacacaatcactatcaccaggagaacgagcaacactatcatgcagagcatcacaatcagtaggaaacaacaaactagcatggtaccaacaaagacccggacaagcaccaagactactaatatatggagcatcatcacgaccatcaggagtagcagacagattctcaggatcaggatcaggaacagacttcacactaacaatatcacgattagaacccgaagacttcgctgtatactattgccaacaatacggacaatcactatcaacattcggacaaggcacaaaagtagaagtaaaaagaacagtagcagcaccctcagtattcatattcccaccatcagacgaacaactaaaaagcggaacagcatcagtagtatgcctacttaacaacttctacccaagagaagcaaaagtacaatggaaagtagacaacgcactacaatccggaaactcacaagaatcagtaacagaacaagactcaaaagactccacatacagcctatcatcaacattaacattatcaaaagcagactacgaaaaacacaaagtatacgcatgtgaagtaacacaccaaggactatcctcacctgtaacaaaatcattcaacaga

SEQ ID NO: 49854 - RNA, 672 nt, synthetic construct
  misc_feature 1..672: note = derived and/or modified sequence opt6 from anti-HIV_5CIN_HeavyChain
  source 1..672: mol_type = other RNA
gtacaacttgtacaatcaggagcagaagtaaaaagaccaggatcatcagtaacagtatcatgtaaagcatcaggaggaagtttctctacatatgcattatcctgggtaagacaagcaccaggcagaggactagaatggatgggaggagtaataccactactaacaataacaaactatgctccaagattccaaggaagaataaccataacagcagaccgcagtacatcaacagcatatctagaattaaattcattaagaccagaagatacagcagtatattattgtgccagagaaggaaccacaggatcaggaggaaaaccaataggagcatttgcacattggggacaaggaacattagtaacagtatcttcagcatcaactaaaggaccatcagtatttccactagcaccatcatcaaaatcaacatccggaggaacagcagcactaggatgcttagtaaaagattactttccagaaccagtaacagtatcatggaactcaggagcactaacttcaggagtacatacatttccagccgtactacaatcatccggattatactcattatcatcagtagttacagtaccatcatcatcactaggaacacaaacatatatatgtaacgtaaaccataaaccatcaaatacaaaagtagataaaaaagtagaacca

SEQ ID NO: 49855 - RNA, 678 nt, synthetic construct
  misc_feature 1..678: note = derived and/or modified sequence opt6 from anti-HIV_5CIL_HeavyChain
  source 1..678: mol_type = other RNA
gtacaattagtacaatcaggagcagaagtaaaaagaccaggatcatcagtaacagtatcatgcaaagcatcaggaggatcattctcaacatatgcattatcatgggtaagacaagcaccaggaagaggtctagaatggatgggcggagtaataccactactaacaataactaattatgcaccaagatttcaaggtagaataactataacagcagacagatcaacttcaacagcctatctagaactaaattcattaagaccagaagatacagcagtatattattgtgcaagagaaggtacaactggagatggagatctaggaaaaccaataggagcatttgcacattggggacaaggaacattagtaactgtatcatcagcatcaacaaaaggaccatcagtatttccattagcaccatcatcaaaatctacatcaggaggaacagcagcattaggatgcctagtaaaagattatttcccagaaccagttacagtatcatggaactctggagctctaacatcaggagtacatacatttccagcagtattacaaagttcaggactatattcattatcatcagtagtaacagtaccatcctcatcactaggaacacaaacatatatatgtaacgtaaaccataaaccaagcaataccaaagtagataaaaaagtagaacca

SEQ ID NO: 49856 - RNA, 678 nt, synthetic construct
  misc_feature 1..678: note = derived and/or modified sequence opt6 from anti-HIV_5CIP_A-Chain
  source 1..678: mol_type = other RNA
gtacaattagtacaatcaggagcagaagtaaaaagaccaggatcatcagtaacagtatcatgcaaagcatcaggaggatcattttcaacatatgcattatcatgggtaagacaagcaccaggaagaggactagaatggatgggaggagtaataccattactaacaataactaattatgcaccacgctttcaaggaagaattaccattacagcagatagatcaacatcaaccgcatatctagaactaaactcactaagaccagaagatacagcagtatattactgtgcacgagaaggaaccacaggatggggatggttaggaaaaccaataggagcatttgcacattggggacaaggaacactagtaaccgtatcatcagcaagcacaaaaggaccatcagtatttccattagcaccaagttcaaaatcaacatcaggaggaacagcagcattaggctgtctagtaaaagattactttccagaaccagtaacagtttcatggaactcaggagcactaacatcaggagtacacacatttccagcagtattacaatcatcaggactatacagtttatcatcagtagttacagtaccatcatcatcattaggaacacaaacatatatatgtaatgtaaaccataaaccatcaaatacaaaagtagataaaaaagtagaacca

SEQ ID NO: 49857 - RNA, 681 nt, synthetic construct
  misc_feature 1..681: note = derived and/or modified sequence opt6 from anti-HIV_5CIP_HeavyChain
  source 1..681: mol_type = other RNA
gtacaattagtacaatcaggagcagaagtaaaaagaccaggatcatcagtaacagtatcatgtaaagcatcaggaggatcattctcaacatatgcattatcatgggtaagacaagcaccaggaagaggactagaatggatgggaggagtaataccactattaacaataacaaactatgcaccaagatttcaaggaagaataacaattacagcagacagatcaacaagcacagcatatttagaattaaatagcttaagaccagaagatacagcagtatattattgtgcacgagaaggaacaacaggatggggatggctaggtaaaccaataggagcatttgcacattggggacaaggaacattagtaacagtatcatcagcatcaacaaaaggaccaagtgtatttccattagcaccatcaagtaaatcaacaagtggaggaacagcagcattaggatgtctagtaaaagattactttccagaaccagtaacagtatcatggaactcaggagcactaactagcggagtccatacatttccagcagtattacaatcatcaggattatatagtctatcaagcgtagtaacagtaccaagttcatcattaggaacacaaacatatatatgtaacgtaaaccataaaccatctaatacaaaagtagataaaaaagtagaaccaaaa

SEQ ID NO: 49858 - RNA, 630 nt, synthetic construct
  misc_feature 1..630: note = derived and/or modified sequence opt6 from anti-HIV_4JKP_LightChain
  source 1..630: mol_type = other RNA
gaaatagtactcacacaaagcccagcaacattaagcctaagcccaggcgaaacagcaataatatcatgtagaacaagccaatacggtagcttagcatggtaccaacaaagaccaggacaagcaccaagattagtcatatatagcggatcaacaagagcagccggaataccagacagattctcaggatcaagatggggagcagactataacctaagcatatcaaatctagaaagcggagactttggagtatactattgccaacaatatgaatttttcggacaaggaacaaaagtacaagtagacataaaaagaacagtagcagcaccaagcgtattcatatttccaccctcagacgaacaattaaaatcaggaacagcatcagtagtatgcttactaaataacttttacccaagagaagcaaaagtccaatggaaagtcgataacgcactacaaagcggaaattcacaagaaagcgtaacagaacaagatagtaaagactcaacatatagcttaagctcaacattaacattaagcaaagccgattacgaaaaacataaagtatacgcatgcgaagtcacacaccaaggattaagctcaccagtaacaaaatcatttaacagaggagaatgc

SEQ ID NO: 49859 - RNA, 678 nt, synthetic construct
  misc_feature 1..678: note = derived and/or modified sequence opt6 from anti-HIV_3TNN_E-Chain
  source 1..678: mol_type = other RNA
gaagtacaattagtagaatcaggaggaggattagtacaaccaggaggatcactaagactatcctgtgcagcatcaggattcacattctcaacatatgcaatgtcatgggtaagacaagcaccaggaaaaggactagaatgggtatcatcaataaataactcaggaagaaacacattctcagcagactcagtaaaaggaagatttacaatatcaagagacaatagtaaaaacacactatttctagtaatgaactcactaagagcagaagatacagcagtatattactgtgcaaaagacctaagactaggaggaggatcagactattggggacaaggaactttagtaacggtatcatcagcatcaacaaaaggaccaagtgtattcccactagcaccatcttcaaaatcaacctcaggaggaacagcagcactcggatgtctagttaaagattactttccagaaccagtaacagtatcatggaatagtggagcactaacttcaggagtacatacatttccagcagtattacaatcttcaggactatattcattatcatcagtagtaacagtaccatcatcatcactaggaacacaaacatatatatgtaatgtaaaccataaaccatcaaacacaaaagtagataaaagagtagaaccaaaatcatgtgacaaaacacat

SEQ ID NO: 49860 - RNA, 705 nt, synthetic construct
  misc_feature 1..705: note = derived and/or modified sequence opt6 from anti-HIV_3BQU_B-Chain
  source 1..705: mol_type = other RNA
agaataaccctaaaagaatcaggaccacccctagtaaaaccaacacaaacactaacattaacatgcagcttctcaggattctcattatcagacttcggagtaggagtaggatggatacgacaaccaccaggaaaagcactagaatggttagcaataatatattcagatgacgacaaaagatactcaccatcattaaatactagactaacaataacaaaagatacatccaaaaaccaagtagtcctagtaatgaccagagtatcaccagtagacacagcaacatacttctgcgcacacagaagaggaccaacaacattattcggagtaccaatagcaagaggaccagtaaacgcaatggacgtatggggtcaaggaataacagtaacaatatcatcaacatcaacaaaaggaccatcagtattcccactagcaccatcatcaaaatcaacagcaggaggagcagcagcattaggatgcttagtaaaagactacttcccagaaccagtaacagtatcctggaactcaggcgcactaacatccggagtacacacattcccagccgtattacaatcatcaggactatattcactatcaagcgtagtaacagtaccatcatcatcattaggaacacaaacatacacatgcaacgtcaaccacaaaccatcaaacacaaaagtagataaacgcgtagaaccaaaatcatgc

SEQ ID NO: 49861 - RNA, 642 nt, synthetic construct
  misc_feature 1..642: note = derived and/or modified sequence opt6 from anti-HIV_3BQU_A-Chain
  source 1..642: mol_type = other RNA
gcactacaactaacacaatcaccatcatcactatcagcatcagtaggagacagaataacaataacatgccgagcatcacaaggagtaacatcagccctagcatggtacagacaaaaacccggatccccaccacaattattaatatacgacgcatcatcactagaatcaggagtaccaagcagattctcaggttctggatcaggaacagaatttacattaacaatctcaacactaagaccagaagacttcgcaacatactactgtcaacaattacacttctacccacacacattcggaggaggaacaagagtcgacgtaagaagaacagtagcagcaccatcagtattcatattcccaccatcagacgaacaattaaaatcaggaacagcatcagtagtatgcttactcaacaacttctacccaagagaagcaaaagtacaatggaaagtagacaacgccttacaatcaggaaactcacaagaatccgtaacagaacaagactcaaaagactcaacttactcactctcatcaacattaacactatcaaaagcagactacgaaaaacacaaagtatacgaatgcgaagtaacacaccaaggattatcatcaccagtaacaaaatcattcaacagaggcgaatgc

SEQ ID NO: 49862 - RNA, 387 nt, synthetic construct
  misc_feature 1..387: note = derived and/or modified sequence opt6 from anti-HIV_IgG_VR-Chain
  source 1..387: mol_type = other RNA
atggaaacaccagcacaattactatttttattgctattatggttaccagatacaacaggagaaatagtactaacacaatcaccaggaacattatcattaagcgcaggagaaagagcaacattaagctgtagagcaagccaaagcgtaagcagcagatatttagcatggtatcaacaaaaaccaggacaagcaccaagattactaatatacggagcatcaagcagagcaacaggaataccagatagatttagcggaagcggaagtggaacagatttcacactaacaatatcaagagtagaaccagaagatttcgcaggatattactgtcaacaatacgataactcagtatgtacatttggacaaggaacaaaattagaaataaaaaga

SEQ ID NO: 49863 - RNA, 348 nt, synthetic construct
  misc_feature 1..348: note = derived and/or modified sequence opt6 from anti-HIV_IgG_HeavyChain
  source 1..348: mol_type = other RNA
atgaaacacctatggttcttcctactactagtagcagcaccaagatgggtactatcacaagtacaactacaagaatcaggaccaggactagtaaaaccatcagaaacactatcactaacatgcacagtatcaggaggatcaatatcatcacactactggtcatggataagacaatcaccaggaaaaggattacaatggataggatacatatactactcaggatcaacaaactactcaccatcactaaaatcaagagtaacaatatcagtagaaacatcaaaaaaccaattctcactaaaattaacatcaatgacagcagcagacacagcagtatactactgcgcaaga

SEQ ID NO: 49864 - RNA, 714 nt, synthetic construct
  misc_feature 1..714: note = derived and/or modified sequence opt6 from anti-HIV_4P9M_HeavyChain
  source 1..714: mol_type = other RNA
caaatacatctagtacaatcaggaactgaagtaaaaaaaccaggctcatcagtaactgtatcatgcaaagcatatggagttaacacattcggtttatatgcagtaaattgggtaagacaagcaccaggtcaatcactagaatacataggccaaatatggagatggaaatcttcagcttcacatcactttagaggaagagtattaatatcagcagtagatctcacaggatcatcaccaccaataagctcactcgaaataaaaaacttaacatctgatgatacagcagtatatttctgtacaacaacatctacatacgacaaatggtctggattacaccatgacggagtaatggcatttagctcatggggacaaggaacattaatatcagtatcagcagcatcaacaaaaggtccatctgtatttccattagcaccatcatctaaatctacatcaggaggaacagcagcattaggatgtctagtaaaagattactttccagaaccagtaacagtatcatggaactcaggagcactaacatcaggagtacatacatttccagctgtcttacaatcatcaggactatattcattaagctctgtagtaacagtaccatcatcatcactaggcacacaaacatatatatgtaacgtaaaccataaaccctcaaatacaaaagtagataaacgagtagaaccaaaatcatgtgacaaaaca

SEQ ID NO: 49865 - RNA, 645 nt, synthetic construct
  misc_feature 1..645: note = derived and/or modified sequence opt6 from anti-HIV_4P9M_LightChain
  source 1..645: mol_type = other RNA
gacatccaaatgacacaatcaccaagcacactatcagcatcaattggagacacagtaagaatatcatgcagagcatcacaatcaatcacaggaaactgggtagcatggtaccaacaaagaccaggaaaagcacctagactattaatatacagaggcgcagcattattaggaggagtaccaagtagattctcaggatcagcagcaggaaccgacttcacactaacaataggaaacctacaagcagaagacttcggaacattttactgccaacaatacgacacatacccaggaacattcggacaaggaacaaaagtagaagtaaaaagaactgtagcagccccatcagtatttatattcccaccatcagacgaacaactaaaatcaggaacagcatcagtagtatgcctactaaacaacttctacccaagagaagcaaaagtacaatggaaagtcgacaacgcactacaaagcggaaattcacaagaatcagtaacagaacaagactcaaaagactcaacctactcactatcatcaacactaacactatcaaaagcagactacgaaaaacacaaagtatacgcatgcgaagtaacacaccaaggactatcatccccagtaacaaaatcattcaacagaggagaatgt

SEQ ID NO: 49866 - RNA, 558 nt, synthetic construct
  misc_feature 1..558: note = derived and/or modified sequence opt6 from anti-HIV_4P9H_C-Chain
  source 1..558: mol_type = other RNA
aaaaaagtagtactaggaaaaaaaggagacacagtagaattaacatgcaccgcatcacaaaaaaaatcaatacaattccactggaaaaactcaaaccaaataaaaatattaggaaaccaaggatcattcctaaccaaaggaccatcaaaactaaacgacagagcagactcaagacgatcattatgggaccaaggaaacttcccattaataataaaaaacctaacaatagaagactcagacacatacatatgcgaagtagaagatcaaaaagaagaagtacaattactagtattcggattaacagcaaattcagacacacacctactacaaggccaatcactaacactaacactagaatcacctccaggctcatcaccatctgtacaatgcagatcaccaagaggaaaaaacatacaaggaggcaaaacactatcagtatcacaactagaactacaagactcaggaacatggacatgcacagtactacaaaaccaaaaaaaagtagaattcaaaatagacatagtagtcctagcattccaaaaagcaatagatggaaga

SEQ ID NO: 49867 - RNA, 462 nt, synthetic construct
  misc_feature 1..462: note = derived and/or modified sequence opt6 from anti-HIV_4YBL_A-Chain
  source 1..462: mol_type = other RNA
gtaccagtatggaaagacgcagacacaacactattctgcgcatcagacgcaaaagcacacgaaacagaatgccacaacgtatgggcaacacacgcatgcgtaccaacagacccaaacccacaagaaatacacctagaaaacgtcacagaaaacttcaacatgtggaaaaacaacatggtagaacaaatgcaagaagacgtaataagcctatgggaccaatgcctacaaccaggaggagcaccaaaaataagtttcgacccaataccaatacactactgcacaccagcaggatacgtaatactaaaatgcaacgacaaaaacttcaacggaacaggaccatgcaaaaacgtatcatcagtacaatgcacacacggaataaaaccagtagtaagctcaggaggaggaaatataaaagacaactggagatcagaactatacaaatacaaagtagtacaaatagaa

SEQ ID NO: 49868 - RNA, 1056 nt, synthetic construct
  misc_feature 1..1056: note = derived and/or modified sequence opt6 from anti-HIV_4R4N_V-Chain
  source 1..1056: mol_type = other RNA
atatggaaagacgccaatacaacattattctgcgcatcagacgcaaaagcatatgacacagaagtacacaacgtatgggcaacacacgcctgtgtaccaacagacccaagcccacaagaactaaaaatggaaaacgtaacagaagaatttaatatgtggaaaaacaacatggtagaacaaatgcatacagacataataagtttatgggaccaaagcctaaaaccatgcgtacaactcacaggaggaagtgcactaacacaagcatgcccaaaagtaacattcgaaccaataccaatacactactgcgcaccagcaggatacgcaatcctaaaatgtaatgacaaagaatttaacggaacaggcctatgtaagaacgtatcaacagtacaatgcacacacggcatcagacctgtcgtctcaacacaattactactaaatggatcactagcagaaggaaaagtaatgataagatcagaaaacataacaaacaacgtcaaaaacataatagtacaactaaacgaatcagtaacaataaactgcacaagaccaaataacggaggatcaggatcaggaggagacataagacaagcacactgcaacgtaagtgggagtcaatggaacaaaacactacaccaagtagtagaacaactcagaaaatactggaacaataacacaatcattttcaattcaagttccggaggagacctagaaatcacaacacattctttcaactgcggaggagaatttttctactgcaatacatccggattattcaattcaacatgggtaaatggaacagcatcaatagaaaacggaacaataaccttaccatgtagaataaaacaaataataaatatgtggcaaagagtaggacaagcaatatacgcaccaccaatacaaggagtaataagatgcgtctcaaacataacaggattaatactaacaagagacggaggaggaaacagcaacgaaaacgaaacattccgaccaggaggaggagacatgagagacaactggagaagcgaactatacaaatacaaagtagtaaaaattgaa

SEQ ID NO: 49869 - RNA, 1065 nt, synthetic construct
  misc_feature 1..1065: note = derived and/or modified sequence opt6 from anti-HIV_4JKP_G-Chain
  source 1..1065: mol_type = other RNA
gtatggaaagacgcagataccactttattttgtgccagcgacgctaaagcacacgaaacagaatgccacaacgtatgggcaactcacgcatgcgtaccaacagacccaaacccacaagaaatacacttagaaaacgtaaccgaaaacttcaacatgtggaaaaacaacatggtagaacaaatgcaagaagatgtaatctcactatgggatcaatgtttacaaccatgcgtaaaattaacaggaggatcagtaataaaacaagcatgcccaaaaatatcattcgacccaataccaatacactactgcaccccagcaggatacgtaatactaaaatgtaacgataaaaacttcaacggaacagggccctgcaaaaacgtatcaagcgtacaatgcacacacggaatcaaaccagtagtatcaacacaactactattaaacggatcattagcagaagaagaaataataataagatcggaaaacctaaccaataacgcaaaaacaataatagtacatttaaacaaatcagtagaaataaactgcactagaccaagtaacggaggaagcggatcaggcggagacataagaaaagcatactgcgaaataaacggaacaaaatggaacaaagtcctaaaacaagtaacagaaaaactaaaagaacacttcaacaacaaaacaataatattccaaccaccttcaggaggagacctagaaataacaatgcaccacttcaactgtagaggagaatttttctactgcaacaccacacaactattcaacaacacatgcataggaaacgaaaccatgaaaggatgcaacggaacaataacactcccatgtaaaataaaacaaataataaacatgtggcaaggcacaggacaagcaatgtatgcaccacccatcgacggcaaaataaactgcgtaagtaacataacaggaatactactaaccagagatggaggcgcaaacaacacaagtaacgaaacattccgaccaggcggaggaaatatcaaagacaactggagatcagaactatataaatataaagtagtacaaatagaaggtagt

SEQ ID NO: 49870 - RNA, 723 nt, synthetic construct
  misc_feature 1..723: note = derived and/or modified sequence opt6 from anti-HIV_3BQU_D-Chain
  source 1..723: mol_type = other RNA
atgggctggtcatggatatttctattcctactatcaggtacagcaggcgtacactcaggagtacaattacaacaatcaggaccagaactagtaaaaccaggtgcatcagtaaaaatgtcatgtaaagcatctggatactctttcactgactatttcatgcactgggtaaaacaatcacacggaaaatcattagattggataggatacataaattgctataccggagcaacaaactactcacaaaaatttaaaggaaaagcaacatttaccgtagatacctcatcaaatacagcatacatgcaattcaattccctaacatcagaagactcagcagtatattactgcgcaagaacatcaataggatacggttcctcaccaccattcccatactggggacaaggaacactagtaacagtatccgcagcaaaaacaacaccaccatccgtatacccactagcaccaggatcagcagcccaaacaaattcaatggtaacactaggatgcttagtaaaaggatacttcccagaaccagtaacagtcacatggaactcaggctccttatcctcaggagtacacacattccctgcagtattacaatccgatctatatacactatcatcatcagtaacagtaccctcatctccacgaccatccgaaaccgtaacatgcaacgtagcacacccagcatcatctaccaaagtagataaaaaaatagtaccaaga

SEQ ID NO: 49871 - RNA, 699 nt, synthetic construct
  misc_feature 1..699: note = derived and/or modified sequence opt6 from anti-HIV_3BQU_C-Chain
  source 1..699: mol_type = other RNA
atgacaatgttctcattagcactactactatcactactactactatgtgtatcagactcaggagcagaaaccacagtaacacaatcacccgcatcattaagtatgtcaatcggagaaaaagtaaccatacgatgcataacatcaacagacatagacgacgacatgaactggtaccaacaaaaaccaggagaaccaccaagattactcatatcagatggaaacacactaagaccaggagtaccatcaagattctcatcatcaggatacggaacagacttcgtattcacaatagaaaacatgctatccgaagacgtagccgactactattgcttacaatcagacaacctaccatacacattcggcggtggaaccaatctagaaataaaaagagcagatgcagcaccaacagtatcaatatttccaccatcatcagaacaactaacatcaggaggagcctctgtagtctgcttcttaaacaacttctatcctaaagacataaacgtaaaatggaaaatagacggctcagaaagacaaaacggagtactaaactcatggacagaccaagactcaaaagactcaacatactcaatgtcctcaacactaacactaacaaaagacgaatacgaaagacataactcatacacatgcgaagcaacacacaaaacatcaacatcaccaatagtaaaatcattcaacaga

SEQ ID NO: 49872 - RNA, 333 nt, synthetic construct
  misc_feature 1..333: note = derived and/or modified sequence opt6 from anti-HIV_Ig_LightChain
  source 1..333: mol_type = other RNA
gacgtagtactaacacaatcaccagcatcactagcagtatcactaggacaaagagcaacaatatcatgcaaagcatcacaatcagtagactacgacggagactcatacatgaactggtaccaacaaaaaccaggacaaccaccaaaactactaatacacgcagcaagcaacctagtatcaggaatgccagcaagattctcaggatcaggatcaggaacagacttcacactaaacatacacccagtagaagaagaagacgcagcaacatactactgccaacaatcaatagaagacccaccaacattcggaggaggaacaaaactagaaataaaa

SEQ ID NO: 49873 - RNA, 342 nt, synthetic construct
  misc_feature 1..342: note = derived and/or modified sequence opt6 from anti-HIV_Ig_HeavyChain
  source 1..342: mol_type = other RNA
gacgtacaactacaacaatcaggaccaggactagtaaaaccatcacaatcactatcacacacatgcacagtaacaggatactcaataacatcagactacgcatggaactggataagacaattcccaggaaacaaactagaatggatgggatacatatcattctccggatcaacatcatacaacccatcactaaaatcaagaatatcaataacaagagacacatcaaaaaacctattcttcctacaactaaactcagtaacaacagaagacacagcaacatactactgcgcaagaggactaccagactactggggacaaggaacaacactaacagtatcatca

SEQ ID NO: 49874 - RNA, 1083 nt, synthetic construct
  misc_feature 1..1083: note = derived and/or modified sequence opt6 from anti-HIV_4P9H_G-Chain
  source 1..1083: mol_type = other RNA
gtatggaaagatgcagacacaacattattttgtgcatcagacgcaaaagcacacgaaacagaatgccataacgtatgggcaacacacgcctgcgtaccaacagacccaaacccacaagaaatacatctagaacaagtcacagaaaacttcaacatgtggaaaaataacatggtagaacaaatgcaagaagacgtaatatctctatgggaccaatgcctacaaccctgcgtaaaattaacaggaggaagtgtaataaaacaagcctgcccaaaaatcagcttcgatcccatccccatccactactgtacaccagcaggatacgtaatactaaaatgcaacgacaaaaatttcaacggaactggaccatgcaaaaatgtaagcagcgtacaatgcacacacggaataaaaccagtagtatcaacacaactactactcaacggaagccttgcagaagaagaaataataataagatcagaaaatctaacaaacaatgcaaaaacaataatagtacacctacaaaaatccgtcgaaatcaactgtacaagaccaagcaacggaggatcaggttcaggaggagacatcagaaaagcatactgtgaaatacaaggaactaaatggaataaagtattaaaacaagtaacagaaaaattaaaagaacacttcaataacaaaactatcatatttcaaccaccatcaggaggagacttagaaataacaatgcaccactttaactgtagaggagaatttttctactgcaacacaacacaactattccaaaatacctgcataggaaacgaaacaatgaaaggatgcaatggaacaataacattaccctgtaaaataaaacaaataataaacatgtggcaaggaaccggacaagcaatgtatgcaccaccaatagacggaaaaataaactgtgtatcacaaataacaggaatactactaaccagagacggcggagctaataacacatcaaacgaaacattcagaccaggaggcggaaacataaaagacaactggagatcagaactatacaaatacaaggttgtacaaatagaaggatcacaccaccaccaccaccac

SEQ ID NO: 49875 - RNA, 147 nt, synthetic construct
  misc_feature 1..147: note = derived and/or modified sequence opt6 from anti-HIV_Chain
  source 1..147: mol_type = other RNA
caagtacaattagtacaaagcggaggacaaatgaaaaaaccaggagaaagcatgagaataagctgtagagcaagcggatacgaattcatagactgtacattaaactggataagactagcaccaggaaaaagaccagaatggatggga

SEQ ID NO: 49876 - RNA, 180 nt, synthetic construct
  misc_feature 1..180: note = derived and/or modified sequence opt6 from anti-HIV_Chain
  source 1..180: mol_type = other RNA
ccatgctgctttgcatatatagcaagaccactaccaagagcacacataaaagaatacttttacacaagcggaaaatgcagcaatccagcagtagtattcgtaacaagaaaaaacagacaagtatgtgcaaatccagaaaaaaaatgggtaagagaatacataaactcactagaaatgtca

SEQ ID NO: 49877 - RNA, 249 nt, synthetic construct
  misc_feature 1..249: note = derived and/or modified sequence opt6 from anti-HIV_Chain
  source 1..249: mol_type = other RNA
ctagaatggatgggaagaataataccagcaatagatgacgtaacatatgcacaaacatttagaggaagagtaacatttagcgcagacaaattcacaacaacagcatatatggatctaacaggattaagatcagaagatacagcaacatatttctgtgcaagagacccacaagtaaacagaagaggaaactgtttcgatcactggggacaaggaacattagtaacagtaagctcagcatcaacaaaagga

SEQ ID NO: 49878 - RNA, 270 nt, synthetic construct
  misc_feature 1..270: note = derived and/or modified sequence opt6 from anti-HIV_Chain
  source 1..270: mol_type = other RNA
gatgtagtaatgacacaatcaccattatcattaccagtaacattaggacaaccagcaagcataagctgtagaagcagccaatcattagtatatagccatggagatacatatctaaaatgctttcaacaaagaccaggacaaagcccaagaagaccaatatacaaagtaagcaacagagactcaggagtaccagatagatttagcggaagcggaagcggaacagatttcacactaaaaatatcaagagtagaagcagaagatgtaggagta

SEQ ID NO: 49879 - RNA, 294 nt, synthetic construct
  misc_feature 1..294: note = derived and/or modified sequence opt6 from anti-HIV_Chain
  source 1..294: mol_type = other RNA
agttcatttgcaatatcatgggtaagacaagcaccaggacaaggactagaatggatgggaggaataataccaatattcgaagcaacatcatatgcacaaaaatttcaagatagactaacaataacaacagacgaaagcacaacaacagcatatatggatctaagttcattaagaagtgaagatacagcagtatattactgtgcaagagcacaaggagatatattaacagaaggatatttcgattactggggacaaggaacattagtaacagtatcaagtgcaagcacaaaagga

SEQ ID NO: 49880 - RNA, 297 nt, synthetic construct
  misc_feature 1..297: note = derived and/or modified sequence opt6 from anti-HIV_Chain
  source 1..297: mol_type = other RNA
aatacattcacaagtcactacgtacactgggtaagacaagcaccaggacaaggactagaatggatgggaatgataaacccaggaggaacaacaagatacgcaccaaaatttcaagacagagtaacactaacaagagacacatcaacaagaacagtatacatggaactaagatcactaagaagtgaagacacagcagtatactactgcgcaagaccacaatacaacctaggaagagaaccactaaacgtatggggacaaggaacaatggtaacagtaagttcagcatcaacaaaagga

SEQ ID NO: 49881 - RNA, 297 nt, synthetic construct
  misc_feature 1..297: note = derived and/or modified sequence opt6 from anti-HIV_Chain
  source 1..297: mol_type = other RNA
ataagatcattctattggcattggataagacaaagcccaggaaaaggattagaatggctaggaagcgtattcgataacggactaacaacacataacccaagcctaaaatcaagattaacaataagtgaagacccaagcagaaaccaaatatcactaaaactaagaagcatgacagcagcagatacagcagtatattactgtgcaagaggagattacgatatactaacatcaagctatcaatttgactattggggacaaggaacattagtagcagtatcaagcgcaagcacaaaagga

SEQ ID NO: 49882 - RNA, 300 nt, synthetic construct
  misc_feature 1..300: note = derived and/or modified sequence opt6 from anti-HIV_Chain
  source 1..300: mol_type = other RNA
caatcagcactaacacaaccagcattcgtatcaggatcaccaggacaatcaataacactatcatgcacactaggaacagaagacgtatcatggtaccaacaaagaccaaactcagcaccaagactcataatattcgacgtaaaaaaaagaccatcagacgtatcagacagattctcaggacacaactcagacacagcagcattcctaacaatatcagaactaagaccagaagacgaagcagactacttctgcacatcatggccatacagattcgacagaggaacaaaagtagacgtagca

SEQ ID NO: 49883 - RNA, 300 nt, synthetic construct
  misc_feature 1..300: note = derived and/or modified sequence opt6 from anti-HIV_Chain
  source 1..300: mol_type = other RNA
caatcagcactaacacaaccagcattcgtatcaggatcaccaggacaatcaataacactatcatgcacactaggaacagaagacgtatcatggtaccaacaaagaccaaactcagcaccaagactaataatattcgacgtaaaaaaaagaccatcagacgtatcagacagattctcaggacacaactcagacacagcagcattcctaacaatatcagaattaagaccagaagacgaagcagaatacttctgcacatcatggccatacagattcggaagaggaacaaaagtagacgtagca

SEQ ID NO: 49884 - RNA, 300 nt, synthetic construct
  misc_feature 1..300: note = derived and/or modified sequence opt6 from anti-HIV_Chain
  source 1..300: mol_type = other RNA
caatcagcactaacacacccagcattcgtatcaggatcaccaggacaatcaataacactatcatgcacactaggaacagaagacgtatcatggtaccaacaaagaccaaactcagcaccaagactaataatattcgacgtaagaaaaagaccatcagaagtatcagacagattctcaggacacaaatcagacacagcagcattcctaacaatatcagacctaagaccagaagacgaagcagaatacttctgcacatcatggccatacagattcgacagaggaacaagactagacgtagca

SEQ ID NO: 49885 - RNA, 300 nt, synthetic construct
  misc_feature 1..300: note = derived and/or modified sequence opt6 from anti-HIV_Chain
  source 1..300: mol_type = other RNA
caatcagtattaacacaaccagcattcgtatcaggatcaccaggacaatcaataacaatatcatgtacagtaggaacaacagatgtatcatggtatcaacaaagaccaaactcagcaccaagactaataatattcgatgtaaaaaaaagaccaagtggagtatcagacagattttcaggatcatcatcagataacgcagcatttctaacaatagcaggattaagaccagaagatgaagcagaatattactgtacatcatggccatacagattcggaagaggaacaaaagtagatgtagga

SEQ ID NO: 49886 - RNA, 300 nt, synthetic construct
  misc_feature 1..300: note = derived and/or modified sequence opt6 from anti-HIV_Chain
  source 1..300: mol_type = other RNA
caatcagtactaacacaaccagcattcgtatcagcatcaccaggacaatcaataacactatcatgcaacctaggaacagactacgtatcatggtaccaacaaagaccatcatcagcaccaagactaataatattcgacgtaaaaaacagaccatcaggagtatcagacagattctcaggatacaactcagacacagcagcattcctaacaatatcaggattacaaccagaagacgaagcagaatactactgcacatcatggccatacaacttcggaccaggaacaaaagtagacgtaaca

SEQ ID NO: 49887 - RNA, 300 nt, synthetic construct
  misc_feature 1..300: note = derived and/or modified sequence opt6 from anti-HIV_Chain
  source 1..300: mol_type = other RNA
caatcagtactaacacaaccagcatcagtatcaggatcaccaggacaatcaataaacatatcatgcgcaggaagatcagacagagtatcatggtaccaacaaagaccaaacggagtaccaaaactactactattcgacgtatacagaagaccatcaggagtatcagacagattctcaggatcacactcagacgacacagcattcctaacaatatcaggactacaaacagacgacgaagcagactactactgcacatcacacccatacgcattcggaccaggaacaaaagtaaacgtacta

SEQ ID NO: 49888 - RNA, 300 nt, synthetic construct
  misc_feature 1..300: note = derived and/or modified sequence opt6 from anti-HIV_Chain
  source 1..300: mol_type = other RNA
caatcagtactaacacaaccagcattcgtatcaggatcaccaggacaatcaataacactatcatgcacactaggaacagaagacgtatcatggtaccaacaaagaccaaactcagcaccaagactaataatattcgacgtaaaaaaaagaccatcagacgtatcagacagattctcaggacacaactcagacacagcagcattcctaacaatatcagaactaagaccagaagacgaagcagaatacttctgcacatcatggccatacagattcggaagaggaacaaaagtagacgtagca

SEQ ID NO: 49889 - RNA, 306 nt, synthetic construct
  misc_feature 1..306: note = derived and/or modified sequence opt6 from anti-HIV_Chain
  source 1..306: mol_type = other RNA
caaagcgcactaacacaaccagcaagcgtatcaggatcaccaggacaatcaataacaatatcatgcacagcagatagcgattacgtaagctggtaccaacaaagaccaaatagcgcaccaaaattaatactatttgacgtaaactcaagaccaagcggagtatcagacagatactcaggatcaagatcaggaaatacagcatcattaacaataagcggactacaaagagaagacgaagcagattacttttgcacaccatggccatatgactttagaccaggaacaagagtattcgtactaggacaa

SEQ ID NO: 49890 - RNA, 306 nt, synthetic construct
  misc_feature 1..306: note = derived and/or modified sequence opt6 from anti-HIV_Chain
  source 1..306: mol_type = other RNA
caatcagcactaacacaaccagcattcgtatcaggatcaccaggacaatcaataacactatcatgctcactaggaacagcagacgtatcatggtaccaacaaagaccaaactcagcaccaagactaataatattcgacgtaaaaaaaagaccatcagacgtatcagacagattctcaggacacaactcagacacagcagcattcgtaacaatatcagaactaagaccagaagacgaagcagaatacttctgcacatcatggccatacagattcggaccaggaacaaaagtagacgtagcaagacaa

SEQ ID NO: 49891 - RNA, 306 nt, synthetic construct
  misc_feature 1..306: note = derived and/or modified sequence opt6 from anti-HIV_Chain
  source 1..306: mol_type = other RNA
caatcagtactaacacaaccagcatcagtatcaggatcaccaggacaaacaatatcaatatcatgctcaggaacattcggatcagactcagtatcatggtaccaacaattcccaaactcagcaccaacactaataatattcgacgtacacagaagaccatcaggaatatcaacaagattctcaggatccacatcaggagacacagcatcactaacaatatcaacactacacagagaagacgaagcattctactactgcacatcacacccatacgacttcggaggaggaacatacgtaatagtacta

SEQ ID NO: 49892 - RNA, 306 nt, synthetic construct
  misc_feature 1..306: note = derived and/or modified sequence opt6 from anti-HIV_Chain
  source 1..306: mol_type = other RNA
caatcagtactaacacaaccagcatcagtatcaggatcaccaggacaaacaatatcaatatcatgctcaggaacattcggatcagactcagtatcatggtaccaacaatacccaaactcagcaccaacactaataatattcgacgtacacagaagaccatcaggaatatcaacaagattctcaggatcaacatcaggagacacagcatcactaacaatatcaacactacacagagaagacgaagcatactactactgcacatcacacccatacgacttcggaggaggaacatacgtaatagtacta

SEQ ID NO: 49893 - RNA, 306 nt, synthetic construct
  misc_feature 1..306: note = derived and/or modified sequence opt6 from anti-HIV_Chain
  source 1..306: mol_type = other RNA
caatcagcactaacacaaccagcatcagtatcaggatcaccaggacaatcaataaacatatcatgcgcaggaagatcagacagagtatcatggtaccaacaaagaccaaacggagtaccaaaactactaatgttcgacgtatacagaagaccatcaggagtatcagacagattctcaggatcacactcaggagacacagcattcctaacaatatcaggactacaaacagaagacgaagcagactactactgcacaagccacccatacgcattcggagcaggaacaaaagtaaacgtactaagacaa

SEQ ID NO: 49894 - RNA, 306 nt, synthetic construct
  misc_feature 1..306: note = derived and/or modified sequence opt6 from anti-HIV_Chain
  source 1..306: mol_type = other RNA
gacatacaaatgacacaatcaccatcatcattatcagcatcagtaggagacagagtatcaatacactgtcaagcaggacaaggaataggatcatcattaaactggtaccaacaaaaaccaggaagagcaccaagactattagtacacggagcatcaaatctacaaagaggagtaccatcaagattctcaggatcaggatttcacacaacatttacactaacaatatcatcactacaaccagacgacgtagcaacatactggtgcgcagcattagaatttttcggaccaggaacaaaagtagaaata

SEQ ID NO: 49895 - RNA, 309 nt, synthetic construct
  misc_feature 1..309: note = derived and/or modified sequence opt6 from anti-HIV_Chain
  source 1..309: mol_type = other RNA
gacatacaaatgacacaatcaccatcatcactatcagcatcagtaggagacacagtaacaataacatgccaagcaaacggatacctaaactggtaccaacaaagaagaggaaaagcaccaaaactactaatatacgacggatcaaaactagaaagaggagtaccatcaagattctcaggaagaagatggggacaagaatacaacctaacaataaacaacctacaaccagaagacatagcaacatacttctgccaagtatacgaattcgtagtaccaggaacaagactagacctaaaaagaacagtagca

SEQ ID NO: 49896 - RNA, 309 nt, synthetic construct
  misc_feature 1..309: note = derived and/or modified sequence opt6 from anti-HIV_Chain
  source 1..309: mol_type = other RNA
gacatacaaatgacacaatcaccatcatcactatcagcaagagtaggagacacagtaacaataacatgccaagcaaacggatacctaaactggtaccaacaaagaagaggaaaagcaccaaaactactaatatacgacggatcaaaactagaaagaggagtaccagcaagattctcaggaagaagatggggacaagaatacaacttaacaataaacaacctacaaccagaagacgtagcaacatacttctgccaagtatacgaattcatagtaccaggaacaagactagacctaaaaagaacagtagca

SEQ ID NO: 49897 - RNA, 309 nt, synthetic construct
  misc_feature 1..309: note = derived and/or modified sequence opt6 from anti-HIV_Chain
  source 1..309: mol_type = other RNA
gacatacaaatgacacaatcaccatcatcactatcagcaagagtaggagacacagtaacaataacatgccaagcaaacggatacctaaactggtaccaacaaagaagaggaaaagcaccaaaactattaatatacgacggaagcaaactagaaagaggagtaccaagcagattctcaggaagaagatggggacaagaatacaacctaacaataaacaacctacaaccagaagacatagcaacatacttctgccaagtatacgaattcgcagtaccaggaacaagactagacctaaaaagaacagtagca

SEQ ID NO: 49898 - RNA, 309 nt, synthetic construct
  misc_feature 1..309: note = derived and/or modified sequence opt6 from anti-HIV_Chain
  source 1..309: mol_type = other RNA
gacatacaaatgacacaatcaccatcatcactatcagcatcagtaggagacacagtaacaataacatgccaagcaaacggatacctaaactggtaccaacaaagaagaggaaaagcaccaaaactactaatatacgatggatcaaaactagaaagaggagtaccatcaagattctcaggaagaagatggggacaagaatacaacctaacaataaacaacctacaagcagaagacatagcaacatacttctgccaagtatacgaattcgcagtaccaggaacaagactagacctaaaaagaacagtagca

SEQ ID NO: 49899 - RNA, 309 nt, synthetic construct
  misc_feature 1..309: note = derived and/or modified sequence opt6 from anti-HIV_Chain
  source 1..309: mol_type = other RNA
gacatacaaatgacacaatcaccatcatcactatcagcatcagtaggagacacagtaacaataacatgccaagcaaacggatacctaaactggtaccaacaaagaagaggaaaagcaccaaaactactaatatacgacggatcaaaactagaaagaggagtaccatcaagattctcaggaagaagatggggacaagaatacaacctaacaataaacaacctacaaccagaagacatagcaacatacttctgccaagtatacgaattcatagtaccaggaacaagactagacctaaaaagaacagtagca

SEQ ID NO: 49900 - RNA, 309 nt, synthetic construct
  misc_feature 1..309: note = derived and/or modified sequence opt6 from anti-HIV_Chain
  source 1..309: mol_type = other RNA
gacatacaaatgacacaatcaccatcatcactatcagcaagagtaggagacacagtaacaataacatgccaagcaaacggatacctaaactggtaccaacaaagaagaggaaaagcaccaaaactactaatatacgacggatcaaaactagaaacaggagtaccatcaagattcacaggaagaagatggggacaagaatacaacctaacaataaacaacctacaaccagaagacatagcaacatacttctgccaagtatacgaattcatcgtaccaggaacaagactagacctaaaaagaacagtagca

SEQ ID NO: 49901 - RNA, 312 nt, synthetic construct
  misc_feature 1..312: note = derived and/or modified sequence opt6 from anti-HIV_Chain
  source 1..312: mol_type = other RNA
gatatacaaatgacacaatcaccatcaagcttaagcgcaagcgtaggagataaagtaacaataacatgtcaaacaagcgcaggatatctaaattggtatcaacaaagaagaggaagagcaccaaaattactaatgtacgatggatcaagattagtaacaggagtaccatcaagatttagcggaagaagatggggaacacaatacaatctaacaataggaagcttacaaccagaagatgtagcaacatattactgtcaagtatacgaattctttggaccaggaacaagattagacttaaaaagaacagtagca

SEQ ID NO: 49902 - RNA, 312 nt, synthetic construct
  misc_feature 1..312: note = derived and/or modified sequence opt6 from anti-HIV_Chain
  source 1..312: mol_type = other RNA
gatatacaaatgacacaatcaccatcaagcttaagcgcaagcgtaggagataaagtaacaataacatgtcaaacaagcgcaggatatctaaattggtatcaacaaagaagaggaagagcaccaaaattactaatgtacgatggatcaagattagtaacaggagtaccatcaagatttagcggaagaagatggggaacacaatacaatttaacaataggaagcttacaaccagaagatatagcaacatattactgtcaagtatacgaattctttggaccaggaacaagattagacttaaaatcaacagtagca

SEQ ID NO: 49903 - RNA, 312 nt, synthetic construct
  misc_feature 1..312: note = derived and/or modified sequence opt6 from anti-HIV_Chain
  source 1..312: mol_type = other RNA
gacatacaaatgacacaatcaccatcaagcctaagcgcaagagtaggagacacagtaacaataacatgccaagcaaacggatacctaaactggtaccaacaaagaagaggaaaagcaccaaaactactaatatatgacggaagcaaactagaaagaggagtaccagcaagattctcaggaagaagatggggacaagaatacaacctaacaataaacaacctacaaccagaagacgtagcaacatacttctgccaagtatacgaatttatagtaccaggaacaagactagacttaaaaagaacagtagcagca

SEQ ID NO: 49904 - RNA, 312 nt, synthetic construct
  misc_feature 1..312: note = derived and/or modified sequence opt6 from anti-HIV_Chain
  source 1..312: mol_type = other RNA
tgcacagtatcaggaggaagcataatatcatactattggaattggataagacaaagcccaggaaaaggattagaatggctaggatacatattcgatggaggaagagcaaactataacccaagcttaagatcaagattaacaatgagcgtagacacaagcaaaaaccaaatatcactaaaagtaaaaagcgtaacagcagcagatagcgcaatatattactgtgcaagactagatggagaagcatttagatattactttgactcatggggacaaggaacattagtaacagtatcaagcgcaagcacaaaagga

SEQ ID NO: 49905 - RNA, 312 nt, synthetic construct
  misc_feature 1..312: note = derived and/or modified sequence opt6 from anti-HIV_Chain
  source 1..312: mol_type = other RNA
gtaagcggaggaagattctcaaactatggattaagctgggtaagacaagcaccaggacaaggactagaatggatgggaagaatagtaccagcaataaatagagcaaaatatgcacaaaaatttcaaggaagagtaatattaacagcagacaaaataacagacacagcatatatggaactaagatcattaagaagcgaagatacagcaatattttactgtgcaagagacccacaaatagaaataagaggaaacgcattcgatatatggggacaaggaacagtagtaacagtaagttcagcatcaacaaaagga

SEQ ID NO: 49906 - RNA, 315 nt, synthetic construct
  misc_feature 1..315: note = derived and/or modified sequence opt6 from anti-HIV_Chain
  source 1..315: mol_type = other RNA
tcagatatatcagtagcaccaggagaaacagcaagaatatcatgcggagaaaaatcattaggatcaagagcagtacaatggtatcaacatagagcaggacaagcaccatcattaataatatacaataaccaagacagaccatcaggaataccagaaagattttcaggatcaccagactcaccatttggaacaacagcaacattaacaataacatcagtagaagcaggagacgaagcagattactattgccatatatgggactcaagagtaccaacaaaatgggtattcggaggaggaacaacactaacagtacta

SEQ ID NO: 49907 - RNA, 315 nt, synthetic construct
  misc_feature 1..315: note = derived and/or modified sequence opt6 from anti-HIV_Chain
  source 1..315: mol_type = other RNA
tcatcaatgtcagtatcaccaggagaaacagcaaaaatatcatgcggaaaagaatcaataggatcaagagcagtacaatggtatcaacaaaaatcaggacaaccaccatcattaataatatacaataaccaagacagaccatcaggagtaccagaaagattttcagcaacaccagacttcggagcaggaacaacagcaacattaacaattacaaatgtagaagcagatgacgaagcagattactactgccatatatatgacgcaagaggaggaacaaactgggtatttgacagaggagcaacattaacagtacta

SEQ ID NO: 49908 - RNA, 315 nt, synthetic construct
  misc_feature 1..315: note = derived and/or modified sequence opt6 from anti-HIV_Chain
  source 1..315: mol_type = other RNA
tcatttgtaagcgtagcaccaggacaaacagcaagaataacatgcggagaagaatcattaggatcaagatcagtaatatggtaccaacaaagaccaggacaagcaccatcactaataatatacaacaacaatgacagaccatcaggaataccagaaagattctcaggatcaccaggatcaacattcggaacaacagcaacactaacaataacatcagtagaagcaggagacgaagcagactactactgccacatatgggactcaagaagaccaacaaactgggtattcggagaaggaacaacactaacagtacta

SEQ ID NO: 49909 - RNA, 315 nt, synthetic construct
  misc_feature 1..315: note = derived and/or modified sequence opt6 from anti-HIV_Chain
  source 1..315: mol_type = other RNA
tcatttgtaagtgtagcaccaggacaaacagcaagaataacatgtggagaagaatcattaggaagtagaagtgtaatatggtatcaacaaagaccaggacaagcaccatcattaataatgtataataatcatgacagaccaagcggaataccagaaagattttcaggatcaccaggaagtacattcggaacaacagcaacattaacaataacaagtgtagaagcaggagatgaagcagactattactgtcatatatgggatagtagaagaccaacaaattgggtattcggagaaggaacaacattaacagtatta

SEQ ID NO: 49910 - RNA, 315 nt, synthetic construct
  misc_feature 1..315: note = derived and/or modified sequence opt6 from anti-HIV_Chain
  source 1..315: mol_type = other RNA
gatatacaaatgacacaatcaccatcaagcttaagcgcaagcgtaggagataaagtaacaataacatgtcaaacaagcgcaggatatctaaattggtatcaacaaagaagaggaagagcaccaaaattactaatgtacgatggatcaagattagtaacaggagtaccatcaagatttagcggaagaagatggggaacacaatacaatctaacaataggaagcttacaaccagaagatatagcaacatattactgtcaagtatacgaattctttggaccaggaacaagactagacttaaaatcaacagtagcagca

SEQ ID NO: 49911 - RNA, 315 nt, synthetic construct
  misc_feature 1..315: note = derived and/or modified sequence opt6 from anti-HIV_Chain
  source 1..315: mol_type = other RNA
gatatacaaatgacacaatcaccatcaagcttaagcgcaagcgtaggagatagagtaagcataaactgtcaagcaggacaaggattaggatcaagcttaaactggtaccaacaaaaaccaggaagagcaccaaaactattagtacatggagcaagcaatctacaaagaggagtaccaagcagattctcaggatcaggatttcacacaacatttacattaacaataagctcactacaaccagatgacgtagcaacatacttttgcgcagcatttcaatggttcggaccaggaacaaaagtagaaataaaaagaaca

SEQ ID NO: 49912 - RNA, 318 nt, synthetic construct
  misc_feature 1..318: note = derived and/or modified sequence opt6 from anti-HIV_Chain
  source 1..318: mol_type = other RNA
tgcacagtaagcggaggatcaatatcatcagcaggatactactggacatggataagacaacacccaggaaaaggactagaattcataggatacatatactacataggaacaacatactacaacccatcactaaaatcaagactaacaatatcaatagacacatcaaaaaaccaattctcactaaaactatcatcagtaacagcagcagacacagcaatatactactgcgcaagagactacacagcaagaggaagacacttcttcgactactggggacaaggagcactagtaacagtatcatcagcatcaacaaaagga

SEQ ID NO: 49913 - RNA, 321 nt, synthetic construct
  misc_feature 1..321: note = derived and/or modified sequence opt6 from anti-HIV_Chain
  source 1..321: mol_type = other RNA
tcatcactaccactatcactagcaccaggagcaacagcaaaaataccatgcggagaaaaatcaagaggatcaagagcagtacaatggtaccaacaaaaaccaggacaagcaccaacactaataatatacaacaaccaagacagaccagcaggagtatcagaaagatactcaggaaacccagacgtagcaataggagtaacagcaacactaacaatatcaagagtagaagcaggagacgaagcagaatactactgccactactgggactcaagatcaccaatatcatgggtattcggaggatggacacaactaacagtacta

SEQ ID NO: 49914 - RNA, 321 nt, synthetic construct
  misc_feature 1..321: note = derived and/or modified sequence opt6 from anti-HIV_Chain
  source 1..321: mol_type = other RNA
agctcattaccattaagtgtagcaccaggagcaacagcaaaaatagcatgtggagaaaaatcatttgcaagcagagcagtacaatggtatcaacaaaaaccaggacaagcaccagtattaataatatataataatcaagatagaccagcaggagtatcagaaagattttcaggaacaccagatgtaggatttggaagtacagcaacactaacaatatcaagagtagaagcaggagatgaagcagattattactgtcataaatgggatagtagaagtccattatcatgggtatttggaggaggaacacaattaacagtatta

SEQ ID NO: 49915 - RNA, 321 nt, synthetic construct
  misc_feature 1..321: note = derived and/or modified sequence opt6 from anti-HIV_Chain
  source 1..321: mol_type = other RNA
gacatacaaatgacacaatcaccatcatcattatcagcatcaataggagacagagtaacaataacatgcagagcatcacaagacatagcaaactacctaaactggtaccaaaaaaaatcaggaacaccaccaaaactactaatattcgcagcaacaaacctacaccgaggagtatcaccaagattcacaggatcaggacacggaacacacttctcactaacaataacaaacgtacaacacgaagacttcggaaactacttctgccaacaatcattcgcaacagtaggatcattcggacaaggaacatgggtagacatacga

SEQ ID NO: 49916 - RNA, 321 nt, synthetic construct
  misc_feature 1..321: note = derived and/or modified sequence opt6 from anti-HIV_Chain
  source 1..321: mol_type = other RNA
gacatacaaatgacacaatcaccatcatcactatcagcatcaataggagacagagtaacaataacatgcagagcctcacaagacatagcaaactacctaaactggtaccaaaaaaaatcaggaacaccaccaaaactactaatattcgcagcaacaaacctacacagaggagtatcaccaagattcacaggatcaggacacggaacacacttctcactaacaataacaaacgtacaacacgaagacttcggacactacttctgccaacaatcattcgcaacagtaggatcattcggacaaggaacatgggtagacataaga

SEQ ID NO: 49917 - RNA, 321 nt, synthetic construct
  misc_feature 1..321: note = derived and/or modified sequence opt6 from anti-HIV_Chain
  source 1..321: mol_type = other RNA
gacatacaaatgacacaatcaccatcatcactatcagcatcagtaggagacagagtaacaataacatgcagagcatcacaagacatagcaaactacctaaactggtaccaaaaaaaatcaggaacaccaccaaaactactaatattcgcagcaacaaacctacacagaggagtatcaccaagattctcaggatcaggatcaggaacacacttctcactaacaataacaaacgtacaatacgaagacttcgcaaactacttctgccaacactcattcggaacaataggaacattcggacaaggaacatgggtagacataaga

SEQ ID NO: 49918 - RNA, 321 nt, synthetic construct
  misc_feature 1..321: note = derived and/or modified sequence opt6 from anti-HIV_Chain
  source 1..321: mol_type = other RNA
gacatacaaatgacacaatcaccatcatcactatcagcatcaataggagacagagtaacaataacatgcagagcatcacaagacatagcaaactacctaaactggtaccaaaaaaaatcaggaacaccaccaaaactactaatattcggagcaacaaacctacaccacggagtatcaccaagattctcaggatcaggacacggaacacacttctcattaacaataacaaacgtacaacacgaagacttcgcaaactacttctgccaacaatcattccaaacagtaggatcattcggacaaggaacatgggtagacataaga

SEQ ID NO: 49919 - RNA, 321 nt, synthetic construct
  misc_feature 1..321: note = derived and/or modified sequence opt6 from anti-HIV_Chain
  source 1..321: mol_type = other RNA
gaaatagtactaacacaatcaccagcaacattaagtttaagcccaggagaaacagcaataataagctgtagaacaagccaaagcggaagcctagcatggtaccaacaaagaccaggacaagcaccaagattagtaatatatagcggaagcacaagagcagcaggaataccagacagattctcaggatcaagatggggagcagactataacttaagcataagtaatctagaaagcggagactttggagtatactattgccaacaatatgaatttttcggacaaggaacaaaagtacaagtagatataaaaagaacagtagca

SEQ ID NO: 49920 - RNA, 321 nt, synthetic construct
  misc_feature 1..321: note = derived and/or modified sequence opt6 from anti-HIV_Chain
  source 1..321: mol_type = other RNA
gacatacaaatgacacaatcaccatcatcactatcagcatcaataggagacagagtaaacataacatgccaagcatcaagagacacaggatcagcactaaactggtaccaacaaaaagtaggaagaccaccaagactactaatatcagcagtatcaaacttaggagcaggagtaccatcaagattctcaggaagaagatcaggaacacaaagcacactaacaataaacacactacaaccagaagacatagcaacatacttctgccaacactacgaattcttcggaccaggaacaaaagtagacataaaaagaacagtagca

SEQ ID NO: 49921 - RNA, 321 nt, synthetic construct
  misc_feature 1..321: note = derived and/or modified sequence opt6 from anti-HIV_Chain
  source 1..321: mol_type = other RNA
gatatacaaatgacacaatcaccatcatcattaagcgcaagcgtaggagatagagtaacaataacatgtcaagcaggacaaggaataggaagcagcttacaatggtaccaacaaaaaccaggaaaagcaccaaaactattagtacatggagcaagcaatctacatagaggagtaccaagcagattctcaggatcaggatttcacacaacatttagcttaacaataagcggactacaaagagatgactttgcaacatacttttgcgcagtattagaatttttcggaccaggaacaaaagtagaaataaaaagaacagtagca

SEQ ID NO: 49922 - RNA, 324 nt, synthetic construct
  misc_feature 1..324: note = derived and/or modified sequence opt6 from anti-HIV_Chain
  source 1..324: mol_type = other RNA
agctatgtaagaccattaagtgtagcattaggagaaacagcaagtataagttgtggaagacaagcattaggaagtagagcagtacaatggtatcaacatagaccaggacaagcaccaatattattaatatataataatcaagatagaccaagtggaataccagaaaggttttcaggaacaccagatataaattttggaacaagagcaacactaacaatatcaggagtagaagcaggagatgaagcagattattattgtcatatgtgggatagtagaagtggattttcatggagttttggaggagcaacaagattaacagtacta

SEQ ID NO: 49923 - RNA, 324 nt, synthetic construct
  misc_feature 1..324: note = derived and/or modified sequence opt6 from anti-HIV_LightChain
  source 1..324: mol_type = other RNA
gacatactaatgacacaatcaccatcactactatccgcatcagtaggagacagagtaacaataacatgcaaagcatcacaagacgtatcaacagcagtagcatggtaccaacaaaaaccaggaaaagcaccaaaactactaatatactgggcatcaacaagacatacaggagtaccatcaagattcacaggatcaggatcaggaacagacttcacactaacaatatcaagactacaagcagaagacttcgcactatactactgccaacaacactacacaacaccatggacattcggaggaggaacaaaagtagaaataaaaaga

SEQ ID NO: 49924 - RNA, 324 nt, synthetic construct
  misc_feature 1..324: note = derived and/or modified sequence opt6 from anti-HIV_LightChain
  source 1..324: mol_type = other RNA
gacatagtaatgacacaatcaccatcactactatcagcatcagtaggagacagagtaacaataacatgcaaagcatcacaagacgtatcaacagcagtagcatggtaccaacaaaaaccaggaaaagcaccaaaactactaatatactgggcatcaacaagacacacaggagtaccatcaagattctcaggatcaggatcaggaacagacttcacactaacaatatcatcactacaaccagaagacttcgcactatactactgccaacaacactacacaacaccatggacattcggaggaggaacaaaagtagaaataaaaaga

SEQ ID NO: 49925 - RNA, 324 nt, synthetic construct
  misc_feature 1..324: note = derived and/or modified sequence opt6 from anti-HIV_Chain
  source 1..324: mol_type = other RNA
gacatacaaatgacacaatcaccatcatcactatcagcatcagtaggagacacagtaacaataaactgccaaacaaacaaaggatacctaaactggtaccaacaaagaagaggaagagcaccaaaactattaatgtacgacggatcaaaactagtaacaggagtaccatcaagattctcaggaagaagatggggaacacaatacaacctaacaataggatcactacaaccagaagacatagcaacatactactgccaagtatacgaattcttcggaccaggaacaagactagacctaaaaagaacagtagcagcaccatcagac

SEQ ID NO: 49926 - RNA, 333 nt, synthetic construct
  misc_feature 1..333: note = derived and/or modified sequence opt6 from anti-HIV_Chain
  source 1..333: mol_type = other RNA
ctatcagcatacgtaggagacagagtaacaataacatgcagagcatcacaaaacataaacacatatctaaactggtaccaacaaagaccaggaaaagcaccaaaactactaatatacgcagcatcaacactacaatcaggagtaccatcaagattctcaggatcaggatcaggaacagacttcacattaacaatatcaaacctagaaacagaagacttcgcagtatactactgccaacaaacatactcatcagtaacattcggccaaggaacaaaactagaaacaagaagaacagtagcagcaccatcagtattcatattcccaccatcagac

SEQ ID NO: 49927 - RNA, 333 nt, synthetic construct
  misc_feature 1..333: note = derived and/or modified sequence opt6 from anti-HIV_Chain
  source 1..333: mol_type = other RNA
gaaatagtactaacacaatcaccagcaacattatcattaagcccaggagaaagagcaacactaagctgtagagcaagccaaggagtaaactttgtagtatggtatcaacaaaaacgaggacaagcaccaagattactaatatacggaaactcagacagagtaccaggagtaccagatagatttagcgcaagaggaagcggaacagaatttagcctagtaatatcaagcgtagaaccagacgatttcgcactatattactgtcaagaatactcaagcacaccatataacttcggaccaggaacaagagtagacagaaaaagaacagtagcagca

SEQ ID NO: 49928 - RNA, 336 nt, synthetic construct
  misc_feature 1..336: note = derived and/or modified sequence opt6 from anti-HIV_HeavyChain
  source 1..336: mol_type = other RNA
gaagtaaaactagaagaatcaggaggaggactagtacaaccaggaggatcaagaaaactatcatgcgcagcatcaggattcacattctcatcattcggaatgcactgggtaagacaagcaccagaaaaaggactagaatgggtagcatacatatcatcaggatcatcaacactacactacgcagacacagtaaaaggaagattcacaatatcaagagacaacccaaaaaacacactattcctacaaatgaaactaccatcactatgctacggactactaggatcaagaaacctatcacacagactactatcacaaaacgacacaccaatatgccta

SEQ ID NO: 49929 - RNA, 336 nt, synthetic construct
  misc_feature 1..336: note = derived and/or modified sequence opt6 from anti-HIV_Chain
  source 1..336: mol_type = other RNA
gaaatagtactaacacaatcaccagcaacattaagcttaagcccaggagaaagagcaacattaagctgtagagcaagccaaggagtaaactttgtagtatggtatcaacaaaaaagaggacaagcaccaagattattaatatacggaccatcagacagagcaccaggagtaccagatagatttagcgcaagaggaagcggaacagaattctcattagtaatatcaagcgtagaaccagacgatttcgcactatattactgtcaagaatactcaagcacaccatataactttggaacaggaacaagagtagacagaaaaagaacagtagcagcacca

SEQ ID NO: 49930 - RNA, 336 nt, synthetic construct
  misc_feature 1..336: note = derived and/or modified sequence opt6 from anti-HIV_Chain
  source 1..336: mol_type = other RNA
caaacactatcactaacatgctcagtatcaggaggaagtataagttcagcaggatactattggggatggataagacaacacccaggaaaaggattagaatggataggacacatatattatagcggaaatacaaactataacccatcattaaaaagcagattaagtatgagcgtagaaacaagcaaaaaccaattctcactaaatctagcaagtgtaacagcagcagatacagcagtatatttctgtgcaagagactatagcgcagcaggaagacatctatttgactcatggggacaaggaatattagtaacagtatcaagcgcaagcacaaaagga

SEQ ID NO: 49931 - RNA, 336 nt, synthetic construct
  misc_feature 1..336: note = derived and/or modified sequence opt6 from anti-HIV_LightChain
  source 1..336: mol_type = other RNA
gacatagtaatgacacaacaaacaccactaacactatcaataacaataggacaaccagcatcaatatcatgcaaatcatcacaatcactactagactcagacggaaaaacatacctaaactggctactacaaagaccaggacaatcaccaaaaagactaatatactggatgtcaaaactagactcaggagtaccagacagattcacaggatcaggatcaggaacagacttcacactaaaaatatcaagagtagaagcagaagacctaggagtatactactgctggcaaggaacacacttcccatggacattcggaggaggaacaaaactagaacta

SEQ ID NO: 49932 - RNA, 339 nt, synthetic construct
  misc_feature 1..339: note = derived and/or modified sequence opt6 from anti-HIV_LightChain
  source 1..339: mol_type = other RNA
gacatagtaataacacaatcaacaaaattcatgtcaacatcagtaggagacagagtatcaataacatgcaaagcatcacaagacgtatcaacagcagtagcatggtaccaacaaaaaccaggacaatcaccaaaactactaatatactgggcatcaacaagacacacaggagtaccagacagattcacaggatcaggatcaggaacagactacacactaacaatatcaagagtacaagcagaagacctagcactatactactgccaacaacactacacaacaccatggacattcggaggaggaacaaaattagaaataaaaagaacagtagcagcacca

SEQ ID NO: 49933 - RNA, 339 nt, synthetic construct
  misc_feature 1..339: note = derived and/or modified sequence opt6 from anti-HIV_Chain
  source 1..339: mol_type = other RNA
gacatacaaatgacacaaagcccatcatcactatcagcaagagtaggagacacagtaacattcacatgccaagcaaacggatacctaaactggtaccaacaaagaagaggaaaagcaccaaaactactaatatacgacggatcaaaactagaaagaggagtaccatcaagattctcaggaagaagatggggacaagaatacaacctaacaataaacaacctacaaccagaagacatagcaacatacttctgccaagtatacgaattcgcagtaccaggaacaagactagacctaaaaagaacagtagcagcaccatcagtattcatattcccatcagac

SEQ ID NO: 49934 - RNA, 339 nt, synthetic construct
  misc_feature 1..339: note = derived and/or modified sequence opt6 from anti-HIV_Chain
  source 1..339: mol_type = other RNA
caatcagtactaacacaaccagcatcagtatcaggatcaccaggacaatcaataacaatatcatgcacaggaacaaactcagacgtaggatactcatacgtatcctggttccaacaacacccaggaaaagtaccaaaactactaatatacgacgtatcaagaagatcatcaggagtatcaaacagattctcaggatcaagatcaggaaacacagcatcactaacaatatcaggactaagagcagaagacgaagcagactactactgcggatcattcacaacatcactaacattagtattcggaggaggaacaaaactagcagtattagtatcaccatca

SEQ ID NO: 49935 - RNA, 339 nt, synthetic construct
  misc_feature 1..339: note = derived and/or modified sequence opt6 from anti-HIV_Chain
  source 1..339: mol_type = other RNA
tcactatcagcatcagtaggagacagagtaacaataacatgcagagcatcagaatcaatatccttctacctaaactggtaccaacaaaaaccaggaaaagcaccagaactactaatattcgcaacatcaacactacactcaggagtaccatcaagattctcaggatcaggatcaggaacagacttcacactaacaatatcatcactacaactagaagacttcgcaacatactactgccaacaatcatcatcaacaccattcacattcggaggaggaacaaaagtagaaataaaaagaacagtagcagcaccatcagtattcatattcccaccatcagac

SEQ ID NO: 49936 - RNA, 342 nt, synthetic construct
  misc_feature 1..342: note = derived and/or modified sequence opt6 from anti-HIV_Chain
  source 1..342: mol_type = other RNA
gacatacaaatgacacaatcaccatcatcattatcagcatcagtaggagacacagtaacaataacatgccaagcaaacggatacctaaactggtaccaacaaagaagaggaaaagcaccaaaactactaatatacgacggatcaaaactagaaagaggagtaccatcaagattctcaggaagaagatggggacaagaatacaacctaacaataaacaacctacaaccagaagacatagcaacatacttctgccaagtatacgaattcatagtaccaggaacaagactagacctaaaaagaacagtagcagcaccatcagtattcatattcccaccatcagac

SEQ ID NO: 49937 - RNA, 342 nt, synthetic construct
  misc_feature 1..342: note = derived and/or modified sequence opt6 from anti-HIV_Chain
  source 1..342: mol_type = other RNA
gacatacaaatgacacaatcaccatcatcactatcagcaagagtaggagacacagtaacaataacatgccaagcaaacggatacctaaactggtaccaacaaagaagaggaaaagcaccaaaactactaatatacgacggatcaaaactagaaagaggagtaccatcaagattctcaggaagaagatggggacaagaatacaacctaacaataaacaacctacaaccagaagacatagcaacatacttctgccaagtatacgaattcgcagtaccaggaacaagactagacctaaaaagaacagtagcagcaccatcagtattcatattcccaccatcagac

SEQ ID NO: 49938 - RNA, 342 nt, synthetic construct
  misc_feature 1..342: note = derived and/or modified sequence opt6 from anti-HIV_Chain
  source 1..342: mol_type = other RNA
gacatacaaatgacacaatcaccatcatcactatcagcaagagtaggagacacagtaacaataacatgccaagcaaacggatacctaaactggtaccaacaaagaagaggaaaagcaccaaaactactaatatacgacggatcaaaactagaaagaggagtaccatcaagattctcaggaagaagatggggacaagaatacaacctaacaataaacaacctacaaccagaagacatagcaacatacttctgccaagtatacgaattcgtagtaccaggaacaagactagacctaaaaagaacagtagcagcaccatcagtattcatattcccaccatcagac

SEQ ID NO: 49939 - RNA, 342 nt, synthetic construct
  misc_feature 1..342: note = derived and/or modified sequence opt6 from anti-HIV_Chain
  source 1..342: mol_type = other RNA
gacatacaaatgacacaatcaccatcatcactatcagcaagagtaggagacacagtaacattcacatgccaagcaaacggatacctaaactggtaccaacaaagaagaggaaaagcaccaaaactactaatatacgacggatcaaaactagaaagaggagtaccatcaagattctcaggaagaagatggggacaagaatacaacctaacaataaacaacctacaaccagaagacatagcaacatacttctgccaagtatacgaattcgcagtaccaggaacaagactagacctaaaaagaacagtagcagcaccatcagtattcatattcccaccatcagac

SEQ ID NO: 49940 - RNA, 342 nt, synthetic construct
  misc_feature 1..342: note = derived and/or modified sequence opt6 from anti-HIV_Chain
  source 1..342: mol_type = other RNA
gacatacaaatgacacaatcaccatcatcactatcagcatcagtaggagacacagtaacaataacatgccaagcaaacggatacttaaactggtaccaacaaagaagaggaaaagcaccaaaactactaatgtacgacggatcaacactagaaagaggagtaccagcaagattctcaggaagaagatggggacaagaatacaacctaacaataaacaacctacaaccagaagacgtagcaacatacttctgccaagtatacgaattcatagtaccaggaacaagactagacttaaaaagaacagtagcagcaccatcagtattcatattcccaccatcagac

SEQ ID NO: 49941 - RNA, 342 nt, synthetic construct
  misc_feature 1..342: note = derived and/or modified sequence opt6 from anti-HIV_Chain
  source 1..342: mol_type = other RNA
gacatacaaatgacacaatcaccatcatcactatcagcatcagtcggagacacagtaacaataacatgccaagcaaacggatacctaaactggtaccaacaaagaagaggaaaagcaccaaaactactaatatacgacggatcaaaactagaaagaggagtaccatcaagattctcaggaagaagatggggacaagaatacaacctaacaataaacaacctacaagcagaagacatagcaacatacttctgccaagtatacgaattcgcagtaccaggaacaagactagacttaaaaagaacagtagcagcaccatcagtattcatattcccaccatcagac

SEQ ID NO: 49942 - RNA, 342 nt, synthetic construct
  misc_feature 1..342: note = derived and/or modified sequence opt6 from anti-HIV_Chain
  source 1..342: mol_type = other RNA
gacatacaaatgacacaatcaccatcatcactatcagcatcagtaggagacacagtaacattcacatgccaagcaaacggatacctaaactggtaccaacaaagaagaggaaaagcaccaaaattactaatatacgacggatcaagactagaaagaggagtaccatcaagattctcaggaagaagatggggacaagaatacaacttaacaataaacaacctacaaccagaagacatagcaacatacttctgccaagtatacgaattcgcagtaccaggaacaagactagacctaaaaagaacagtagcagcaccatcagtattcatattcccaccatcagac

SEQ ID NO: 49943 - RNA, 342 nt, synthetic construct
  misc_feature 1..342: note = derived and/or modified sequence opt6 from anti-HIV_Chain
  source 1..342: mol_type = other RNA
gacatacaaatgacacactcaccatcatcactatcagcatcagtaggagacacagtaacaataacatgccaagcaaacggatacctaaactggtaccaacaaagaagaggaaaagcaccaaaactactaatatacgacggatcaaaactagaaacaggagtaccatcaagattcacaggaagaagatggggacaagaatacaacctaacaataaacaacctacaaccagaagacatagcaacatacttctgccaagtatacgaattcatagtaccaggaacaagactagacctaaaaagaacagtagcagcaccatcagtattcatattcccaccatcagac

SEQ ID NO: 49944 - RNA, 342 nt, synthetic construct
  misc_feature 1..342: note = derived and/or modified sequence opt6 from anti-HIV_Chain
  source 1..342: mol_type = other RNA
gacatacaaatgacacaatcaccatcatcactatcagcaagagtaggagacacagtaacaataacatgccaagcaaacggatacctaaactggtaccaacaaagaagaggaaaagcaccaaaactactaatatacgacggatcaaaactagaaacaggagtaccatcaagattcacaggaagaagatggggacaagaatacaacctaacaataaacaacctacaaccagaagacatagcaacatacttctgccaagtatacgaattcatagtaccaggaacaagactagacctaaaaagaacagtagcagcaccatcagtattcatattcccaccatcagac

SEQ ID NO: 49945 - RNA, 342 nt, synthetic construct
  misc_feature 1..342: note = derived and/or modified sequence opt6 from anti-HIV_Chain
  source 1..342: mol_type = other RNA
gacatacaaatgacacaatcaccatcatcactatcagcaagagtaggagacacagtaacattcacatgccaagcaaacggatacctaaactggtaccaacaaagaagaggaaaagcaccaaaactattaatatacgacggatcaaaactagaaagaggagtaccatcaagattctcaggaagaggatggggacaagaatacaacctaacaataaacaacctacaaccagaagacatagcaacatacttctgccaagtatacgaattcgcagtaccaggaacaagactagacttaaaaagaacagtagcagcaccatcagtattcatattcccaccatcagac

SEQ ID NO: 49946 - RNA, 342 nt, synthetic construct
  misc_feature 1..342: note = derived and/or modified sequence opt6 from anti-HIV_Chain
  source 1..342: mol_type = other RNA
gacatacaaatgacacaatcaccatcatcactatcagcatcagtaggagacacagtaacaataacatgccaagcaaacggatatctaaactggtaccaacaaagaagaggaaaagcaccaaaactactaatatacgacggatcaaaactagaaagaggagtaccatcaagattctcaggaagaagatggggacaagaatacaacctaacaataaacaacctacaaccagaagacatagcaacatacttctgccaagtatacgaattcgtagtaccaggaacaagactagacctaaaaagaacagtagcagcaccatcagtattcatattcccaccatcagac

SEQ ID NO: 49947 - RNA, 342 nt, synthetic construct
  misc_feature 1..342: note = derived and/or modified sequence opt6 from anti-HIV_Chain
  source 1..342: mol_type = other RNA
tcacaatcagtagtaacacaagaaccatcactaacagtatcaccaggaggaacagtaacactaacatgcggaccatcaacaggagcagtaacatcaggattctacccacactggttccaacaaaaaccaggacaagcaccaagagcactaatatactcaacatcaaacaaatactcatggacaccagcaagattctcaggatcactactaggaggaaaagcagtattaacactatcagacgtacaaccagacgacgaagcagaatactactgcctattactactatactacggaggaccatggatattcggaggaggaacaaaactaacagtattagtatca

SEQ ID NO: 49948 - RNA, 345 nt, synthetic construct
  misc_feature 1..345: note = derived and/or modified sequence opt6 from anti-HIV_Chain
  source 1..345: mol_type = other RNA
gatatacaaatgacacaatcaccatcaagcttaagcgcaagcgtaggagataaagtaacaataacatgtcaaacaagtgcaggatatctaaattggtatcaacaaagaagaggaagagcaccaaaactactaatgtacgatggatcaagattagtaacaggagtaccatcaagatttagcggaagaagatggggaacacaatacaatttaacaataggaagcttacaaccagaagatgtagcaacatattactgtcaagtatacgaattctttggaccaggaacaagattagacttaaaaagaacagtagcagcaccatcagtatttatatttccaccaagtgat

SEQ ID NO: 49949 - RNA, 345 nt, synthetic construct
  misc_feature 1..345: note = derived and/or modified sequence opt6 from anti-HIV_Chain
  source 1..345: mol_type = other RNA
gacatacaaatgacacaatcaccatcatcactatcagcatcagtaggagacacagtaacaataacatgccaaacaacaaaaggatacttaaactggtaccaacaaagaagaggaagagcaccaaaactactaatgttcgacggatcaaaactagtaacaggagtaccatcaagattctcaggaagaagatggggaacacaatacaacctaacaataggatcactacaaccagaagacctagcaacatactactgccaagtatacgaattcttcggaccaggaacaagactagacctaaaaagaacagtagcagcaccatcagtattcatattcccaccatcagac

SEQ ID NO: 49950 - RNA, 345 nt, synthetic construct
  misc_feature 1..345: note = derived and/or modified sequence opt6 from anti-HIV_Chain
  source 1..345: mol_type = other RNA
gatatacaaatgacacaatcaccatcaagcttaagtgcaagcgtaggagatacagtaacaataacatgtcaaacaaacaaaggatatctaaattggtatcaacaaagaagaggaagagcaccaaaattactaatgtgcgatggatcaaaattagtaacaggagtaccatcaagatttagcggaagaagatggggaacacaatacaatctaacaataggaagcttacaaccagaagatatagcaacatattactgtcaagtatacgaattctttggaccaggaacaagattagacttaaaaagaacagtagcagcaccatcagtatttatatttccaccaagcgat

SEQ ID NO: 49951 - RNA, 345 nt, synthetic construct
  misc_feature 1..345: note = derived and/or modified sequence opt6 from anti-HIV_Chain
  source 1..345: mol_type = other RNA
gatatacaaatgacacaatcaccatcaagcttaagcgcaagagtgggagataaagtaacaataacatgtcaaacaagcgcaggatatctaaattggtatcaacaaagaagaggaagagcaccaaaactactaatgtacgatggatcaagattagtaacaggagtaccatcaagatttagcggaagaagatggggaacacaatacaatctaacaataggaagcttacaaccagaagatatagcaacatattactgtcaagtatacgaattctttggaccaggaacaagattagacttaaaaagaacagtagcagcaccatcagtatttatatttccaccaagcgat

SEQ ID NO: 49952 - RNA, 345 nt, synthetic construct
  misc_feature 1..345: note = derived and/or modified sequence opt6 from anti-HIV_Chain
  source 1..345: mol_type = other RNA
gacatacaaatgacacaatcaccatcatcactatcagcatcagtaggagacacagtaacaataacatgccaaacaaacaaaggatacctaaactggtaccaacaaaaaagaggaagagcaccaaaactactaatgtacgacggatcaaaactagtaacaggagtaccatcaagactatcaggaagaagatggggaacacaatacaacctaacaataggatccctacaaccagaagacatagcaacatactactgccaagtatacgaattcttcggaccaggaacaagactagacctaaaaagaacagtagcagcaccatcagtattcatattcccaccatcagac

SEQ ID NO: 49953 - RNA, 345 nt, synthetic construct
  misc_feature 1..345: note = derived and/or modified sequence opt6 from anti-HIV_Chain
  source 1..345: mol_type = other RNA
gacatacaaatgacacaaagcccatcatcactatcagcatcagtaggagacacagtaacaataacatgccaaacaaacaaaggatacctaaactggtaccaacaaagaagaggaagagcaccaaaactactaatgtacgacggatcaaaattagtaacaggagtaccatcaagactatcaggaagaagatggggaacacaatacaacctaacaataggatcactacaaccagaagacatagcaacatactactgccaagtatacgaattcttcggaccaggaacaagactagacctaaaaagaacagtagcagcaccatcagtattcatattcccaccatcagac

SEQ ID NO: 49954 - RNA, 345 nt, synthetic construct
  misc_feature 1..345: note = derived and/or modified sequence opt6 from anti-HIV_Chain
  source 1..345: mol_type = other RNA
gacatacaaatgacacaatcaccatcatcactatcagcatcagtaggagacacagtaacaataacatgccacacaaacaaaggatacctaaactggtaccaacaaagaagaggaagagcaccaaaactactaatgttcgacggatcaaaactagtaacaggagtaccatcaagattctcaggaagaagatggggaacacaatacaacctaacaataggatcactacaaccagaagacatagcaacatactactgccaagtatacgaagtattcggaccaggaacaagactagacctaaaaagaacagtagcagcaccatcagtattcatattcccaccatcagac

SEQ ID NO: 49955 - RNA, 345 nt, synthetic construct
  misc_feature 1..345: note = derived and/or modified sequence opt6 from anti-HIV_Chain
  source 1..345: mol_type = other RNA
gacatacaaatgacacaatcaccatcatcactatcagcatcagtaggagacacagtaacaataaactgccaaacaaacaaaggatacctaaactggtaccaacaaagaagaggaagagcaccaaaactactaatgtacgacggatcaaaactagtaacaggagtaccatcaagattctcaggaagaagatggggaacacaatacaacctaacaataggatcattacaaccagaagacatagcaacatactactgccaagtatacgaattcttcggaccaggaacaagactagacctaaaaagaacagtagcagcaccatcagtattcatattcccaccatcagac

SEQ ID NO: 49956 - RNA, 345 nt, synthetic construct
  misc_feature 1..345: note = derived and/or modified sequence opt6 from anti-HIV_Chain
  source 1..345: mol_type = other RNA
gatatacaaatgacacaatcaccatcaagcttaagcgcaagagtaggagataaagtaacaataacatatcaaacaagcgcaggatatctcaattggtatcaacaaagaagaggaagagcaccaaaattactaatgtacgatggatcaagattagtaacaggagcaccatcaagatttagcggaagaagatggggaacacaatacaatctaacaataggaagcttacaaccagaagatatagcaacatattactgtcaagtatacgaattctttggaccaggaacaagattagacttaaaaagaacagtagcagcaccatcagtatttatatttccaccaagcgat

SEQ ID NO: 49957 - RNA, 345 nt, synthetic construct
  misc_feature 1..345: note = derived and/or modified sequence opt6 from anti-HIV_Chain
  source 1..345: mol_type = other RNA
gacatacaaatgacacaatcaccatcatcactatcagcatcagtaggagacacagtaacaataacatgccaaacaaacaaaggatacctaaactggtaccaacaaagaagaggaagagcaccaaaactattaatgtacgacggatcaaaactagtaacaggagtaccatcaagattctcaggaagaagatggggaacacaatacaacctaacaataggatcactacaaccagaagacatagcaacatactactgccaagtatacgaattcttcggaccaggaacaagattagacttaaaaagaacagtagcagcaccatcagtattcatattcccaccatcagac

SEQ ID NO: 49958 - RNA, 345 nt, synthetic construct
  misc_feature 1..345: note = derived and/or modified sequence opt6 from anti-HIV_Chain
  source 1..345: mol_type = other RNA
gtaacattatcattatcaccaggagaaagagcaacactatcatgcagagcatcacaaacaatatcaaataactatctagcatggtatcaacaaaaaccaggacaagcaccaagactactaatatacggagcatcatcaggagcaacaggactaccagacagattttcaggatcaggatcaggaacagatttcacactaacaatatcaagactagaaccagaagacttcgcagtatattactgtcaccaatacgcactatcaccatggacattcggaagaggaacaaaagtagaaataaaaagaacagtagcagcaccatcagtatttatatttccaccatcagat

SEQ ID NO: 49959 - RNA, 345 nt, synthetic construct
  misc_feature 1..345: note = derived and/or modified sequence opt6 from anti-HIV_Chain
  source 1..345: mol_type = other RNA
acactatcagcatcagtaggagacagagtaacaataacatgcagagcatcacaatcaataaacaactacctaaactggtaccaacaaaaaccaggaaaagcaccaaaactactaatatacgcagcatcatcactacaatcaggagtaccatcaagattctcaggatcaggatcaggaacagacttcacactaacaatatcatcactacaaccagaagacttcgtaacatactactgccaacaaacatactcaaacccaagaatgttcggacaaggaacaaaagtagaaataaaaagaacagtagcagcaccatcagtattcatattcccaccatcagacgaacaa

SEQ ID NO: 49960 - RNA, 345 nt, synthetic construct
  misc_feature 1..345: note = derived and/or modified sequence opt6 from anti-HIV_Chain
  source 1..345: mol_type = other RNA
caatcagcactaacacaagcaccatcagcatcaggaacaccaggacaacgagtaacaatatcatgctcaggaggaggatcaaacataggaggaaacctagtatcatggtaccaacacttcccaggagcagcaccaaaactactaatatacagaaacgaccaaagaccatcaggagtaccagacagattctcagcatcaaaatcaggaacatcagcatcattagcaatatcaggactaagatcagacgacgaagcaacatacttctgcgcagcatacgactcaacactatcactaagactattcggaggaggaacaacattagcagtattatcacaaccaaaagca

SEQ ID NO: 49961 - RNA, 345 nt, synthetic construct
  misc_feature 1..345: note = derived and/or modified sequence opt6 from anti-HIV_Chain
  source 1..345: mol_type = other RNA
aaaccatcacaaacactatcactaacatgcacagtatcaggaggatcaatatcatcagcaggatactactggacatggataagacaccacccaggaaaaggactagaattcataggctacatataccacataggaacaccatactacaacccatcactaaaatcaagactaacaatatcaatagacacatcaaaaaaccaattctcactaaaactatcatcagtaacagcagcagacacagcaatatactactgcgcaagagactacacagcaagaggaagacacttcttcgactactggggacaaggagcactagtaacagtatcatcagcatcaacaaaagga

SEQ ID NO: 49962 - RNA, 345 nt, synthetic construct
  misc_feature 1..345: note = derived and/or modified sequence opt6 from anti-HIV_Chain
  source 1..345: mol_type = other RNA
ccatcagaaacactatcactaacatgcagagtatcaggagcaagcataagcaatttctattggacatggataagacaaccagcaggaaaaggattagaatggataggaagattatactcaagcgataaaacaaactataacccaagcctaaacggaagagtaacaatgagcttagacacaagcaaaaaccaattctcactaagactaacaagcatgacagatgcagatacagcaatatattactgtgcaagagaaaaaggacaatgggtaacattaccaccatactatttcgatagctggggacaaggaatattagtaacagtaagctcagcatcaacaaaagga

SEQ ID NO: 49963 - RNA, 348 nt, synthetic construct
  misc_feature 1..348: note = derived and/or modified sequence opt6 from anti-HIV_Chain
  source 1..348: mol_type = other RNA
ggaccagcaacactatcagtaagcccaggagaaagagcaacactatcatgcagagcatcacaatcactaagaaacaacctagcatggtaccaacaaaaaacaggacaatcaccaagactactaatatacgcagtatcaacaagagcaacaggaataccaccaagattctcaggaggaggatcaggaacagaattcacactaacaatagactcactacaatcagaagacttcgcagtatacttctgccaacaatacgactcaccacaatggacattcggacaaggaacaaaagtagaaatcaaaagaacagtagcagcaccatcagtattcatattcccaccatcagac

SEQ ID NO: 49964 - RNA, 348 nt, synthetic construct
  misc_feature 1..348: note = derived and/or modified sequence opt6 from anti-HIV_Chain
  source 1..348: mol_type = other RNA
gcaccagtaacactatcagcatcagtaggagacacagtaacaataacatgcagagcatcacaaccaatagcaacattcctaaactggtaccaacacaaaccaggacaagcaccaaaactactaatatacgcagcatcaacattccaaagaggagcaccatcaagatactcaggatcaggatcaggaacagacttcacactaacaataaactcattacaaccagaagacctagcaacatactattgccaacaaacattcacagacccagtaacattcggacaaggaacaagactagaaataaaaagaacagtagcagcaccatcagtattcatattcccaccatcagac

SEQ ID NO: 49965 - RNA, 351 nt, synthetic construct
  misc_feature 1..351: note = derived and/or modified sequence opt6 from anti-HIV_LightChain
  source 1..351: mol_type = other RNA
gatatacaaatgacacaatcaccatcaacattaagcgcaagcataggcgatacagtaagaataagctgtagagcaagccaaagcataacaggaggatggctagcatggtatcaccaaagaccaggaaaagcaccaagattactaatatacagaggatcaagattactaggaggagtaccatcaagatttagcggaagcgcagcaggaacagatttcacattaacaatagcaaacttacaagcagaagatttcggaacattttactgtcaacaatacgatacatatccaggaacatttggacaaggaacaaaagtagaagtaaaaagaacagtagcagcaccatcagtattt

SEQ ID NO: 49966 - RNA, 351 nt, synthetic construct
  misc_feature 1..351: note = derived and/or modified sequence opt6 from anti-HIV_LightChain
  source 1..351: mol_type = other RNA
gatatacaaatgacacaatcaccatcaacattaagcgcaagcataggagatacagtaagaataagctgtagagcaagccaaagcataacaggaaactgggtagcatggtatcaacaaagaccaggaaaagcaccaagattactaatatacagaggagcagcattactaggaggagtgccatcaagatttagcggaagcgcagcaggaacagatttcacactaacaataggaaacttacaaacagaagatttcggaacattttactgtcaacaatacgatacatatccaggaacatttggacaaggaacaaaagtagaagtaaaaagaacagtagcagcaccatcagtattt

SEQ ID NO: 49967 - RNA, 351 nt, synthetic construct
  misc_feature 1..351: note = derived and/or modified sequence opt6 from anti-HIV_LightChain
  source 1..351: mol_type = other RNA
gatatacaaatgacacaatcaccatcaacattaagcgcaagcataggagatacagtaagaatatcctgtagagcaagccaaagcataacaggaaactgggtagcatggtatcaacaaagaccaggaaaagcaccaagactactaatatacagaggagcagcattactaggaggagtaccatcaagatttagaggaagcgcagcaggaacagatttcacactaacaataggaaacttacaagcagaagatttcggaacattttactgtcaacaatacgatacatatccaggaacatttggacaaggaacaaaagtagaagtaaaaagaacagtagcagcaccatcagtattt

SEQ ID NO: 49968 - RNA, 351 nt, synthetic construct
  misc_feature 1..351: note = derived and/or modified sequence opt6 from anti-HIV_LightChain
  source 1..351: mol_type = other RNA
gatatacaaatgacacaatcaccatcaacactaagcgcaagcgtaggagatacagtaagaataagctgtagagcaagtcaaagtataacaggaggctggctagcatggtatcaccaaagaccaggaaaagcaccaagattattaatatacagaggatcaagattactaggaggagtaccatcaagatttagtggaagcgcagcaggaacagatttcacactaacaatagcaaacttacaagcagaagatttcggaacattttactgtcaacaatacgatacatatccaggaacatttggacaaggaacaaaagtagaagtaaaaagaacagtagcagcaccatcagtattt

SEQ ID NO: 49969 - RNA, 351 nt, synthetic construct
  misc_feature 1..351: note = derived and/or modified sequence opt6 from anti-HIV_LightChain
  source 1..351: mol_type = other RNA
gatatacaaatgacacaatcaccatcaacattaagcgcaagcataggagatacagtaagaataagctgtagagcaagccaaagcataacaggaaactgggtagcatggtatcaacaaagaccaggaaaagcaccaagattattaatatacagaggagcagcattactaggaggagtaccatcaagatttagcggaagcgcagcaggaacagatttcacactaacaataggaaacttacaagcagaagatttcggaacattttactgtcaacaatacgatacatatccaggaacatttggacaaggaacaaaagtagaagtaaaaagaacagtagcagcaccatcagtattt

SEQ ID NO: 49970 - RNA, 351 nt, synthetic construct
  misc_feature 1..351: note = derived and/or modified sequence opt6 from anti-HIV_LightChain
  source 1..351: mol_type = other RNA
gatatacaaatgacacaatcaccatcaacattaagcgcaagcataggagatacagtaagaataagttgtagagcaagccaaagcataacaggaggatgggtagcatggtatcaccaaagaccaggaaaagcaccaagattactaatatacagaggatcaagattactaggaggagtaccaagtagatttagcggaagcgcagcaggaacagatttcacactaacaataggaaacttacaagcagaagatttcggaacattttactgtcaacaatacgatacatatccaggaacatttggacaaggaacaaaagtagaagtaaaaagaacagtagcagcaccatcagtattt

SEQ ID NO: 49971 - RNA, 351 nt, synthetic construct
  misc_feature 1..351: note = derived and/or modified sequence opt6 from anti-HIV_LightChain
  source 1..351: mol_type = other RNA
gatatacaaatgacacaatcaccatcaacattaagcgcaagcgtaggagatacagtaagaatatcatgtagagcaagccaaagcataacaggaggatggctagcatggtatcaccaaagaccaggaaaagcaccaagattactaatatacagaggatcaagattactaggaggagtaccatcaagatttagcggaagcgcagcaggaacaggattcacactaacaatagcaaacttacaagcagaagatttcggaacattttactgtcaacaatacgatacatatccaggaacatttggacaaggaacaaaagtagaagtaaaaagaacagtagcagcaccatcagtattt

SEQ ID NO: 49972 - RNA, 351 nt, synthetic construct
  misc_feature 1..351: note = derived and/or modified sequence opt6 from anti-HIV_LightChain
  source 1..351: mol_type = other RNA
gatatacaaatgacacaatcaccatcaacattaagcgcaagcgtaggaggaacagtaagaataagctgtagagcatcacaaagcataacaggaggatggctagcatggtatcaccaaagaccaggaaaagcaccaagattactaatatacagaggatcaagattactaggaggagtaccatcaagatttagcggaagcgcagcaggaacagatttcacactaacaatagcaaacttacaagcagaagatttcggaacattttactgtcaacaatacgatacatatccaggaacctttggacaaggaacaaaagtagaagtaaaaagaacagtagcagcaccatcagtattt

SEQ ID NO: 49973 - RNA, 351 nt, synthetic construct
  misc_feature 1..351: note = derived and/or modified sequence opt6 from anti-HIV_LightChain
  source 1..351: mol_type = other RNA
gatatacaaatgacacaatcaccatcaacattaagcgcaagcataggagatacagtaagaataagctgtagagcaagccaaagcataacaggaaactgggtagcatggtatcaccaaagaccaggaaaagcaccaagattactaatatacagaggagcagcattactaggaggagtaccatcaagatttagcggaagcgcagcaggaacagatttcacactaacaataggaaacttacaagcagaagatttcggaacattttactgtcaacaatacgatacatatccaggaacatttggacaaggaacaaaagtagaagtaaaaagaacagtagcagcaccatcagtattt

SEQ ID NO: 49974 - RNA, 351 nt, synthetic construct
  misc_feature 1..351: note = derived and/or modified sequence opt6 from anti-HIV_LightChain
  source 1..351: mol_type = other RNA
gatatacaaatgacacaaagtccatcaacattaagcgcaagcataggagatacagtaatgataagctgtagagcaagccaaagcataacaggtggatggctagcatggtatcaccaaagaccaggaaaagcaccaagattactaatatacagaggatcaaaattactaggaggagtaccatcaagatttagcggaagcgcagcaggaacaggattcacactaacaataggaaacttacaagcagaagatttcggaacattttactgtcaacaatacgatacatatccaggaacatttggacaaggaacaaaagtagaagtaaaaagaacagtagcagcaccatcagtattt

SEQ ID NO: 49975 - RNA, 351 nt, synthetic construct
  misc_feature 1..351: note = derived and/or modified sequence opt6 from anti-HIV_LightChain
  source 1..351: mol_type = other RNA
gatatacaaatgacacaatcaccatcaacattaagtgcaagcgtaggagatacagtaagaataagctgtagagcaagccaaagcataacaggaggatggctagcatggtatcaccaaagaccaggaaaagcaccaagattactaatatacagaggatcaagattactaggaggagtaccatcaagatttagcggaagcgcagcaggagcagatttcacactaacaatagcaaacttacaagcagaagatttcggaacattttactgtcaacaatacgatacatatccaggaacatttggacaaggaacaaaagtagaagtaaaaagaacagtagcagcaccatcagtattt

SEQ ID NO: 49976 - RNA, 351 nt, synthetic construct
  misc_feature 1..351: note = derived and/or modified sequence opt6 from anti-HIV_LightChain
  source 1..351: mol_type = other RNA
gatatacaaatgacacaatcaccatcaacattaagcgcaagcataggagatacagtaagaataagctgtagagcaagccaaagcataacaggaggatggctagcatggtatcaccaaagaccaggaaaagcaccaagattactaatatacagaggatcaagattagtaggaggagtaccatcaagatttagcggaagcgcagcaggaacagatttcacactaacaataggaaacttacaagcagaagatttcggaacattttactgtcaacaatacgatacatatccaggaacatttggacaaggaacaaaagtagaagtaaaaagaacagtagcagcaccatcagtattt

SEQ ID NO: 49977 - RNA, 351 nt, synthetic construct
  misc_feature 1..351: note = derived and/or modified sequence opt6 from anti-HIV_LightChain
  source 1..351: mol_type = other RNA
gatatacaaatgacacaatcaccatcaacattaagcgcaagcataggagatacagtaagaataagttgtagagcaagtcaaagcataacaggaggatggctagcatggtatcaccaaagaccaggaaaagcaccaagattactaatatacagaggatcaagattactaggaggagtaccatcaaaatttagtggaagcgcagcaggaacagatttcacactaacaatagcaaacttacaagcagaagatttcggaacattttactgtcaacaatacgatacatatccaggaacatttggacaaggaacaaaagtagaagtaaaaagaacagtagcagcaccatcagtattt

SEQ ID NO: 49978 - RNA, 351 nt, synthetic construct
  misc_feature 1..351: note = derived and/or modified sequence opt6 from anti-HIV_LightChain
  source 1..351: mol_type = other RNA
gatatacaaatgacacaatcaccatcaacattaagtgcaagcacaggagatacagtaagaataagctgtagagcaagccaaagcataacaggaaactgggtagcatggtatcaacaaagaccaggaaaagcaccaagattactaatatacagaggagcagccttactaggaggagtaccatcaagatttagaggaagcgcagcaggaacagatttcacattaacaataggaaacttacaagcagaagatttcggaacattttactgtcaacaatacgatacatatccaggaacatttggacaaggaacaaaagtagaagtaaaaagaacagtagcagcaccatcagtattt

SEQ ID NO: 49979 - RNA, 351 nt, synthetic construct
  misc_feature 1..351: note = derived and/or modified sequence opt6 from anti-HIV_LightChain
  source 1..351: mol_type = other RNA
gatatacaaatgacacaatcaccatcaacattaagtgcaagcataggagatacagtaagaataagttgtagagcaagtcaaagcataacaggaaactggctagcatggtatcaccaaagaccaggaaaagcaccacgattactaatatacagaggatcaagattactaggaggagtaccatcaagatttagcggaagcgcagcaggaacagatttcacactaacaatagcaaacttacaagcagaagatttcggaacattttactgtcaacaatacgatacatatccaggaacatttggacaaggaacaaaagtagaagtaaaaagaacagtagcagcaccatcagtattt

SEQ ID NO: 49980 - RNA, 351 nt, synthetic construct
  misc_feature 1..351: note = derived and/or modified sequence opt6 from anti-HIV_Chain
  source 1..351: mol_type = other RNA
ataatattattcttagtagcaacagcaacaggatcatgggcacaatcagcactaacacaaccaagatcagtatcaggatcactaggacaatcagtaacaatatcatgcacaggatcatcatcagacgtaggaagatacaactacgtatcatggtaccaacaccacccaggaaaagcaccaaaattaatgatatcagacgtaaacaaaagaccatcaggagtaccagacagattctcaggatcaaaatcaggaaacacagcatcactaacaataagtggactacaagcagaagacgaaacagactactactgctgctcatacgcaggatcatacatatgggtattcggagga

SEQ ID NO: 49981 - RNA, 351 nt, synthetic construct
  misc_feature 1..351: note = derived and/or modified sequence opt6 from anti-HIV_Chain
  source 1..351: mol_type = other RNA
ccagtaacactatcagcatcagtaggagacagagtaacaataacatgcagagcatcagaagacatatcaaaatacctaaactggtaccaacacaaaccaggaaaagcaccaaaactactaatatacacagcatcatcactagaaacaggagtaccatcaagattctcaggatcaggatcaggaacagacttctcactaacaatatcatcactacaaccagacgacttcgcaacatactactgccaacaatcatacacatcatcagtaacattcggacaaggaacaagagtagaagtaaaaagaacagtagcagcaccatcagtattcatattcccaccatcagacgaacaa

SEQ ID NO: 49982 - RNA, 351 nt, synthetic construct
  misc_feature 1..351: note = derived and/or modified sequence opt6 from anti-HIV_Chain
  source 1..351: mol_type = other RNA
gtagaagaaccaggaagttcagtaaaagtatcatgtaaagcatcaggaggaagttcaacagcatatggatattcatgggtaagacaagcaccaggacaaggatttgaatggatgggaagaataataccattttatggaataataacatatgcaccaaaatttcaaggaagagtaacaataacagcagatagatcaacatcaacagtatatatggaattaacaagattaacatttgcagatacagcattatttttttgtgcaagagattatggagatccaagaaatggatattattttgattcatgggatcaaggattatggttaacagtatcaagtgcaagtacaaaagga

SEQ ID NO: 49983 - RNA, 351 nt, synthetic construct
  misc_feature 1..351: note = derived and/or modified sequence opt6 from anti-HIV_Chain
  source 1..351: mol_type = other RNA
caagtaagattagaacaaagcggagcagcagtaagaacaccaggagcaagcgtaacattaagctgtcaagcaagcggatacaaattcgtaaactatataatacactgggtaagacaaagaccaggactagcattcgaatgggtaggaatgatagatccatatagaggaagaccatggtcagcacatagctttgaaggaagattaagcctaagcagagacgtaagcatggaaatactatatatgacactaacatcattaagaagcgacgatacagcaacatatttctgtgcaagagcagaagcagaaagccaaagccatagtagaccaataatatcaacatcaggagcaaga

SEQ ID NO: 49984 - RNA, 351 nt, synthetic construct
  misc_feature 1..351: note = derived and/or modified sequence opt6 from anti-HIV_Chain
  source 1..351: mol_type = other RNA
gtacacctagaagtacaactacaacaatcaggaccagaactaaaaaaaccaggagaaacagtaaaaatatcatgcaaagcatcagtatacacattcacagaatacccaatacactgggtaaaacaagcaccaggaaaaggattcaaatggatgggatggataaacacatactcaggagaaccaacatacgcagacgacttcaaaggaagattcgcattctcactagaaacatcagcatcaacagcatacctacaaataaactcactaaaaaatgaagacacagcaacatacttctgcgcatcactaggaagagactactggggacaaggacaaggaacaacactaacagta

SEQ ID NO: 49985 - RNA, 354 nt, synthetic construct
  misc_feature 1..354: note = derived and/or modified sequence opt6 from anti-HIV_Chain
  source 1..354: mol_type = other RNA
ctatcagtatcattaggagaaagagcaacaataaactgcaaatcatcacaatcaatactatactcatcagacaaaaaaaactacctagcatggtaccaacaaaaaataggacaaccaccaaaactactactatactgggcatcaacaagagaatcaggaataccagacagattctcaggatcaggatcaggatcagacttcacactaacaatatcatcactacaaccagaagacgtagcagtatactactgccaacaatactacatatcaccattcacattcggaccaggaacaaaagtagacctaaaaagaacagtagcagcaccatcagtattcatattcccaccatcagac

SEQ ID NO: 49986 - RNA, 354 nt, synthetic construct
  misc_feature 1..354: note = derived and/or modified sequence opt6 from anti-HIV_Chain
  source 1..354: mol_type = other RNA
caatcagtattaacacaaccaccatcagcatcaggagcaccaggacaaagagtaacaatatcatgctcaggaggaccatcaaacgtaggaggaaactatgtatattggtatagacaattcccaggaacagcaccaaaattattaatactaagagacgaccaaagaccatcaggagtaccagacagattttcagcatcaaaatcaggaaactctgcatcactagcaatatcaggattaagaccagacgacgaagcattctatttctgtgcaacatacgactcagacggatctataagactatttggaggaggaactgcattaacagtactatcacaaccaaaagcagcaccatca

SEQ ID NO: 49987 - RNA, 354 nt, synthetic construct
  misc_feature 1..354: note = derived and/or modified sequence opt6 from anti-HIV_Chain
  source 1..354: mol_type = other RNA
aaagcaccagcaacactatcattatcaccaggagaaagagcaacactatcatgtagagcatcacaatcagtaggatcagacctagcatggtaccaacaaaaaccaggacaagcaccaagactactaatatacgacgcatcaaacagagcaacagcaataccagcaagattctcaggatcaggatcaggaacagacttcacattatcaatatcatcactagaaccagaagacttcgcagtatacttctgccaacaaagatacgacaaaataacattcggacaaggaacaagactagaaatacaaagaacagtagcagcaccatcagtattcatattcccaccatcagacgaacaa

SEQ ID NO: 49988 - RNA, 354 nt, synthetic construct
  misc_feature 1..354: note = derived and/or modified sequence opt6 from anti-HIV_Chain
  source 1..354: mol_type = other RNA
caagtacaattagtacaaagcggagcagaagcaaaaagaccaggagacagtgtaaaagtaagttgtaaagcaagcggatatacatttacagaatattatatacactgggtaagacaaacaccaggacaaggatttgaatggatgggaataataacaccaggagcaggaaatacaacatatgcacaaaaatttcaaggaagaataacagtaacaagagatacaagtgcagcaacagtatatatggaattatcaaatttaacatcagaagatacagcagtatatttttgtagcagaggagtaagtttttggggacaaggaacattagtaacagtatcaagtgcaagcacaaaagga

SEQ ID NO: 49989 - RNA, 354 nt, synthetic construct
  misc_feature 1..354: note = derived and/or modified sequence opt6 from anti-HIV_HeavyChain
  source 1..354: mol_type = other RNA
gaagtaaaattacaacaaagcggagcagaattagtaagaccaggagcaagcgtaaaaatgagctgtaaagcaagcggatacagattcacaagctataacatgcactgggtaaaacaaacaccaagacaaggactagaatggataggagcaatatatccaggaaacggagacacaagctataaccaaaaatttaaaggaaaagcaacactaacagtagacaaaagctcaagcacagcatatatgcaactatcaagcctaacatcagaagatagcgcagtatatttctgtgcaagaggaagactatcactaggattcgattactggggacaaggatcaacattaacagtaagctca

SEQ ID NO: 49990 - RNA, 357 nt, synthetic construct
  misc_feature 1..357: note = derived and/or modified sequence opt6 from anti-HIV_Chain
  source 1..357: mol_type = other RNA
caagtacaattagtacaaagcggaacagcagtaaaaagaccaggagcaagcgtaagagtaagctgtcaagcaagcggatacacattcatagaccatttcatatactggtggagacaagcgccaggacaaggactagaatggttaggatggataaatccattaacatcacaaccaagctatccatcaagatttcaaggaagattaacattaacaagagacacattcgatgaaatgctatatatggatttaagaggattaagatcagacgatacaggaatatatttctgtgcaagaagacatagtgattactgtgactttgacatatggggaagcggaacacaaataatagtatcaagt

SEQ ID NO: 49991 - RNA, 357 nt, synthetic construct
  misc_feature 1..357: note = derived and/or modified sequence opt6 from anti-HIV_Chain
  source 1..357: mol_type = other RNA
caagtacaattagtacaaagcggaacagcagtaaaaagaccaggagcaagcgtaagagtaagctgtcaagcaagcggatatacattcacagactatttcatatactggtggagacaagcaccaggacaaggactagaatggttaggatggataaatccattaacatcacaaccaagctatccatcaagatttcaagggagattaacattaacaagagacacatttgatgaaatgctatatatggatttaagaggattaagatcagacgatacaggaatatatttctgtgcaagaagacatagcgattactgtgactttgacatatggggaagcggaacacaaataatagtatcaagt

SEQ ID NO: 49992 - RNA, 357 nt, synthetic construct
  misc_feature 1..357: note = derived and/or modified sequence opt6 from anti-HIV_Chain
  source 1..357: mol_type = other RNA
caatcagtactaacacaaccaagatcagtatcaggatcaccaggacaatcagtaacaatatcatgcacaggaacatcatcagacgtaggaggatacaactacgtatcatggtaccaacaacacccaggaaaagcaccaaaaacaatgatattcgacgtaacaaaaagaccatcaggagtaccagacagattctcaggatccaaatcaggaaacacagcatcactaacaatatcaggactacaagcagaagacgaagcagactactactgctcatcatacgcaggaagaaacacattctacgtattcggaacaggaacaacagtaacagtacaagtatcaccatcacaaccaccacca

SEQ ID NO: 49993 - RNA, 357 nt, synthetic construct
  misc_feature 1..357: note = derived and/or modified sequence opt6 from anti-HIV_Chain
  source 1..357: mol_type = other RNA
gaaatagtactaacacaatcaccaggaacattatcactatcaccaggagaaagagcaacactatcatgcagagcaagccaatcagtatcatcaaactacctagcatggtatcaacaaaaaccaggacaagcaccacgactactaatatacggagcatcatccagagcaacaggaataccagacagattctcaggatcaggatcaggaacagacttcacactatcaatatcaagactagaaccagaagacttcgcagtatactactgccaacaatacggaacatcatcatgcacattcggacaaggaacaaaattagaaataaaaagaacagtagcagcaccatcagtattcatattc

SEQ ID NO: 49994 - RNA, 357 nt, synthetic construct
  misc_feature 1..357: note = derived and/or modified sequence opt6 from anti-HIV_Chain
  source 1..357: mol_type = other RNA
ttatcagcatcagtaggagaccgagtaacaataacatgcagagcatcacaatcaatagacagatacctaaactggtaccaacaaaaaccaggaaaagcaccaaaactactaatatacgcagcatcatcactacacacagacgtaccatcaagattctcaggatcaggagcaggaacatacttcacactaacaataacatcactacaaccagaagacttcgcaacatactactgccaacaatcacactcaccatcattcggacaagaatcatactcaataacattcggacaaggaacaagactagaaataaaaagaacagtagcagcaccatcagtattcatattcccaccatcagac

SEQ ID NO: 49995 - RNA, 357 nt, synthetic construct
  misc_feature 1..357: note = derived and/or modified sequence opt6 from anti-HIV_Chain
  source 1..357: mol_type = other RNA
aatttcatgttaacacaagcaccatcagcatcaggagcaccaggacaaagagtaacaatatcatgctcaggaggaccatcaaacgtaggaggaaactacgtatactggtacagacaatacccaggaacagcaccaaaactactaatactaagagacgatcaaagaccatcaggagtaccagacagattctcagcatcaaaatcaggaaactcagcatcactagcaatatcagaactaagaccagacgacgaagcattctacttctgtgcaacatacgactcagacggatcaataagactattcggaggaggaacagcactaacagtactatcacaaccaaaagcagcaccatcagta

SEQ ID NO: 49996 - RNA, 360 nt, synthetic construct
  misc_feature 1..360: note = derived and/or modified sequence opt6 from anti-HIV_Chain
  source 1..360: mol_type = other RNA
gacatacaaatgacacaatcaccatcatcactatcagcatcaataggagacagagtaaacataacatgccaagcatcaagagacacaggatcagcactaaactggtaccaacaaaaagtaggaagaccaccaagactactaatatcagcagtatcaaacctaggagcaggagtaccatcaagattctcaggaagaagatcaggaacacaatcaacactaacaataaacaccctacaaccagaagacatagcaacatacttctgccaacactacgaattcttcggaccaggaacaaaagtagacataaaaagaacagtagcagcaccatcagtattcatattcccaccatcagacgaacaa

SEQ ID NO: 49997 - RNA, 360 nt, synthetic construct
  misc_feature 1..360: note = derived and/or modified sequence opt6 from anti-HIV_Chain
  source 1..360: mol_type = other RNA
caatcagtactaacacaaccagcatcagtatcaggatcaccaggacaatcaataacaatatcatgcacaggaacatcaaacgacgtaggaggacaaaacttcgtatcatggtaccaacaacacccaggaacagcaccacaactactaatatacgacgtaacaaacagaccagcaggagtatcatcaagattctcaggatcaaaatcaggaaacacagcatcactaacaatatcaggactaagaacagaagacgaagcagactactactgcgcatcattcacaatattaaacggagtagactacgtattcggaacaggaacaaaagtaacagtactactatcaccatcacaaccataccta

SEQ ID NO: 49998 - RNA, 360 nt, synthetic construct
  misc_feature 1..360: note = derived and/or modified sequence opt6 from anti-HIV_Chain
  source 1..360: mol_type = other RNA
aacttcatgctaacacaaccagcatcagtatcaggatcaccaggacaatcaataacactatcatgcacaggaacaacatcagacgtacgagactcaaacttcgtatcatggtaccaacaagtaccaggaaaagcaccaaaactaataatatacgacgtatcagcaagaccatcaggagtatcattcagattctcaggatcaaaatcaggaaacacagcatcactaacaatatcaggactacaagcagaagacgaagcactatactactgctcatcattcacaccaacaaacacactagtattcggaggaggaacaaaactaacagtactaggacaaccaaaagcagcaccatcagtaaca

SEQ ID NO: 49999 - RNA, 360 nt, synthetic construct
  misc_feature 1..360: note = derived and/or modified sequence opt6 from anti-HIV_Chain
  source 1..360: mol_type = other RNA
caatcagcactaacacaaccaccagcagcatcaggagcaccaggacaaagagtaacaatatcatgctcaggaggaggatcaaacgtaggaggaaacctagtatcatggtatcaacaattcccaggagcagcaccaaaactaatattacacagagacggccaaagaccatcaggagtaccagacagattttcagcatcaaaatcaggaacatcagcatcattaacaatatcaggactaagatcagacgacgaagcaacatatttctgcgcagcatacgactcagcagtatcactaccagtattcggaggaggaacaaaactaacagtactatcacaaccaaaagcagcaccattagtaaca

SEQ ID NO: 50000 - RNA, 360 nt, synthetic construct
  misc_feature 1..360: note = derived and/or modified sequence opt6 from anti-HIV_Chain
  source 1..360: mol_type = other RNA
caattagtactaacacaaccaccatcagtatcaggaacaccaggacaaaacgtaacaatatcatgctccggaggaggatctcacgtaggaggaaacctagtatcatggtaccaacatttcccaggagcagcaccaaaactactaatacacagagacaatcaacgaccatcaggagtaccagacagattctcagcactaaaatcaggaaactcagcatcactagcaatatcaggactaagatcagacgacgaagcattctacttctgcgcagtatacgactcatcactatcactaggactattcggaggaggaacaaaactaacagtattatcacaaccaaaagcagcaccatcagtaaca

SEQ ID NO: 50001 - RNA, 360 nt, synthetic construct
  misc_feature 1..360: note = derived and/or modified sequence opt6 from anti-HIV_Chain
  source 1..360: mol_type = other RNA
gatatacaaatgacacaatcaccatcaagtttaagcgcaagcgtaggagatagagtaagcatacactgtcaagcaggacaaggaataggatcaagtttaaaatggtaccaacaaaaaagcggaagagcaccaagactattagtacatggagcaagtaatctacaaagaggagtaccaagcagattctcaggatcaggatttcacacaacatttacattaacaataagctcactacaaccagatgacgtagcaacatactggtgcgcagtattagaatttttcggaccaggaacaaaagtagaaataaaaagaacagtagcagcaccaagtgtattcatattcccaccatcagacgaacaa

SEQ ID NO: 50002 - RNA, 360 nt, synthetic construct
  misc_feature 1..360: note = derived and/or modified sequence opt6 from anti-HIV_Chain
  source 1..360: mol_type = other RNA
gacatacaaatgacacaatcaccatcatcactatcagcatcagtaggagacagagtaacaataacatgccaagcatcacaaggaataggatcatcactacaatggtaccaacaaaaaccaggaagagcaccaaaactactagtacacggagcatcaaacctacacagaggagtaccatcaagattctcaggatcaggattccacacatcattcacactaacaatatcctcactacaaccagacgacgtagcaacatacttctgcgcagtactagaattcttcggaccaggaacaaaagtagaaataaaaagaacagtagcagcaccatcagtattcatattcccaccatcagatgaacaa

SEQ ID NO: 50003 - RNA, 360 nt, synthetic construct
  misc_feature 1..360: note = derived and/or modified sequence opt6 from anti-HIV_Chain
  source 1..360: mol_type = other RNA
gatatacaaatgacacaatcaccaagcagcttaagcgcaagcgtaggcgatagagtaagcataaactgtcaagcaggacaaggaataggaagctcattaaactggtaccaacaaaaacgaggaaaagcaccaaaactattagtacatggagcaagcacactacaaagaggagtaccaagcagattctcaggatcaggatttcacacaacatttacattaacaataagctcactacaaccagatgacgtagcaacatacttttgcgaatcatttcaatggttcggaccaggaacaaaagtagaaataaaaagaacagtagcagcaccatcagtattcatattcccaccatcagacgaacaa

SEQ ID NO: 50004 - RNA, 360 nt, synthetic construct
  misc_feature 1..360: note = derived and/or modified sequence opt6 from anti-HIV_Chain
  source 1..360: mol_type = other RNA
tacatacaaatgacacaatcaccatcatcactatcagcatcaataggagacagagtaacaataacatgccaagcaggacaaggaataggatcatcactaaactggtaccaacaaaaaccaggaaaagcaccaaaactactagtacacggagcatcaaacctacaaagaggagtatcatcaagattctcaggatcaggattccacacaacattcacactaacaatatcatcactaagaccagaagacgtaggaacatacttctgcgaagtatacgaattcataggaccaggaacaaaagtagacataaaaagaacagtagccgcaccatcagtattcatattcccaccatcagacgaacaa

SEQ ID NO: 50005 - RNA, 360 nt, synthetic construct
  misc_feature 1..360: note = derived and/or modified sequence opt6 from anti-HIV_Chain
  source 1..360: mol_type = other RNA
gacatacaaatgacacaatcaccatcatcactaccagcatcagtaggagacacagtaacaataacatgccaagcaggacaaggaataggatcatcactacaatggtaccaacaaagaccaggaagagcaccaaacctactagtatacgacgcatcaaacctacaaagaggagtaccatcaagattcacaggaacaggattccacacaacattcacactaacaataagaggactaagaccagaagacttcggaacatacttctgcgcatcactagaattcttcggaccaggaacaaaagtagacataaaaagaacagtagcagcaccatcagtattcatattcccaccatcagacgaacaa

SEQ ID NO: 50006 - RNA, 360 nt, synthetic construct
  misc_feature 1..360: note = derived and/or modified sequence opt6 from anti-HIV_Chain
  source 1..360: mol_type = other RNA
gacatacaaatgacacaatcaccatcatcactatcagcatcagtaggagacagagtaacaataacatgccaagcatcacaaggaataggatcatcactacaatggtaccaacaaaaaccaggaagagcaccaaacctactagtacacggagcatctaacctacacagaggagtaccatcaagattctcaggatcaggattccacacaacattctcactaacaatatcaggactacaaagagacgacttcgcaacatacttctgcgcagtactagaattcttcggaccaggaacaaaagtcgacataaaaagaacagtagcagcaccatcagtattcatattcccaccatcagacgaacaa

SEQ ID NO: 50007 - RNA, 360 nt, synthetic construct
  misc_feature 1..360: note = derived and/or modified sequence opt6 from anti-HIV_Chain
  source 1..360: mol_type = other RNA
gacatacaaatgacacaatcaccatcatcactatcagtatcagtaggagacagagtatcaataacatgcagagcaacacaaggaataggaaactcactaaactggtaccaacaaaaaccaggaaaagcaccaaaagtactaatatacggaacaacaaaactacacggaggagtaccatcaagattctcaggaggaggatcaggatcaacaggaacactaacaatagactcactacaaccagaagacatagcaacatacttctgccaactattcgaattcttcggaccaggaacaaaagtagaaataaaaagaacagtagcagcaccaagcgtattcatattcccaccatcagacgaacaa

SEQ ID NO: 50008 - RNA, 360 nt, synthetic construct
  misc_feature 1..360: note = derived and/or modified sequence opt6 from anti-HIV_Chain
  source 1..360: mol_type = other RNA
gacatacaaatgacacaatcaccatcatcactatcagcatcagtaggagacagagtaacaataacatgccaagcaggacaaggaataggatcatcactaaactggtaccaacaaaaaccaggaagagcaccaaaactactagtatacggagcatcaaacttacaaagaggagtaccatcaagattctcaggatcaggattccacacaacattcacactaacaatatcatcactacaaccagaagacttcgcaacatacttttgctccgtatacgaattcctaggaccaggaacaaaagtagaaataaaaagaacagtagcagcaccatcagtattcatattcccaccatcagacgaacaa

SEQ ID NO: 50009 - RNA, 360 nt, synthetic construct
  misc_feature 1..360: note = derived and/or modified sequence opt6 from anti-HIV_Chain
  source 1..360: mol_type = other RNA
ccaatgtttcaaccaggacaaagtggaggagtagtagtacaaagtggagaaagtttacatttaagttgtgaagcaagtggatttaaatttgcaagtcaaatgatgcattgggtaagacatgtaccaggaagaggactagaatgggtagcattaataagttgggatggaagcggaaaattatttgcagatagtgtaagaggaagatttacaatacatagatggaatgatagaaatagtttatatttagatgtaaaaaatgtaagaccagaagatgcagcaatatattattgtacaagaaatggatttgatgtatggggacaaggaatactagtaacagtaagcagtgcaagtacaaaagga

SEQ ID NO: 50010 - RNA, 363 nt, synthetic construct
  misc_feature 1..363: note = derived and/or modified sequence opt6 from anti-HIV_HeavyChain
  source 1..363: mol_type = other RNA
gaagtaaaattagtagaaagcggaggaggattagtacaaccaggaggaagtttaagattaagttgtgcagcaagcggattcacattcagctcatttggaatgcactgggtaagacaagcaccagaaaaaggactagaatgggtagcatatatatcaagcggaagctcaacattacactatgcagatacagtaaaaggaagatttacaataagcagagacaatagcaaaaactcactatatctacaaatgaatctattaagagcagaagatacagcagtatattactgtgcaagaggatcacgaaatttatcacacagattattaagctattggggacaaggaacattagtaacagtatcaagc

SEQ ID NO: 50011 - RNA, 363 nt, synthetic construct
  misc_feature 1..363: note = derived and/or modified sequence opt6 from anti-HIV_HeavyChain
  source 1..363: mol_type = other RNA
gaagtacaattagtagaaagtggaggaggattagtacaaccaggaggaagtttaagattaagttgtgcagcaagtggatttacatttagtagttttggaatgcattgggtaagacaagcaccaggaaaaggattagaatgggtaagttatataagtagtggaagttcaacattacattatgcagatacagtaaaaggaagatttacaataagtagagataatagtaaaaattcactatatttacaaatgaatagtttaagagcagaagatacagcagtatattattgtgcaagaggaagtagaaatttaagccatagattattaagttattggggacaaggaacattagtaacagtaagtagt

SEQ ID NO: 50012 - RNA, 363 nt, synthetic construct
  misc_feature 1..363: note = derived and/or modified sequence opt6 from anti-HIV_Chain
  source 1..363: mol_type = other RNA
gacatacaaatgacacaatcaccatcatcactatcagcatcagtaggagacagagtaacaataacatgccaagcatcacaaggaatatcaaactcactaaactggtaccaacaaaaaccaggaaaagcaccaagactattaatatacggaacaagcacactacaaagaggagtaccatcaagattctcaggatcaggatcaggaacaagattcacagtaacaataaactcactacaaccagaagacatagcaacatacttctgccaacacaacgaattcttcggaagaggaacaaaagtagacataaaaagaacagtagcagcaccatcagtattcatattcccaccatcagacgaacaacta

SEQ ID NO: 50013 - RNA, 363 nt, synthetic construct
  misc_feature 1..363: note = derived and/or modified sequence opt6 from anti-HIV_Chain
  source 1..363: mol_type = other RNA
gacatacaaatgacacaatcaccatcatcagtatcagcatcagtaggagacagagtaacaataacatgccaagcatcaagagacacagacaactcactaacatggtaccaacaaaaaccaggaagaccaccaaaactactaatataccacgtagtaaacttaggaccaggagtaccatcaagattctcaggatcagcatcatcagcaacacaatcaacactaataatatcagacttccaaccagacgacgtagcaacatacttctgccaaaactacgaattcttcggaccaggaacaaaagtagaaataaaaagaacagtagcagcaccatcagtattcatattcccaccatcagacgaacaa

SEQ ID NO: 50014 - RNA, 363 nt, synthetic construct
  misc_feature 1..363: note = derived and/or modified sequence opt6 from anti-HIV_Chain
  source 1..363: mol_type = other RNA
gaaatagtactaacacaatcaccaggaacactatcactatcaccaggagaaagagcaacattatcatgcagagcatcacaatcagtatcatcaaacaacctagcatggtaccaacaaaaaccaggacaagcaccaagactactaatgtcaggagcatcatcaagagcaacaggaataccagacagattctcaggatcaggatcaggaacagacttcacactaacaatatcaagactagaaccagaagacttcgcagtataccactgccaacaatacggatcaagcccaccaacattcggacaaggaacaaaagtagaaataaaaagaacagtagcagcaccatcagtattcatattcccacca

SEQ ID NO: 50015 - RNA, 363 nt, synthetic construct
  misc_feature 1..363: note = derived and/or modified sequence opt6 from anti-HIV_Chain
  source 1..363: mol_type = other RNA
gacatacaaatgacacaatcaccatcatcactatcagcatacgtaggagacagagtaacaataacatgcagagcatcacaaaacataaacacatacctaaactggtaccaacaaagaccaggaaaagcaccaaaactactaatatacgcagcatcaacactacaatcaggagtaccatcaagattctcaggatcaggatcaggaacagacttcacactaacaatatcaaacctagaaacagaagacttcgcagtatactactgccaacaaacatacagatcagtaacattcggacaaggaacaaaactagaaataaaaagaacagtagcagcaccatcagtattcatattcccaccatcagac

SEQ ID NO: 50016 - RNA, 363 nt, synthetic construct
  misc_feature 1..363: note = derived and/or modified sequence opt6 from anti-HIV_Chain
  source 1..363: mol_type = other RNA
gacatacaaatgacacaatcaccatcatcactatccgcatcagtaggagacagagtaacaataacatgccaagcaggacaaggaataggatcatcacttcaatggtaccaacaaaaaccaggaaaagcaccaaaactattagtacacggagcatcaaacttacaccgaggagtaccatcaagattctcaggatcaggattccacacaacattctcactaacaatatcaggactacaaagagacgacttcgcaacatacttctgcgcagtagtagaatttttcggaccaggaacaaaagtagacataaaaagaacagtagcagcaccatcagtattcatattcccaccatcagacgaacaacta

SEQ ID NO: 50017 - RNA, 363 nt, synthetic construct
  misc_feature 1..363: note = derived and/or modified sequence opt6 from anti-HIV_Chain
  source 1..363: mol_type = other RNA
caagtacaattagtagaaagcggagcagaactaagaaaaccaggagaaagtttagaaataagttgtaaagcaagtggatactcgttctcaagccattggataggatgggcaagacaaatgccaggaaaaggactagaatggatgggaataatatatccaggagactcaaacacaatatatagcccaagttttcaaggacaagtaacaataagcgcagacaaaagcataaacacagcatatctacaatggtcaagcctaaaagcaagcgatacagcaatgtatttctgtgcatcaaactatcacgattacttttactggggacaaggaacattagtaacagtaagctcagcatcaacaaaagga

SEQ ID NO: 50018 - RNA, 363 nt, synthetic construct
  misc_feature 1..363: note = derived and/or modified sequence opt6 from anti-HIV_Chain
  source 1..363: mol_type = other RNA
tttgtacaattagtagaaagtggaggaggagtagtacaaccaggaacaagtttaagattaagttgtacaacaagtggatttatatttagtgattatggaatgcattgggtaagacaagcagcaggaaaaggattagaatgggtagcagtaatatggcatgatggaagtaatagattttatgcagatagtgtaaaaggaagatttacaataagtagagataatagtaaaaatgcagtatatttagaaatgaataatctaagagtagaagatacagcattatattattgtgcaagaacaagtatggatatagattattggggacaaggaacaccagtgacagtaagtagtgcaagtacaaaagga

SEQ ID NO: 50019 - RNA, 363 nt, synthetic construct
  misc_feature 1..363: note = derived and/or modified sequence opt6 from anti-HIV_Chain
  source 1..363: mol_type = other RNA
gaaccaatgtttcaaccaggacaaagtggaggagtagtagtacaaagtggagaaagtttacatttaagttgtgaagcaagtggatttaaatttgcaagtcaaatgatgcattgggtaagacatgtaccaggaagaggattagaatgggtagcattaataagttgggatggaagtggaaaattatttgcagatagtgtaagaggaagatttacaatacatagatggaatgatagaaatagtttatatttagatgtaaaaaatgtaagaccagaagatgcagcaatatattattgtacaagaaatggatttgatgtatggggacaaggaatattagtaacagtaagtagtgcaagtacaaaagga

SEQ ID NO: 50020 - RNA, 366 nt, synthetic construct
  misc_feature 1..366: note = derived and/or modified sequence opt6 from anti-HIV_Chain
  source 1..366: mol_type = other RNA
agccaacatttagtacaaagtggaacacaagtaaaaaaaccaggagcaagtgtaagaatatcatgtcaagcaagtggatatagttttacagattatgtattacattggtggagacaagcaccaggacaaggattagaatggatgggatggataaaaccagtatatggagcaagaaattatgcaagaagatttcaaggaagaataaattttgatagagatatatatagagaaatagcatttatggacttaagtggattaagaagtgatgatacagcattatatttttgtgcaagagatggaagtggagatgatacaagttggcatttagatccatggggacaaggaacattagtaatagtaagtgca

SEQ ID NO: 50021 - RNA, 366 nt, synthetic construct
  misc_feature 1..366: note = derived and/or modified sequence opt6 from anti-HIV_Chain
  source 1..366: mol_type = other RNA
gacatacaaatgacacaatcaccatcatcactatcagcatcagtaggagacagagtaacaataacatgcagagcatcacaatcaatatccagatacctaaactggtaccaacaaaaaccaggaaaagcaccaaaactactaatatacgcagcatcatcactacaaggaggagtaccatcaagattctcaggatcaggatcaggaacagacttcacactaacaatatcatcactacaaccagaagacttcgcaacatactactgccaacaatcatcatcaaaaccattcacattcggaggaggaacaaaagtagaaataaaaagaacagtagcagcaccatcagtattcatattcccaccatcagac

SEQ ID NO: 50022 - RNA, 366 nt, synthetic construct
  misc_feature 1..366: note = derived and/or modified sequence opt6 from anti-HIV_Chain
  source 1..366: mol_type = other RNA
gaaatagtactaacacaatcaccaggaacactatcactatcaccaggagaaagagcaacactatcatgcagagcatcacaatcaatatcatcaaactacctagcatggtaccaacaaaaaccaggacaagcaccaagactactaatatacggagcatcaacaagagcaacaggaataccagacagattctcaggatcaggatcaggaacagacttcacactatcaatatcaagactagaaccagaagacatagcagtatactactgccaccaatacggatcatcacaaagattcggacaaggaacaaaagtagaaataaaaagaacagtagcagcaccatcagtattcatattcccaccatcagac

SEQ ID NO: 50023 - RNA, 366 nt, synthetic construct
  misc_feature 1..366: note = derived and/or modified sequence opt6 from anti-HIV_Chain
  source 1..366: mol_type = other RNA
gaaatagtaatgacacaatcaccagcaacactatcagtatcaccaggagacagagcaacactatcatgcagagcatcacaatcagtatcaacaaacctagcatggtaccaacaaaaaccaggacaagcaccaagactactaatatacggagcatcaacaagagcaacaggaataccagcaacattctcaggatcaggattcgcaacagaattcacactaacaatatcatcactacaatcagaagacttcgcagtatactactgccaacaatataacaactggccaccagcattcggacaaggaacaaaagtagaaataaaaagaacagtagcagcaccatcagtattcatattcccaccatcagat

SEQ ID NO: 50024 - RNA, 366 nt, synthetic construct
  misc_feature 1..366: note = derived and/or modified sequence opt6 from anti-HIV_Chain
  source 1..366: mol_type = other RNA
gacatacaaatgacacaatcaccagcatcactatcagcatcagtaggagacagagtaacaataacatgcagagcatcacaaggaatatcacactacctagcatggtaccaacaaaaaccaggaaaagtaccaagactactaatatacgcagcatccagactacaatcaggagtaacatcaagattctcaggatcaggatcaggcacagaattcacactaacaatatcatcactactaccagaagacgcagcagtatacttctgccaaaaatacgacacagacccaatgacattcggacaaggaacaagattagaaataaaaagaacagtagcagcaccatcagtattcatattcccaccatcagac

SEQ ID NO: 50025 - RNA, 366 nt, synthetic construct
  misc_feature 1..366: note = derived and/or modified sequence opt6 from anti-HIV_Chain
  source 1..366: mol_type = other RNA
caatcagcactaactcaaccaccatcagcatcaggcgcaccaggacaaagagtaacaatatcatgctcaggaggaccatcaaacgtaggaggaaactatgtatactggtacagacaatttccaggaacagcaccaaacttactaatactaagagacgaccaaagaccatcaggagtaccagacagattctcagcatcaaaatcaggaaactcagcatcactagcaatatcaggactaagaccagacgacgaagcattctacttctgtgcaacatacgactcagacggatcaataagactattcggaggaggaacaacactaacagtactatcacaaccaaaagcagcaccatcagtaacattattc

SEQ ID NO: 50026 - RNA, 366 nt, synthetic construct
  misc_feature 1..366: note = derived and/or modified sequence opt6 from anti-HIV_Chain
  source 1..366: mol_type = other RNA
gacatacaaatgacacaatcaccatcatcactatcagcatcagtaggagacagagtaacaataaactgccaagcaggacaaggaataggatcatcactaaactggtaccaaaaaaaaccaggaagagcaccaaaactactagtacacggagcatcaaacctacaaagaggagtaccatcaagattctcaggatcaggattccacacaacattcacactaacaatatcatcactacaaccagacgacgtagcaacatacttctgcgcagtattccaatggttcggaccaggaacaaaagtagacataaaaagaacagtagcagcaccatcagtattcatattcccaccatcagacgaacaactaaaa

SEQ ID NO: 50027 - RNA, 366 nt, synthetic construct
  misc_feature 1..366: note = derived and/or modified sequence opt6 from anti-HIV_Chain
  source 1..366: mol_type = other RNA
gacatacaaatgacacaatcaccatcatcactatcagcatcagtaggagacagagtaacaataacctgccaagcatcacaaggaataggatcatcactacaatggtaccaacaaaaaccaggaagagcaccaaacctattagtacacggagcatcaaaactacacagaggagtaccatcaagattctcaggatcaggattccacacaacattctcactaacaatatccggactacaaagagacgacttcgcaacatacttctgcgcagtactagaattcttcggaccaggaacaaaagtagaaataaaaagaacagtagcagcaccatcagtattcatattcccaccatcagacgaacaactaaaa

SEQ ID NO: 50028 - RNA, 366 nt, synthetic construct
  misc_feature 1..366: note = derived and/or modified sequence opt6 from anti-HIV_Chain
  source 1..366: mol_type = other RNA
caagtacatctagtacaatcaggagcagaagtaaaaaaaccaggagcaagtgtaaaagtaagttgcaaagtatcaggatatacattaagtgaactaagcatacattgggtaagacaaggaccaggaagaggattagaatggatggcaaactttgacccagaagatggagaaacaatatacgcaccacaattccaaggaagagtaacactaacagaagatacatcaacagatacagcatacatgcaattaacatcactaagaagcgaagacacagcagtatactattgcgcaacagatagatatacagatacaggaagatggggaccaggaacactagtaacagtaagctcagcatcaacaaaagga

SEQ ID NO: 50029 - RNA, 366 nt, synthetic construct
  misc_feature 1..366: note = derived and/or modified sequence opt6 from anti-HIV_Chain
  source 1..366: mol_type = other RNA
caagtacaattagtagaaagtggagggggattaatacaaccaggaggaagtttaagattaagctgtgaagcaagtggatttgcagtaggagatataaattatatgagttgggtaagacaagcaccaggaaaaggattagaatgggtaagtgtattatatagtggaggaagtagtcaatatgcagatagtgtaaaaggaagatttacaataagtagagataatagtagaaatacattatatttacaaatggataatttaagagcagaagatacagcagtatattattgtgcaagaggattaagagtatattttgatttatggggacaaggaatattagtaacagtaagtagtgcaagtacaaaagga

SEQ ID NO: 50030 - RNA, 366 nt, synthetic construct
  misc_feature 1..366: note = derived and/or modified sequence opt6 from anti-HIV_Chain
  source 1..366: mol_type = other RNA
caagtacaaatggtagcaagcggaggaggattagtaaaaccaggaggatcattaagattaagttgtgaagcatcaggatttacatttagtgattattatatgagttgggtaagacaagcaccaggaaaaggattagaatggatatcatatataacaagcggaggaaatgcattatattatgcagatagtgtaaaaggaagatttacaataagtagagataatgcaaaaaatagtttatatctacaaatgaatagtctaagagcagaagatacagcagtatattattgtgcaagagatttattacatgcacatgattttggaagacaaggaacattagtaacagtaagttcagcaagtacaaaagga

SEQ ID NO: 50031 - RNA, 366 nt, synthetic construct
  misc_feature 1..366: note = derived and/or modified sequence opt6 from anti-HIV_Chain
  source 1..366: mol_type = other RNA
caactacaattagtagaatcaggaggaggagtagtacaaccaggaagatcgctaagactatcatgcgcagcatcaggatttacatttagtacatacacaatgcattgggtaagacaagcaccaggaaaaggattagaatgggtagcagtaataagttatgacggaacaaataaatattacgcagactcagtaaaaggaagattcacaatatcaagagataacagcaaaaatacattatacttacaaatgaactcactaagaggagaagacacagcagtatactattgcgcaagatcaccatcatactatttcgattactggggacaaggaacattagtaacagtatcagcagcatcaacaaaagga

SEQ ID NO: 50032 - RNA, 369 nt, synthetic construct
  misc_feature 1..369: note = derived and/or modified sequence opt6 from anti-HIV_Chain
  source 1..369: mol_type = other RNA
caagtacatttaagtcaaagtggagcagcagtaacaaaaccaggagcaagtgtaagagtaagttgtgaagcaagtggatataaaatatcagatcattttatacattggtggagacaagcaccaggacaaggattacaatgggtaggatggataaatccaaaaacaggacaaccaaataatccaagacaatttcaaggaagagtaagtttaacaagacaagcaagttgggattttgatacatattcattttatatggatttaaaagcagtaagatcagatgatacagcaatatatttttgtgcaagacaaagaagtgatttttgggattttgatgtatggggaagtggaacacaagtaacagtatcaagt

SEQ ID NO: 50033 - RNA, 369 nt, synthetic construct
  misc_feature 1..369: note = derived and/or modified sequence opt6 from anti-HIV_Chain
  source 1..369: mol_type = other RNA
caagtacaactattacaatcaggagcagtagtaacaaaaccaggagcatcagtaagagtatcatgtgaagcatcaggatataaaataagagattactttatacattggtggagacaagcaccaggacaaggattacaatgggtaggatggataaacccacaaacaggacaaccaaatataccaagaccatttcaaggaagagtaacactaacaagacatgcatcatgggattttgatacatttagcttttatatggacttaaaagcattaagatcagatgacacagcaatatatttttgtgcaagaagaagaagtgactattgtgatttcgatgtatggggatcaggaacacacgtaacagtatcatca

SEQ ID NO: 50034 - RNA, 369 nt, synthetic construct
  misc_feature 1..369: note = derived and/or modified sequence opt6 from anti-HIV_Chain
  source 1..369: mol_type = other RNA
caagtacaattattacaaagtggagcagcagtaacaaaaccaggagcaagtgtaagagtaagttgtgaagcaagtggatataatataagggattattttatacattggtggagacaagcaccaggacaaggattacaatgggtaggatggataaatccaaaaacaggacaaccaaataatccaagacaatttcaaggaagagtaagtttaacaagacatgcaagttgggattttgatacatttagtttttatatggatttaaaaggattaagaagtgatgatacagcaatatatttttgtgcaagacaaagaagtgattattgggattttgatgtatggggaagtggaacacaagtaacagtaagtagt

SEQ ID NO: 50035 - RNA, 369 nt, synthetic construct
  misc_feature 1..369: note = derived and/or modified sequence opt6 from anti-HIV_Chain
  source 1..369: mol_type = other RNA
caagtacaattactacaaagtggagcagcagtaacaaaaccaggagcaagcgtaagagtaagttgtgaagcaagtggatataatataagagattattttatacattggtggagacaagcaccaggacaaggattacaatgggtaggatggataaatccaaaaacaggacaaccaaataatccaagattatttcaaggaagagtaagtttaacaagacatgcaagttgggattttgatacattttcattttatatggacttaaaagcagtaagatcagatgatacagcagtatatttttgtgcaagacaaagatcagattattgggattttgatgtatggggaagtggaacacaagtaacagtatcaagt

SEQ ID NO: 50036 - RNA, 369 nt, synthetic construct
  misc_feature 1..369: note = derived and/or modified sequence opt6 from anti-HIV_Chain
  source 1..369: mol_type = other RNA
caagtaagattattacaaagcggagcagcagtaacaaaaccaggagcaagtgtaagagtaagttgtgaagcaagtggatatgaaataagagattattttatacattggtggagacaagcaccaggacaaggattacaatgggtaggatggataaatccaaaaacaggacaaccaaataatccaagacaatttcaaggaagagtaagtttaacaagacaagcaagttgggattttgatagttatagtttttatatggatttaaaagcattaagaagtgatgatacaggagtatatttttgtgcaagacaaagaagtgattattgggattttgatgtatggggaagtggaacacaagtaacagtaagtagt

SEQ ID NO: 50037 - RNA, 369 nt, synthetic construct
  misc_feature 1..369: note = derived and/or modified sequence opt6 from anti-HIV_Chain
  source 1..369: mol_type = other RNA
caagtacaattattacaaagtggagcagcagtaacaaaaccaggagcatcagtaagagtaagttgtgaagcaagtggatataatataagagattattttatacattggtggagacaagcaccaggacaaggattacaatgggtaggatggataaatccaaaaacaggacaaccaaataatccaagacaatttcaaggaagagtatcattaacaagacatgcaagttgggattttgatacatttagtttttatatggatttaaaagcattaagaagtgatgatacagcagtatatttttgtgcaagacaaagatcagattattgggattttgatgtatggggaagtggaacacaagtaacagtaagcagt

SEQ ID NO: 50038 - RNA, 369 nt, synthetic construct
  misc_feature 1..369: note = derived and/or modified sequence opt6 from anti-HIV_Chain
  source 1..369: mol_type = other RNA
gaagtacaattagtagaaagtggaggaggattaatacaaagaggaggaagtttaagattaagttgtgtagcaagtggatttccagtaagtgataatcatatgagttgggtaagacaagcaccaggaaaaggactagaatgggtaagtataatatatagtgatggaggaacatattatgcagattcagtaaaaggaagatttacaataagtagagataatagtaaaaatacagtatatttacaaatgaatagtttaagagcaacagatacagcagtatattattgtgcaagagatccaggatttcattatggattagatgtatggggacaaggaacaacagtaacagtaagtagtgcatcaacaaaagga

SEQ ID NO: 50039 - RNA, 369 nt, synthetic construct
  misc_feature 1..369: note = derived and/or modified sequence opt6 from anti-HIV_Chain
  source 1..369: mol_type = other RNA
caagtacaattacaagaaagtggaccaggattattaagaccgttagaaacattaagtttaacatgtagcgtaagtggaggaagtataagaggatatttttggagttgggtaagacaaccagcaggaagaggattagaatggataggaagaatatatagtagtggaacaacaagatttaatccaagtttaaaaagtagagtaagattaagcatagatacagcaaaaagtgaagtaagtttaaatataacaagtgtaacagcagcagatagtgcaagttatttttgtgcaggaacaagtccagtacatggaggattagatttatggggattaggattaagagtaacagtaagtagtgcaagtacaaaagga

SEQ ID NO: 50040 - RNA, 369 nt, synthetic construct
  misc_feature 1..369: note = derived and/or modified sequence opt6 from anti-HIV_Chain
  source 1..369: mol_type = other RNA
gaaatagtactaacacaatcaccaggaacattaagtttaagcccaggagaaagagcaacattaagctgtagagcaagccaaagcgtaagctcaaacctagcatggtacgcacaaaaaccaggacaagcaccaagactaataatatatggagcaagctcaagagcaagcgcaataccagacagattcagaggatcaggctcaggaacagactttacattaacaataagcagactagaaccagaagactttgcagtatactattgccaacaatatgacgatgcaccaataacattcggacacggaacaagactagaaataaaaagaacagtagcagcaccaagcgtattcatattcccaccatcagacgaa

SEQ ID NO: 50041 - RNA, 369 nt, synthetic construct
  misc_feature 1..369: note = derived and/or modified sequence opt6 from anti-HIV_Chain
  source 1..369: mol_type = other RNA
gaaatagtactaacacaatcaccaggaacactatcattatcaccaggagacagagcagcactaagctgtagagcatcagaaacattatcaggaaactcactagcatggtatcaacaaaaaagaggacaaccaccaagattactaatattcgcagcatcatcaagagcaacaggaataccagaaagattttcaggaggaggatcaggaacagatttcacactaacaataacaagattagaaccagaagatttcgcagtatatttctgtcaacaatacgtagacgcaccaataacatttggacaaggaacaagattagaaataaaaagaaccgtagccgcaccatcagtatttatatttccaccaagcgat

SEQ ID NO: 50042 - RNA, 369 nt, synthetic construct
  misc_feature 1..369: note = derived and/or modified sequence opt6 from anti-HIV_Chain
  source 1..369: mol_type = other RNA
gacatacaaatgacacaatcaccatcatcactatcagcatcagtaggagacagagtaacaataacatgtagagcatcacaagacataacaacatacctagcatggctacaacaaaaaccaggaaaagcaccaaaatcactaatatactcagcatcaacagtacaatcaggagtaccatcaagattctcaggatcaggatcaggaacagaattcacactaacaatatcaggactacaaccagaagacttcgcaacatactactgccaacaatacaactactacccaataacattcggactaggaacaagactagaaataaaaagaacagtagcagcaccatcagtattcatattcccaccatcagacgaa

SEQ ID NO: 50043 - RNA, 369 nt, synthetic construct
  misc_feature 1..369: note = derived and/or modified sequence opt6 from anti-HIV_Chain
  source 1..369: mol_type = other RNA
gacatacaaatgacacaatcaccatcatcactatcagcatcaataggagacagagtaacaataacatgcagagcaaaccaacacataagatcattcctaaactggtaccaacaaacaccaggaaaagcaccaaaattactaatatacgcagcatcaacactacaaagaggagtaccatcaagattctcaggatcaggatcaggaacagacttcacactaacaataacatcactagaaagagaagacctagcaacatactactgccaacaaacatacacatcaccaataacattcggacaaggaacaagactagaaataaaaagaacagtagcagccccatcagtattcatattcccaccatcagacgaa

SEQ ID NO: 50044 - RNA, 369 nt, synthetic construct
  misc_feature 1..369: note = derived and/or modified sequence opt6 from anti-HIV_Chain
  source 1..369: mol_type = other RNA
tcagaaatagtactaacacaatcaccagcaacactatcactatcaccaggcgaatcagcaacattatcatgcagagcatcacaatcactatcatcatcactagcatggtaccaacaaaaaccaggacaagcaccaagactactaatatacgacacatccgacagagcaacaggaataccagcaagattctcaggaagaggatcaggaacagacttcacactaacaatatcatcactagaaccagaagacttcgcagtatactactgccaacaaagatcaaactgggcaataacattcggacaaggaacaagattagaaataaaaagaacagtagcagcaccatcagtattcatattcccaccatcagac

SEQ ID NO: 50045 - RNA, 369 nt, synthetic construct
  misc_feature 1..369: note = derived and/or modified sequence opt6 from anti-HIV_Chain
  source 1..369: mol_type = other RNA
caagtactatcagtatcaggtacaccaggacaaagagtaataatatcatgctcaggaacaagctcaaacgtaggaggaaacttagtatcatggtatcaacatttaccaggagcagcaccaagattattaatacacagagacgatcaaagaccatcaggagtaccagatagatttagcggaagtaaaagcggaaactcagcaagcctagtaatatcaggactaagatcagacgatgaagcagactatttctgtgcagcatacgattcaacattctcactaccagtatttggaggaggaacaagattaacagtactatcacaaccaaaagcagcaccaagcgtaacattatacgcaccatcaagcgaagaa

SEQ ID NO: 50046 - RNA, 369 nt, synthetic construct
  misc_feature 1..369: note = derived and/or modified sequence opt6 from anti-HIV_Chain
  source 1..369: mol_type = other RNA
gacatacaaatgacacaatcaccatcatcactatcagcatcagtaggagacagagtaacaataacatgccaagcaggacaaggaataggatcatcattacaatggtaccaacaaaaaccaggaaaagcaccaaaactactagtacacggagcatcaaacctacacagaggagtaccatcaagattctcaggatcaggattccacacaacattctcactaacaatatcaggactacaaagagacgacttcgcaacatacttctgcgcagtactagaattcttcggaccaggaacaaaagtagaaataaaaagaacagtagcagcaccatcagtattcatattcccaccatcagacgaacaactaaaatca

SEQ ID NO: 50047 - RNA, 369 nt, synthetic construct
  misc_feature 1..369: note = derived and/or modified sequence opt6 from anti-HIV_Chain
  source 1..369: mol_type = other RNA
gaaatagtactaacacaatcaccagcaacattaagcttaagcccaggagaaagagcaacattaagctgtagagcaagccaaggattaaactttgtagtatggtatcaacaaaaaagaggacaagcaccaagattattaatacacgcaccatcagacagagcaccaggagtaccagatagattttcagcaagaggatcaggaacagatttctcactagtaatatcatcagtagaaccagacgatttcgcaatatattactgtcaagaatactcatcaacaccatataactttggaccaggaacaagagtagacagaaaaagaacagtagcagcaccatcagtatttatatttccaccatcagatgaacaa

SEQ ID NO: 50048 - RNA, 369 nt, synthetic construct
  misc_feature 1..369: note = derived and/or modified sequence opt6 from anti-HIV_Chain
  source 1..369: mol_type = other RNA
gaaatagtactaacacaatcaccaacaacattaagtttaagcccaggagaaagagcaacattaagctgtagagcaagccaaggagtaaacttagtagtatggtatcaacaaaaaagaggacaagcaccaagattattaatatacggaccatcagacagagcaccaggagtaccagatagatttagcgcaagaggaagcggaacagaattctcactagtaatatcaagcgtagaaccagacgatttcgcactatattactgtcaagaatactcaagcacaccatataactttggaacgggaacaagagtagacagaaaaagaacagtagcagcaccatcagtatttatatttccaccaagcgatgaacaa

SEQ ID NO: 50049 - RNA, 369 nt, synthetic construct
  misc_feature 1..369: note = derived and/or modified sequence opt6 from anti-HIV_Chain
  source 1..369: mol_type = other RNA
gaaatagtactaacacaatcaccagcaacattaagcttaagcccaggagaaagagcaacattaagctgtagagcaagccaaggagtaaactttgtagtatggtatcaacaaaaaagaggacaagcaccaagattactaatatacggaccatcaaacagagcaccaggagtaccagatagatttagtgcaagaggaagcggaacagaattctcattagtaatatcaagcgtagaaccagacgatttcgcactatattactgtcaagaatactcaagcacaccatataactttggaccaggcacaagagtagacagaaaaagaacagtagcagcaccatcagtatttatatttccaccaagcgatgaacaa

SEQ ID NO: 50050 - RNA, 369 nt, synthetic construct
  misc_feature 1..369: note = derived and/or modified sequence opt6 from anti-HIV_Chain
  source 1..369: mol_type = other RNA
gaaatagtactaacacaatcaccagcaacattaagcctaagcccaggagaaagagcaacattaagctgtagagcaagccaaggattaaactttgtagtatggtatcaacaaaaacgaggacaagcaccaagattactaatacacggaccatcacacagagcaccaggagtaccagatagatttagcgcaagaggaagcggaacagaatttagcctagtaatatcatcagtagaaccagacgatttcgcaatatattactgtcaagaatactcaagcacaccatataacttcggaccaggaacaagagtagacagaaaaagaacagtagcagcaccatcagtatttatatttccaccaagcgatgaacaa

SEQ ID NO: 50051 - RNA, 369 nt, synthetic construct
  misc_feature 1..369: note = derived and/or modified sequence opt6 from anti-HIV_Chain
  source 1..369: mol_type = other RNA
gaaatagtactaacacaatcaccagcaacactatcattaagcccaggagaacgagcaacattaagctgtagagcaagccaaggattaaactttgtagtatggtatcaacaaaaaggaggacaagcaccacgattactaatacacggaccaacagacagagcaccaggagtaccagatagatttagcgcaagaggaagtggaacagaatttagcctagtaatatcaagtgtagaacctgacgatttcgcactatattactgtcaagaatactcaagcacaccatataacttcggaccaggaacaagagtagacagaaaaagaacagtagcagcaccatcagtatttatatttccaccaagcgatgaacaa

SEQ ID NO: 50052 - RNA, 369 nt, synthetic construct
  misc_feature 1..369: note = derived and/or modified sequence opt6 from anti-HIV_Chain
  source 1..369: mol_type = other RNA
gaaatagtactaacacaatcaccagcaaccttaagcttaagcccaggagaacgagcaacattaagctgtagagcaagccaaggactaaactttgtagtatggtatcaacaaaaaaggggacaagcaccaagattactaatacacgcaccatcaggaagagcaccaggagtaccagatagatttagcgcaagaggaagcggaacagaattctcactagtaatatcatcagtagaaccagacgatttcgcaatatattactgtcaagaatactcatcaacaccatataactttggaccaggaacaagagtagacagaaaaagaacagtagcagcaccatcagtatttatatttccaccaagcgatgaacaa

SEQ ID NO: 50053 - RNA, 369 nt, synthetic construct
  misc_feature 1..369: note = derived and/or modified sequence opt6 from anti-HIV_Chain
  source 1..369: mol_type = other RNA
caagtacaattagtacaatcaggagcagaagtaaaaaaaccaggaagctcagtaaaagtatcatgcaaaacatcaggaggatcattctcaaactacgcattctcatgggtaagacaagcaccaggagaaggactagaatggatgggaagaataataccaatattcggaacagccaaatacacacaaaaactacaaggaagagtaacaataacagcagacaaattcacatcaacagtatacatggaactatcatcactaagatcagaagacacagcaatatactactgcgcatcactacaccaaggaccaataggatacacaccatggcacccaccaccaagagcaccattaggacaatcagtatgcgga

SEQ ID NO: 50054 - RNA, 369 nt, synthetic construct
  misc_feature 1..369: note = derived and/or modified sequence opt6 from anti-HIV_Chain
  source 1..369: mol_type = other RNA
caagtacaattagtagaaagcggaggaggattagtacaaccaggaggaagtctaagaataagctgtagcgcaacaggattcacattctcaacacatgcaatgcactgggtaagacaagcaccaggaaaaggactagaatacgtaagcgcaataaatagcaatggaagaagcgcattctatgcagatagcgtaaaaggaagagtaacaataagcagagacaatagcaaaaatacactatttctacaaatgacatcactaagagcagaagatacagcagtatattactgtgtaaaaggaccattattaagatatctagatagctggggacaaggaacattagtaacagtaagcagcgcatcaacaaaagga

SEQ ID NO: 50055 - RNA, 369 nt, synthetic construct
  misc_feature 1..369: note = derived and/or modified sequence opt6 from anti-HIV_Chain
  source 1..369: mol_type = other RNA
gaagtacaattagtagaaagcggaggaggattagtacaaccaggaggaagcctaagaataagttgtagcgcaacaggattcacattctcaacccatgcaatgcactgggtaagacaagcaccaggaaaaggactagaatacgtaagcgcaataaatagcaatggaagaagcgcattctatgcagatagcgtaaaaggaagagtaacaataagcagagacaatagtaaaaacacactatttctacaaatgacaagcctaagagcagaagatacagcagtatattactgtgtaaaaggaccactattaagatatctagatagctggggacaaggaacattagtaacagtaagctcagcatcaacaaaagga

SEQ ID NO: 50056 - RNA, 369 nt, synthetic construct
  misc_feature 1..369: note = derived and/or modified sequence opt6 from anti-HIV_Chain
  source 1..369: mol_type = other RNA
gaagaatcaggaccaggattagtaaaaccaagccaaacattaagcctaacatgtagcgtaagcggagactcagtatcatcaggaggatatttctggtcatggataagacaacatccaacaaaaggactagaatgcttaggatatgtatattacacaggaaatacatattacaacccatcactaaaaagcccaccaacaatagaagtagcaatggcaaataatcaagtaagcctaaaattaggatcagtaacagcagcagacacagcagtatactattgcgcaagaataaaaagattcagaggaggaaactatttcgatacatggggacatggattattagtaacagtatcatcagcatcaacaaaagga

SEQ ID NO: 50057 - RNA, 369 nt, synthetic construct
  misc_feature 1..369: note = derived and/or modified sequence opt6 from anti-HIV_Chain
  source 1..369: mol_type = other RNA
caagtacaactacaagaatcaggatcaggactagtaaaaccatcaggaacactatcattaacatgcgcagtatcaaacggaccaataagctcaggaaactggtggagttgggtaagacaaacaccagaaaaaggactagaatggataggagaagtataccactcaggatcaacaaaccacaacccatcattaaaatcaagagcaacaatactagtagacaaatcaaaaaatcaattcagcctaaacctaagatcagtaacagcagcagacacagcagtatactactgcgcaagagtaagaggaagttggaacttcgactactggggacaaggaatactagtaacagtatcatcagcaagtacaaaagga

SEQ ID NO: 50058 - RNA, 369 nt, synthetic construct
  misc_feature 1..369: note = derived and/or modified sequence opt6 from anti-HIV_HeavyChain
  source 1..369: mol_type = other RNA
gaagtacaattacaacaaagcggaacagtactagcaagaccaggagcaagcgtaaaaatgagctgtaaagcaagcggatacacattcacaagttattggatgcactgggtaaaacaaaggccaggacaaggactagaatggataggagcaatatatccaggaaactcagacacaagttataaccaaaaatttaaaggaaaagcaaaattaacagcagtaacaagcgcaagcacagcatatatggaactaagctcattaacaaatgaagatagtgcagtatattactgtacaagatggccacactattacggaggatcaagatattactttgactattggggacaaggaacaacactaacagtatcaagc

SEQ ID NO: 50059 - RNA, 372 nt, synthetic construct
  misc_feature 1..372: note = derived and/or modified sequence opt6 from anti-HIV_Chain
  source 1..372: mol_type = other RNA
gtagtacaattagtagaaagtggagggggactagtacaaccaggaggaagtttaagattaagttgtgcagcaagtggatttgcatttagaagttattggatgagttgggtaagacaagcaccaggaagaggattagaatgggtagcaaatataaaacaagatggaagtgaaaaatattatgcagatagtgtaaaaggaagatttacaataagtagagataatacaaaaaatagtttatatttacaaatgaatagtttaagagcagaagatacagcagtattttattgtgcaagtagaggagatagatatggaccaatagattattggggacaaggaacattagtaacagtaagtagtgcaagcacaaaagga

SEQ ID NO: 50060 - RNA, 372 nt, synthetic construct
  misc_feature 1..372: note = derived and/or modified sequence opt6 from anti-HIV_Chain
  source 1..372: mol_type = other RNA
caagtacaattagtacaaagtggagcagaaataaaaaaaccaggagaaagcttaaaaataagttgtaaagcaagtggatatacatttaatgattattggataggatgggtaagacaaatgccaggaaaaggattagaatggatgggaatattttatccagatgacagtgatagtaattatagtccaagttttcaaggaagagtaacaataagtgcagataaaagtataacaacagcatatttacaatggagtacattaaaagcaagtgatagtgcaatgtatttttgtgcaagattattaggagatagtggagcatttgatatatggggacaaggaacaatggtaatagtatcaagtgcaagtacaaaagga

SEQ ID NO: 50061 - RNA, 372 nt, synthetic construct
  misc_feature 1..372: note = derived and/or modified sequence opt6 from anti-HIV_Chain
  source 1..372: mol_type = other RNA
caagtacaattagtacaaagtggaggaggattagtaaaaccaggaggaagtttaagattaagttgtgcagcaagtggatttacatttagtagttatagtatgaattgggtaagacaagcaccaggaaaaggattagaatgggtaagtagtataagtagttcaagtagttatatatattatgcagatagtgtaaaaggaagatttacaataagtagagataatgcaaaaaatagtttatatttacaaatgaatagtttaagagcagaagatacagcagtatattattgtgcaagagaaggaagttattattatggaatggatgtatggggacaaggaacaacagtaacagtaagcagtgcaagtacaaaagga

SEQ ID NO: 50062 - RNA, 372 nt, synthetic construct
  misc_feature 1..372: note = derived and/or modified sequence opt6 from anti-HIV_Chain
  source 1..372: mol_type = other RNA
gaaatagtactaacacaatcaccagcaacactatcagtatcaccaggagaaagagcaacactatcatgcagagcaggacaatcagtatcatcagacctagcatggtaccaacacaaaccaggacaagcaccaagactattaatatacgacgcatcaaaaagagcaacaggaataccagcaagattctcaggatcaggatcaggaacagacttcacactaacaatatcatcactagaaccagaagacttcgcagtatactactgtcaacacagaacaaactggccaccatcaataacattcggacaaggaacaagactagaaataaaaagaacagtagcagcaccatcagtattcatattcccaccatcagac

SEQ ID NO: 50063 - RNA, 372 nt, synthetic construct
  misc_feature 1..372: note = derived and/or modified sequence opt6 from anti-HIV_Chain
  source 1..372: mol_type = other RNA
gaaatagtactaacacaatcaccaggaacactatcactatcaccaggagaaagagcaacactaagctgcagagcatcacaatcagtatcatcaagatacctagcatggtaccaacaaaaaccaggacaagcaccaagactaataatatacgacgcatcatcaagagcatcaggaataccagaccgattctcaggatcaggatcagaaacagacttcacactaacaataacaagactagaaccagaagacttcgcagtatactactgccaactatacggaacatcaccaaaattcacattcggacaaggaacaaaattagaaataaaacgaacagtagcagcaccatcagtattcatattcccaccatcagac

SEQ ID NO: 50064 - RNA, 372 nt, synthetic construct
  misc_feature 1..372: note = derived and/or modified sequence opt6 from anti-HIV_Chain
  source 1..372: mol_type = other RNA
gaaatagtactaacacaatcaccaggaacactatcactatcaccaggagaaagagcaacactatcatgcagagcatcacaatccgtatcaaacaactacctagcatggtaccaacaaaaaccaggacaagcaccaagactactaatatacggagcatcatcaagagcaacaggaataccagacagattctcaggatcaggatcaggaacagacttcacactaacaatatcaagactagaaccagaagacttcgcagtatactactgccaacaatacgcaacatcatcactatacacattcggacaaggaacaaaactagaaataaaaagaacagtagcagcaccatcagtattcatattcccaccatcagac

SEQ ID NO: 50065 - RNA, 372 nt, synthetic construct
  misc_feature 1..372: note = derived and/or modified sequence opt6 from anti-HIV_Chain
  source 1..372: mol_type = other RNA
ccagcaacactagcagtatcaccaggagaacgagcaacaatatcatgcaaatcatcacaaaacctactatactcagcaaacaaccaacactcactagcatggtaccaacaaagaccaggacaaccaccaaaactactactatactgggcatcaaccagactatccggagtaccagacagattctcaggatcaggatcaggaacagacttcacactaacaatatcaaacctacaagccgaagacgtagcagtatactactgccaacaatactactcaccaccaccaacattcggacaaggaacaaaagtagaaataagaagaacagtagcagcaccatcagtattcatattcccaccatcagacgaacaacta

SEQ ID NO: 50066 - RNA, 372 nt, synthetic construct
  misc_feature 1..372: note = derived and/or modified sequence opt6 from anti-HIV_Chain
  source 1..372: mol_type = other RNA
caaccagtactaacacaaccaccatcagcatcaggagcaccaggacaaagagtaacaatatcatgctcaggaggaccatcaaatgtcggaggaaactatgtatactggtacagacaattcccaggaacagcaccaaacttactaatactaagagacgaccaaagaccatccggagtaccagacagattctcagcatcaaaatcaggaaactcagcatcactagcaataacaggattaagaccagacgatgaagcattctacttctgtgcaacttacgactcagacggatcaataagactattcggaggaggaacagcattaacagtactatcacaaccaaaagcagcaccatcagtaacattattcccacca

SEQ ID NO: 50067 - RNA, 372 nt, synthetic construct
  misc_feature 1..372: note = derived and/or modified sequence opt6 from anti-HIV_Chain
  source 1..372: mol_type = other RNA
aacttcatgctaacacaaccaccatcagcatcaggagcaccaggacaaagagtaacaatatcatgctcaggaggaccatccaacgtaggcggaaactacgtatactggtacagacaattcccaggaacagcaccaaacttactaatactaagagacgaccaaagaccatcaggagtaccagacagattctcagcatcaaaatcaggaaactcagcatcactagcaatatcaggactaagaccagacgatgaagcattttacttctgcgcaacatacgactcagacggatcaataagactatttggaggaggaacaacattaacagtactatcacaaccaaaagcagcaccatcagtaacactattcccacca

SEQ ID NO: 50068 - RNA, 372 nt, synthetic construct
  misc_feature 1..372: note = derived and/or modified sequence opt6 from anti-HIV_Chain
  source 1..372: mol_type = other RNA
gacatacaaatgacacaatcaccaccatcactatcagcatcagtaggagacagagtaacaataacatgccaagcatcccaagacataaacaacttcctaaactggtaccaacaaaaaccaggaaaagcaccaagactactaatatacgacgcatcaaacctagaatcaggagtatcatccagattctcaggctcaagatcaggaacagacttcacactaacaatatcatccctactaccagaagacatagcaacatactcatgccaacaatactcaaacctaccatacacattctcacaaggaacaaaactagaaataaaaagaacagtagcagcaccatcagtattcatattcccaccatcagacgaacaa

SEQ ID NO: 50069 - RNA, 372 nt, synthetic construct
  misc_feature 1..372: note = derived and/or modified sequence opt6 from anti-HIV_Chain
  source 1..372: mol_type = other RNA
caagtacaattagtacaatcaggaacagcagtaaaaagaccaggagcaagtgtaagagtaagctgtcaagcaagcggatacacatttatagaccatttcatatactggtggagacaagcaccaggacaaggattagaatggttaggatggataaatccattaacatcacaaccaagttatccatcaagatttcaaggaagattaacattaacaagagacacattcgatgaaatgctatatatggatctaagaggattaagatcagacgatacaggaatatatttctgtgcaagaagacatagtgattactgtgactttgacatatggggaagcggaacacaaataatagtatcatcagcaagcacaaaagga

SEQ ID NO: 50070 - RNA, 372 nt, synthetic construct
  misc_feature 1..372: note = derived and/or modified sequence opt6 from anti-HIV_Chain
  source 1..372: mol_type = other RNA
caagtacaattagtacaaagcggagcagcattaaaaaaaccaggagcaagcttaagaataagctgtcaagcatacggatataaatttacagaccatttaatatattggtggagacaagcacccggacaaggactagaatggataggatggataaaaccagaaacaggacaaccaagttatagttataaatttcaaggaagagtaagtttaacaagagatacatttcaagaaatattatttatggatttaagaggattaagatcagacgatacagcaatatatttctgtgcaagaagacatagtgattactgtgactttgacgtatggggaagtggaagtcaagtaatagtatcaagtgcaagtacaaaagga

SEQ ID NO: 50071 - RNA, 372 nt, synthetic construct
  misc_feature 1..372: note = derived and/or modified sequence opt6 from anti-HIV_Chain
  source 1..372: mol_type = other RNA
caagtacaattagtacaaagtggagcagcattaaaaaaaccaggagcaagtttaagaataagttgtcaaacatatggatataaatttacagatcatttaatatattggtggagacaagcaccaggacaaggattagaatggatgggatggataaaaccagaaacaggacaaccaagttatagttatagatttcaaggaagagtaagtttaacaagagatacatttgaagaaatagtatttatggatttaagaggactaagaagtgatgatacagcaatatatttttgtgcaagaagacatagtgattattgtgattttgatgtatggggaagtggaagtcaagtaatagtaagtagtgcaagtacaaaagga

SEQ ID NO: 50072 - RNA, 372 nt, synthetic construct
  misc_feature 1..372: note = derived and/or modified sequence opt6 from anti-HIV_Chain
  source 1..372: mol_type = other RNA
caagtacaattagtacaaagcggagccgcactaaaaaaaccaggagcaagtttaagaataagctgtcaaacatacggatacaaattcacagaccatctaatatactggtggagacaagcaccaggacaaggattagaatggataggatggataaaaccagaaacaggacaaccaagttatagttatagatttcaaggaagagtaagtctaacaagagacacattcgaagaaatagcatttatggatctaagaggattaagatcagacgatacagcaatatatttctgtgcaagaagacatacagattactgtgtatttgacgtatggggatcaggaagccaaataatagtatcatcagcaagcacaaaagga

SEQ ID NO: 50073 - RNA, 372 nt, synthetic construct
  misc_feature 1..372: note = derived and/or modified sequence opt6 from anti-HIV_Chain
  source 1..372: mol_type = other RNA
caagtacaattagtccaaagcggaacagcagtaaaaagaccaggagcaagcgtaagagtaagctgtcaagcaagcggatacacattcacagactattttatatactggtggagacaagcaccaggacaaggactagaatggttaggatggataaatccattaacatcacaaccaagttatccatcaagatttcaaggaagattaacattaacaagagacacattcgatgaaatgctatatatggatctaagaggattaagatcagacgatacaggaatatatttctgtgcaagaagacatagtgattactgtgactttgacatatggggaagcggaacacaaataatagtatcaagtgcaagcacaaaagga

SEQ ID NO: 50074 - RNA, 372 nt, synthetic construct
  misc_feature 1..372: note = derived and/or modified sequence opt6 from anti-HIV_Chain
  source 1..372: mol_type = other RNA
caagtacaattagtacaaagtggagcagcattaaaaaaaccaggagcaagtgtaagaataagttgtcaagcatacggatataaatttacagatcatctaatatattggtggagacaagcaccaggacaaggattagaatggataggatggataaaaccagaaacaggacaaccaagttatgcatataaatttcaaggaagagtaacattaacaagggacacatttgaagaaatacattttatggatttaagaggagtaagaaatgatgatacagcaacatatttctgtgcaagaagacatagtgattactgtgactttgatgtatggggaagtggaagtcaagtaatagtatcaagtgcgagtacaaaagga

SEQ ID NO: 50075 - RNA, 372 nt, synthetic construct
  misc_feature 1..372: note = derived and/or modified sequence opt6 from anti-HIV_Chain
  source 1..372: mol_type = other RNA
caagtacaactagtacaaagtggagcagcattaaaaaaaccaggagcaagcgtaagaatatcatgtcaaacatatggatataaatttacagatcatttaatatattggtggagacaagcaccaggacaaggattagaatggataggatggataaaaccagaaacaggacaaccaagctatagttatagatttcaaggaagagtaagtttaacaagagacacatttgaagaaatagtatttatggatttaagaggattaagatcagatgatacagcaatatatttctgtgcaagaagacatagtgattattgtgactttgatgtatggggaagtggaagccaagtattagtatcaagtgcaagcacaaaagga

SEQ ID NO: 50076 - RNA, 372 nt, synthetic construct
  misc_feature 1..372: note = derived and/or modified sequence opt6 from anti-HIV_Chain
  source 1..372: mol_type = other RNA
caagtacaattagtacaaagtggagcagcattaaaaaaaccaggagcaagtttaagaataagctgtcaaacatatggatataaatttacagatcatttaatatattggtggagacaagcaccaggacaaggattagaatggataggatggataaaaccagaaacaggacaaccaagttatagctatagatttcaaggaagagtaagtttaacaagagatacatttgaagaaatagtatttatggatttaagaggattaagatcagatgatacagcaatatatttttgtgcaagaagacatagcgattattgtgattttgatgtatggggaagtggaagtcaagtactagtatcaagtgcaagtacaaaagga

SEQ ID NO: 50077 - RNA, 372 nt, synthetic construct
  misc_feature 1..372: note = derived and/or modified sequence opt6 from anti-HIV_Chain
  source 1..372: mol_type = other RNA
caagtacaattagtacaaagtggagcagcattaaaaaaaccaggagcaagtgtaagaataagttgtcaaacatatggatataaatttacagatcatttaatacattggtggagacaagcaccaggacaaggattagaatggataggatggataaaaccagatacaggacaaccaagttatagtagtagatttcaaggaagagtaagtttaacaagagatacatttgaagaaatagtatttatggatttaagaggattaagatcagatgatacagcaatatatttttgtgcaagaagacatagtgattattgtgattttgatgtatggggaagcggaagtcaagtattagtatcaagtgcaagtacaaaagga

SEQ ID NO: 50078 - RNA, 372 nt, synthetic construct
  misc_feature 1..372: note = derived and/or modified sequence opt6 from anti-HIV_Chain
  source 1..372: mol_type = other RNA
caagtacaattagtacaaagtggagcagcattaaaaaaaccaggagcaagtttaagaataagttgtcaaacatatggatataaatttacagatcatttaatatattggtggagacaagcaccaggacaaggattagaatggataggatggataaaaccagaaacaggacaaccaagttatagttatagatttcaaggaagagtaagtttaacaagagacacatttgaagaaatagtatttatggatttaagaggattaagatcagatgatacagcaatatatttctgtgcaagaagacatagtgattattgtgactttgatgtatggggaagtggaagtcaagtaatagtatcaagtgcaagcacaaaagga

SEQ ID NO: 50079 - RNA, 372 nt, synthetic construct
  misc_feature 1..372: note = derived and/or modified sequence opt6 from anti-HIV_Chain
  source 1..372: mol_type = other RNA
caagtacaattagtacaaagtggagcagcattaaaaaaaccaggagcaagtttaagaataagttgtcaaacatatggatataaatttacagatcatttaatatattggtggagacaagcaccaggacaaggactagaatggataggatggataaaaccagaaacaggacaaccaagttatagttatagatttcaaggaagagtaagtttaacaagagatacatttgaagaaatagtatttatggatttaagaggattaagatcagatgatacagcaatatatttttgtgcaagaagacatagtgattattgtgattttgatgtatggggaggaggaagtcaagtaatagtaagtagtgcaagcacaaaagga

SEQ ID NO: 50080 - RNA, 372 nt, synthetic construct
  misc_feature 1..372: note = derived and/or modified sequence opt6 from anti-HIV_Chain
  source 1..372: mol_type = other RNA
caagtacaattagtacaaagtggagcagcattaaaaaaaccaggagcaagtttaagaataagttgtttaacatatggatataaatttacagatcatttaatatattggtggagacaagcaccaggacaaggattagaatggataggatggataaaaccagaaacaggacaaccaagctatagttatagatttcaaggaagagtaagtttaacaagagacacatttgaagaaatagtatttatggatttaagaggattaagatcagatgatacagcaatatatttctgtgcaagaagacatagtgattattgtgactttgatgtatggggaagtggaagtcaagtaatagtatcaagtgcaagcacaaaagga

SEQ ID NO: 50081 - RNA, 372 nt, synthetic construct
  misc_feature 1..372: note = derived and/or modified sequence opt6 from anti-HIV_Chain
  source 1..372: mol_type = other RNA
caagtacaattagtacaaagtggagcaacattaaaaaaaccaggagcaagtgtaagaataagttgtcaagcatacggatataaatttacagatcatttaatacattggtggagacaagcaccaggacaaggattagaatggataggatggataaaaccagaaacaggacaaccaagttatgcatataaatttcaaggaagagtaagtttaacaagagacacatttgaagaaatattatttatggatttaagaggattaagatcagatgatacagcaatatatttctgtgcaagaagacatagtgattactgtgacttagatgtatggggaggaggaacacaactattagtatcaagtgcatcaacaaaagga

SEQ ID NO: 50082 - RNA, 372 nt, synthetic construct
  misc_feature 1..372: note = derived and/or modified sequence opt6 from anti-HIV_Chain
  source 1..372: mol_type = other RNA
caagtacaattagtacaaagcggagcagcactaaaaaaaccaggagcaagtgtaagaataagctgtcaagcatacggatacaaattcacagaccatttaatatactggtggagacaagcaccaggacaaggactagaatggataggatggataaaaccagaaacaggacaaccaagttatagttataaatttcaaggaagagtaacattaacaagagacacatttgaagaaatacattttatggatctaagaggattaagatatgacgatacagcaacatatttctgtgcaagaagacatagtgattactgtgactttgacgtatggggaagcggaagtcaagtatcagtatcaagtgcaagtacaaaagga

SEQ ID NO: 50083 - RNA, 372 nt, synthetic construct
  misc_feature 1..372: note = derived and/or modified sequence opt6 from anti-HIV_Chain
  source 1..372: mol_type = other RNA
caagtacaattagtacaaagtggagcagcactaaaaaaaccaggagcaagtttaagaataagctgtcaagcatacggatacaaattcacagaccatctaatatactggtggagacaagcaccaggacaaggactagaatggataggatggataaaaccagaaacaggacaaccaagttatagttataaatttcaaggaagagtaagcttaacaagagacacattccaagaaatactatttatgaacctaagaggactaagatcagacgatacagcaatatatttctgtgcaagaagacatagtgattactgtgactttgacgtatggggaagcggaagccaaatattagtatcaagcgcaagtacaaaagga

SEQ ID NO: 50084 - RNA, 372 nt, synthetic construct
  misc_feature 1..372: note = derived and/or modified sequence opt6 from anti-HIV_Chain
  source 1..372: mol_type = other RNA
caagtacaattagtacaaagtggaacagcagtaaaaaaaccaggagcaagcgtaagagtaagctgtcaagcaagcggatacacattcacagactatttcatatactggtggagacaagcaccaggacaaggactagaatggttaggatggataaatccaagaacatcacaaccaagttatccatatagatttcaaggaagagtaacattaacaagagacatattcgaagaaatgctatatatggatttaagaggattaagatcagacgatacaggaatatatttttgtgcaagaagacatagtgattactgtgactttgacatatggggaagcggaacacaaataatagtatcaagcgcatcaacaaaagga

SEQ ID NO: 50085 - RNA, 372 nt, synthetic construct
  misc_feature 1..372: note = derived and/or modified sequence opt6 from anti-HIV_Chain
  source 1..372: mol_type = other RNA
caagtacaattagtacaaagtggagcagcattaaaaaaaccaggagcaagtttaagaataagttgtcaagcatatggatataaatttacagattatctaatacattggtggagacaagcaccaggacaaggactagaatggataggatggataaaaccagaaacaggacaaccaagttatagttataaatttcaaggaagagtaagtttaacaagagacacatttgaagaaatattatttatggatttaagaggattaagatcagatgatacagcaatatatttctgtgcaagaagacatagtgattattgtgactttgatgtatggggaggaggaagtcaagtattagtatcaagtgcaagtacaaaagga

SEQ ID NO: 50086 - RNA, 372 nt, synthetic construct
  misc_feature 1..372: note = derived and/or modified sequence opt6 from anti-HIV_Chain
  source 1..372: mol_type = other RNA
gaagtacaattgctagaaagcggaggagcattagtacaaccaggaggaagtctaagattaagctgtgcagcaagcggattcacattctcaacatcaagcatgagctgggtaagacaagcaccaggaaaaggactagaatgggtaagtgcaataggaagcggaagaggaagcacattctatgcagatagcgtaaaaggaagatttacaataagcagagacaatagcaaaaacacactatcactacaaatgaatagcttaacagcagaagatacagcaacatattactgtacaaaaacaggaggattactaagattcccagaagtatgggggaaaggaacaacagtaacagtatcaagcgcaagcacaaaagga

SEQ ID NO: 50087 - RNA, 372 nt, synthetic construct
  misc_feature 1..372: note = derived and/or modified sequence opt6 from anti-HIV_Chain
  source 1..372: mol_type = other RNA
gaagtacaattagtagaaagcggaggaggactagtaaaaccaggaggaagtttaagattaagctgtgcagatagcggattcacattcagaagttatagtatgcattgggtaagacaagcaccaggaaaaggactagcatgggtaagttcaatatcaagtacaagtaattatatatattatgcagatagtgtaaaaggaagatttacaataagtagggacaatgcaaaaaattcattatatttacaaatgaatagtttaagagcagaagatacagcagtatattactgtgcaagaacatttataacagcatcatggtttgactcatggggacaaggaacattagtaacagtatcaagtgcaagtacaaaagga

SEQ ID NO: 50088 - RNA, 372 nt, synthetic construct
  misc_feature 1..372: note = derived and/or modified sequence opt6 from anti-HIV_Chain
  source 1..372: mol_type = other RNA
caagtacaattagtacaaagtggagcagaagtaaaaaaaccaggagcaagtgtaaaagtaagctgtaaagcaagcggatacacattcacaaactatggagtaagctgggtaagacaagcaccagggcaaggactagaatggatgggatggatatcaccatatagtggaaacacaaactatgcacaaagattacaagatagagtaacaatgacaacagacacaagcacaaacacagcatatatggaactaagaagcttaagatcagacgatacagcagtatattactgtgcagcaagatcatactattactatagtatggacgtatggggacaaggaacaacagtaacagtatcaagcgcaagcacaaaagga

SEQ ID NO: 50089 - RNA, 372 nt, synthetic construct
  misc_feature 1..372: note = derived and/or modified sequence opt6 from anti-HIV_Chain
  source 1..372: mol_type = other RNA
caagtacaattagtacaaagtggagcagaactaaaaaaaccaggatcaagcgtaaaagtaagctgtaaagcaagcggaggaacattctcaaactatgcaataaactgggtaagacaagcaccaggacaaggattcgaatggatgggaggaataataccattattcgcaacaccaacatatgcacaaaaatttcaaggaagagtaagaataacagcagacgatagcacaagcacagcatatatggaactatcaagcttaagatcagacgatacagcagtatatttctgtgcaagaccaaatgtagtaagatcagcattagactattggggacaaggaacattagtaacagtatcaagcgcaagcacaaaagga

SEQ ID NO: 50090 - RNA, 372 nt, synthetic construct
  misc_feature 1..372: note = derived and/or modified sequence opt6 from anti-HIV_Chain
  source 1..372: mol_type = other RNA
caagtacaattagtagaaagtggaggaggagtagtacaaccaggaaaaagtctaagattaagttgtgcagcaagtggatttacatttagtacacatgcaatgcattgggtaagacaagcaccaggaaaaggattagattgggtagcagtaataagtcatgatggagataatcaatattatgcagatgcagtaaaaggaagatttacaataagtagagatgatagtagagatacagtatttttacaaatgaatagtttaagaacagaagatacaggagtatattattgtgcagcagatagtagtggaagtaattggtttgattattggggacaaggaatattagtaacagtaagtagtgcaagtacaaaagga

SEQ ID NO: 50091 - RNA, 375 nt, synthetic construct
  misc_feature 1..375: note = derived and/or modified sequence opt6 from anti-HIV_Chain
  source 1..375: mol_type = other RNA
caagtaagattaagtcaaagtggaggacaaatgaaaaaaccaggagaaagcatgagattaagttgtagagcaagtggatatgaatttttaaattgtccaataaattggataagattagcaccaggaagaagaccagaatggatgggatggttaaaaccaagaggaggagcagtaaattatgcaagaaaatttcaaggaagagtaacaatgacaagagatgtatatagtgatacagcatttttagaactaagaagtttaacaagtgatgatacagcagtatatttttgtacaagaggaaaatattgtacagcaagagattattataattgggattttgaacattggggaagaggagcaccagtaacagtaagtagt

SEQ ID NO: 50092 - RNA, 375 nt, synthetic construct
  misc_feature 1..375: note = derived and/or modified sequence opt6 from anti-HIV_Chain
  source 1..375: mol_type = other RNA
gaagtacaattagtacaatcaggatcagacgtaagaaaaccaggagcaacagtaacagtatcatgcaaagcagatgaagatgaagatgactttacagcatacaattactttatgcattgggtaagacaagcaccgggacatggattagaatggataggatggataaacccacgaacaggacaaccaaatcacgcaaaacaattccaaggaagagtaacactaacaagagaaagatcaacatcaacagtattcatgaaattaacaaatttaagactagatgacacagcagtatacttttgcgcaagaccactaagaggaggagacacatggcattaccatagctggggaagaggaacaagtttaacagtaagctca

SEQ ID NO: 50093 - RNA, 375 nt, synthetic construct
  misc_feature 1..375: note = derived and/or modified sequence opt6 from anti-HIV_Chain
  source 1..375: mol_type = other RNA
caagtacaattagtacaaagcggaggaggattagtacaaccaggagaaagcctaagactaagctgtacagcaagcggattcacattctcaagttataacatgaactgggtaagacaagcaccaggaaaaggactagaatggataagctatatatcagacaaaagcaaaaacaaatactatgcagatagcgtaagaggaagatttacaataagcagagacaatgcacaaaactcactatttttacaaatgtcaagcctaagagatgaagatacagcagtatattactgtacaagagaaggaccacaaagatcattctatttcgattactggggacaaggaatacaagtaacagtaagctcagcatcaacaaaagga

SEQ ID NO: 50094 - RNA, 375 nt, synthetic construct
  misc_feature 1..375: note = derived and/or modified sequence opt6 from anti-HIV_Chain
  source 1..375: mol_type = other RNA
gaagtacaattagtagaaagtggagcagaagtaaaaaaaccaggaagtagtgtaaaagtaagttgtaaagcaagtggaggaacatttagtagttatagtataagttgggtaagacaagcaccaggacaaggactagaatggatgggaggaataataccaatatttgcaacaacacattatggacaaaaatttcaaggaagaataaaaataacagcagataaaagtacaagtacagcatatatggaattaagtagactaagaagtgaagatacagcagtatattattgtgcaagagatagagaattttatttttatggaatggatgtatggggacaaggaacaacagtaacagtaagtagtgcaagtacaaaagga

SEQ ID NO: 50095 - RNA, 375 nt, synthetic construct
  misc_feature 1..375: note = derived and/or modified sequence opt6 from anti-HIV_Chain
  source 1..375: mol_type = other RNA
caattacaattacaagaaagcggaccaggattagtaaaaccatgggaaacattagtattaacatgtagcgtaagcggaggatcaatatcaagcggagactattactggggatggataagacaatcaccaggaaaaggaccagaatggataggaaatatattttactcaagcggaaacacatactataacacaagcctaaaatcaagagtaacaataagtgtagacgtaagcaaaaacagattctcattaaaattaacaagcatgacagcagcagatacagcagtatattactgtggaagactatcaaacaaaggatggttcgatccatggggacaaggaacattagtaagcgtaagctcagcatcaacaaaagga

SEQ ID NO: 50096 - RNA, 375 nt, synthetic construct
  misc_feature 1..375: note = derived and/or modified sequence opt6 from anti-HIV_Chain
  source 1..375: mol_type = other RNA
gaaatagtactaacacaatcaccagcaacactatcactatcaccaggagaaagagcaacactatcatgcagagcatcacaatcagtatcatcatacctagcatggtaccaacaaaaaccaggacaagcaccaagactattaatatacgacgcatcaaacagagcaacaggaataccagcaagattctcaggatcaggatcagacacagacttcaccctaacaatatcatcactagaaccagaagacttcgcagtatactactgccaacaaagaggaatatggccactacaaataacattcggacaaggaacaagactagaaataaaaagaacagtagcagcaccatcagtattcatattcccaccatcagacgaa

SEQ ID NO: 50097 - RNA, 375 nt, synthetic construct
  misc_feature 1..375: note = derived and/or modified sequence opt6 from anti-HIV_Chain
  source 1..375: mol_type = other RNA
tcagaaatagtactaacacaatcaccaggaacactatcactatcaccaggagaaagagcaacattatcatgcagagcatcacaatcagtatcatcttcatacctagcatggtaccaacaaaaaccagtacaagcaccaagattactaatatacggagcatcatcaagagcaacaggaataccagacagattctcaggatcaggatcaggaacagatttcacactaacaatatcaagactagaaccagaagacttcgcagtatactactgccaacaatacggaacactacacccaagaacattcggacaaggaacaaaagtagaaataaaaagaacagtagcagcaccatcagtattcatattcccaccatcagac

SEQ ID NO: 50098 - RNA, 375 nt, synthetic construct
  misc_feature 1..375: note = derived and/or modified sequence opt6 from anti-HIV_Chain
  source 1..375: mol_type = other RNA
tcacaagcagtagtaacacaaccaccatcagtatcaggagcaccaggacaaagagtaacaatatcatgctcaggaggaccatcaaacgtaggaggaaacctagtatactggtacaaacaattcccaggaacagcaccaaaactactaataagaagagacgaccaaagaccatcaggagtaccagacagattcagtggaagtaaatcaggaaactcagcaagcctagcaatatcaggactaagaccagacgacgaagcattctacttctgcgcaacatacgactcacacggatcaataagactattcggaggaggaacactattaacagtactaagtcaaccaaaagcagcaccatcagtaacactatttccacca

SEQ ID NO: 50099 - RNA, 375 nt, synthetic construct
  misc_feature 1..375: note = derived and/or modified sequence opt6 from anti-HIV_Chain
  source 1..375: mol_type = other RNA
gatatacaaatgacacaatcaccatcaacattagcagcatcaataggaggaacagtaagagtatcatgtagagcatcacaatcaataacaggaaactgggtagcatggtatcaacaaagacctggaaaagcaccaagattactaatatacagaggagcagcattactaggaggagtaccatcaagattttcaggatcagcagcaggaacagatttcacactaacaataggaaacttacaagcagaagatttcggaacattttactgtcaacaatacgatacatatccaggaacatttggacaaggaacaaaagtagaagtaaaaagaacagtagcagcaccatcagtatttatatttccaccatcagatgaacaa

SEQ ID NO: 50100 - RNA, 375 nt, synthetic construct
  misc_feature 1..375: note = derived and/or modified sequence opt6 from anti-HIV_Chain
  source 1..375: mol_type = other RNA
gaaatagtaatgacacaatccccagacacactatcagtatccccaggagaaagagcaacactatcatgcagagcatcacaatcagtaaactcaaacctagcatggtaccaacaaaaaccaggacaagcaccaagactattaatatacggagcatcaacaagagcaacagcagtaccagcaagattctcaggatcaggatcaggaacagaattcacactaacaatatcatcactacaatcagaagactcagcagtatactactgccaacaatactaccaatggctatcatacacattcggacaaggaacaaaactagaaataaaaagaacagtagcagcaccatcagtattcatattcccaccatcagacgaacaa

SEQ ID NO: 50101 - RNA, 375 nt, synthetic construct
  misc_feature 1..375: note = derived and/or modified sequence opt6 from anti-HIV_Chain
  source 1..375: mol_type = other RNA
agacaagtacaactagtacaatcaggagcagcattaaaaaaaccaggagcatcactaagaatatcatgccaagcatacggatataaatttacagaccacttaatatattggtggagacaagcaccaggacaaggactagaatggataggatggataaaaccagaaacaggacaaccatcatactcatacaaattccaaggaagagtatcactaacaagagacacatttcaagaaatattattcatggacttaagaggattaagatcagacgacacagcaatatacttctgcgcaagaagacactcagactactgcgacttcgacgtatggggatcaggatcacaaatactagtatcatcagcatcaacaaaagga

SEQ ID NO: 50102 - RNA, 375 nt, synthetic construct
  misc_feature 1..375: note = derived and/or modified sequence opt6 from anti-HIV_Chain
  source 1..375: mol_type = other RNA
caagtacaattagtacaaagcggagcagcattaaaaaaaccaggagcaagtgtaagaataagctgtcaagcatacggatataaatttacagactatttaatacactggtggagacaagcaccaggacaaggattagaatggataggatggataaaaccagaaacaggacaaccaagttatagttataaatttcaaggaagagtaacattaacaagagacacatttgaagaaatattatttatggatttaagaggattaagatcagatgatacagcaatatatttttgtgcaagaagacatagtgattactgtgactttgacgtatggggaagcggaagtcaagtaatagtatcaagtgcaagtacaaaaggagca

SEQ ID NO: 50103 - RNA, 375 nt, synthetic construct
  misc_feature 1..375: note = derived and/or modified sequence opt6 from anti-HIV_Chain
  source 1..375: mol_type = other RNA
gaagtacaattagtagaaagtggaggaggattagtaaaaccaggaggaagtttaagattaagttgtgcagcaagtggatttagttttagcgaacattatatgagctggataagattagcaccaggaaaaggattagaatggttaagctatataagtagtagtacaagaacaacatatagtgcagatagtgtaagaggaagatttacaataagtagagatacagcaaaacaattattatttttacatatgagtagtttaagagcagaagatacagcagtgtattattgtgtaagattatatggaggaataaatggatggttcgatcaatggggacaaggaacattagtaagtgtaagtagtgcaagtacaaaagga

SEQ ID NO: 50104 - RNA, 375 nt, synthetic construct
  misc_feature 1..375: note = derived and/or modified sequence opt6 from anti-HIV_Chain
  source 1..375: mol_type = other RNA
caagtacaattagtacaaagtggaccaggattagtaaaaccaagcgaaacactatcactaacatgtagcgtgagcaatggaagcatatcaagcggaggatattactggagctggctaagacaatttccaggaaaaggactagaatggataggatcaatacattacacaggaagaacattttacaatccatcactaatgggaagaacagcactatcaatggatacatcaaacaatcaatttagtttaaaagtaagctcagtaacagcagcagacacagcattatactattgcgcaagagaattacaatggatgttcgtagtagatccatggggacaaggaacattagtaacagtaagctcagcatcaacaaaagga

SEQ ID NO: 50105 - RNA, 375 nt, synthetic construct
  misc_feature 1..375: note = derived and/or modified sequence opt6 from anti-HIV_Chain
  source 1..375: mol_type = other RNA
caagtacaactacaagaaagcggaccaggattagtaaaaccaagcgaaacactaagtttaacatgtagcgtaagcaatggatcaatatcaagcggaggatattactggagctggctaagacaatttccaggaaaaggactagaatggataggatcaatacattacacaggaagaacaatgtacaatccatcactaatgggaagaccagcactatcaatggatacatcaaacaatcaatttagcttaaaattaagatcagtaacagcagcagacacagcattatacttttgcgcaagagatctacaatggatattcgtagtagatccatggggacaaggaacattagtaacagtgagctcagcatcaacaaaagga

SEQ ID NO: 50106 - RNA, 375 nt, synthetic construct
  misc_feature 1..375: note = derived and/or modified sequence opt6 from anti-HIV_Chain
  source 1..375: mol_type = other RNA
gaagtacaattattagaaagtggaggaggattagtacaaccaggaggaagtttaagattaagttgtgcagtaagtggatttacatttggaggacatgcagtaagctgggtaagacaagcaccaggaaaaggattagaatggttaagtcaaataagtggaacaggaagtagaacagattatgcagatgcagtaaaaggaagatttacagtaagtagagataatagtaaaaaaacagtatatttacaaatgaatagtttaagagtagaagatacagcattattttattgtgcaacaagaagtccaggaggaggatatgcatttgatatatggggacaaggagcaatggtaacagtaagtagtgcaagtacaaaagga

SEQ ID NO: 50107 - RNA, 375 nt, synthetic construct
  misc_feature 1..375: note = derived and/or modified sequence opt6 from anti-HIV_Chain
  source 1..375: mol_type = other RNA
caagtacaattagtacaaagcggagcagaagtaaaaaaaccaggatcaagcgtaaaagtaagctgtaaagtaagctttttctcaaactatggaataagttgggtaagacaaagaccaggacaaggactagaatggatgggaagaataataccagcaatagatgacatgacatatgcacaaacatttagaggaagagtaacatttagcgcagacaaattcacaacaacagcatatatggaactaacaggattaacatttgaagatacagcaacatatttctgtgcaagagacccacaagtaaacagaagaggaaactgtttcgatcactggggacaaggaacactagtaacagtaagctcagcatcaacaaaagga

SEQ ID NO: 50108 - RNA, 375 nt, synthetic construct
  misc_feature 1..375: note = derived and/or modified sequence opt6 from anti-HIV_Chain
  source 1..375: mol_type = other RNA
caagtacaattacaagaaagcggaccaggattagtaaaaccaagtgaaacattatcattaacatgtacagtaagcggaggatcaatatcatactattactggagctggataagacaaccaccaggaaaaggactagaatggataggagatatatattactcaggaacaacagattacaatccatcactaaaaagtagagtaacaatatcagtagatacaagcaaaaatcaatttagcttaaaattaagctcagtaacagcagcagacacagcagtatactattgcgcaagaagaagaggacaaagactattagcatatttcgattactggggacaaggaagcctagtaacagtatcatcagcatcaacaaaagga

SEQ ID NO: 50109 - RNA, 375 nt, synthetic construct
  misc_feature 1..375: note = derived and/or modified sequence opt6 from anti-HIV_Chain
  source 1..375: mol_type = other RNA
caagtacaactacaagaatcaggaccaggaccagtaaaaccatcagaaacactatcactaacatgcacagtatcaggaggatcaatgatatcatactactggtcatggataagacaaccaccaggaaaaggactagaatggataggatacatattcacaaacggaagaacaacatacagcccatcactaagatcaagagtaacaatatcactagacacatcaacaaaccacttctcactaagactaaaatcagtaacagcagcagacacagcaatatactactgcgcaagattagacggagaagcattcagatactacctagacctatggggacaaggaaacttagtaacagtatcatcagcaagcacaaaagga

SEQ ID NO: 50110 - RNA, 375 nt, synthetic construct
  misc_feature 1..375: note = derived and/or modified sequence opt6 from anti-HIV_Chain
  source 1..375: mol_type = other RNA
caagtacaattagtacaaagcggagcagaagtaaaaaaaccaggagcaagtgtaaaagtaagctgtaaaccaagctcaaacacattcacaagtcattacatacactgggtaagacaagcaccaggacaaggactagaatggatgggaatgataaatccaggaggatcaacaagatacgcaccaaaattccaaggaagagtaacattaacaagagatacatcaacaagaacagtatacatggaattaagctcattaagaagcgaagacacagcagtatattattgcgcaagaccacaatataacttaggaagagacccactagatgtatggggcttaggaacaatggtaacagtaagttcagcatcaacaaaagga

SEQ ID NO: 50111 - RNA, 375 nt, synthetic construct
  misc_feature 1..375: note = derived and/or modified sequence opt6 from anti-HIV_Chain
  source 1..375: mol_type = other RNA
caagtacaactacaacaatggggagcaggactattaaaaccaagcgaaacattatcattaacatgtgcagtatacggaggatcattctcaggatattactggagctggataagacaaccaccaggaaaaggactagaatggataggagaaataaatcactcaggatcaacaaattacaatccatcactaaaaagcagagtaacaatatcagtagatacaagcaaaaatcaatttagcttaaaattaagctcagtaacagcagcagacacagcagtatactattgcgcaagattaccaataggatcaggatggtacggaagagattactggggacaaggaacattagtaacagtaagctcagcatcaacaaaagga

SEQ ID NO: 50112 - RNA, 375 nt, synthetic construct
  misc_feature 1..375: note = derived and/or modified sequence opt6 from anti-HIV_Chain
  source 1..375: mol_type = other RNA
caagtacaattagtacaaagtggagcagaagtaaaaaaaccaggagcaagcgtaaaagtaagttgtaaagcaagcggaaacacattcacaagctatggaataacatgggtaagacaagcaccaggacaaggactagaatggatgggatggatatcagcatataacggaaacacaaactatgcacaaaaattacaagatagattaacaatgacaacagacacaagtacatcaacagcatatatggaactaagaagcttaagatcagacgatacagcagtatattactgtgcatttagcagacactatggatcaggaaattacgattactggggacaaggaacactagtaacagtaagctcagcatcaacaaaagga

SEQ ID NO: 50113 - RNA, 375 nt, synthetic construct
  misc_feature 1..375: note = derived and/or modified sequence opt6 from anti-HIV_Chain
  source 1..375: mol_type = other RNA
caatttagattagtacaaagcggaccagaagtaaaaaacccaggatcaagcgtaacagtaagctgtaaagcaagcggaggaacattctcaggattaggaataaactgggtaagacaagcaccaggacaaggactagaatggttaggagatataaaaacaatgtacggaacaacaaactatgcaccgaaatttcaaggaagagtaacaataacagcagacgaaagtacaagcacaagctatatggaattatcaggattaagatcagaagatacagcagtattttactgtgtaagagaattattcggacaccatccagcattcggagtatggggacaaggaacaagcgtaatagtaagcagtgcatcaacaaaagga

SEQ ID NO: 50114 - RNA, 375 nt, synthetic construct
  misc_feature 1..375: note = derived and/or modified sequence opt6 from anti-HIV_Chain
  source 1..375: mol_type = other RNA
agagtacaattagtacaaagcggagccgaagtaaaaaaaccaggatcaagcgtaacagtaagctgtaaagcaagcggaggatcattctcaagctatgcaataagctgggtaagacaagcaccaggacaaggactagaatgggtaggaggagtaaaagtaatgttcggaacagtacactatagtcaaaaagtacaaggaagagtaacaataacagcagacgatagtacaggaacaagttatctagaattatcaggattaagatcagcagatacagcagtatattactgtgcaagaaacgcaggagcatacttttacccattcgatatatggggacaaggaacactaataatagtaagctcagcatcaacaaaagga

SEQ ID NO: 50115 - RNA, 375 nt, synthetic construct
  misc_feature 1..375: note = derived and/or modified sequence opt6 from anti-HIV_Chain
  source 1..375: mol_type = other RNA
caagtacaattacaagaaagcggaccaggcctagtaaaaccaagcgaaacattaagcctaacatgtacagtaagcggaggatcaatatcaagcagaagctattactggggatggataagacaaccaccaggaaaaggactagaatgggtaggatcaatatattacacaggatcaacatattactcaccatcactaaaaagcagagtaacaatatcagtagatacatcacaaaatcaatttagcttaaaattaaactcagtaacagcagcagacacagcagtatactattgcgcaagacaaaaaggaagcggaacatcactattatactggggacaaggaacattagtaacagtaagctcagcatcaacaaaagga

SEQ ID NO: 50116 - RNA, 375 nt, synthetic construct
  misc_feature 1..375: note = derived and/or modified sequence opt6 from anti-HIV_Chain
  source 1..375: mol_type = other RNA
caagtacaattagtacaaagcggaacagaagtaaaaaaaccaggaagtagtgtaaaagtaagctgtaaagcaagcggaggaacattctcagactcagacatagcatgggtaagacaagcaccaggacaaggactagaatggatgggaggaataacaccaatgttcgatatggcaaaatcagcacaaaaatttagaggaagattaataataacagcagacaaaagcacaggaacagcatatatggaactatcaagcttaagatatgaagatgcagcagtatatttctgtgcaagaagctcaggaaatttcgaattcgcattcgaaatatggggacaaggaacaaaaataatagtaagcttagcatcaacaaaagga

SEQ ID NO: 50117 - RNA, 375 nt, synthetic construct
  misc_feature 1..375: note = derived and/or modified sequence opt6 from anti-HIV_Chain
  source 1..375: mol_type = other RNA
gtagtacaattagtacaaagtggaacagaagtaaaaaaaccaggaagtagtgtaaaagtaagttgtaaagcaagtggaggaacatttagtggaagtgatataagctgggtaagacaagcaccaggacaaggattagaatggatgggaggaataataccaatgtttgatatagaagatcatgcacaaaaatttagaggaagattaacaataacagcagataaaagtacaggagcagcatatatggaattaagtagtctaagaagtgaagatgcagcagtatattattgtgcaagaagtagtggaaattatgattttgcatttgatatatggggacaaggaacaagattaatagtaagcagtgcaagtacaaaagga

SEQ ID NO: 50118 - RNA, 375 nt, synthetic construct
  misc_feature 1..375: note = derived and/or modified sequence opt6 from anti-HIV_Chain
  source 1..375: mol_type = other RNA
gtagtacaattagtagaaagcggaacagaagtaaaaaaaccaggaagtagtgtaaaagtaagctgtaaagcaagcggaggaacattcagtggatcagacataagctgggtaagacaagcaccaggacaaggactagaatggatgggaggaataataccaatgttcgatatagaaaaccatgcagaaaaatttagaggaagattaacaataacagcagtaaaaagcacaggagcagcatatatggaactatcaagcttaagaagtgaagatgcagcagtatattactgtgcaagaagctcaggaaattacgatttcgcatacgatatatggggacaaggaacaagagtaatagtaagctcagcatcaacaaaagga

SEQ ID NO: 50119 - RNA, 378 nt, synthetic construct
  misc_feature 1..378: note = derived and/or modified sequence opt6 from anti-HIV_Chain
  source 1..378: mol_type = other RNA
caagtacaattagtacaaagtggaagtgcaatgaaaaaaccaggagcaagtgtaagagtaagttgttggacaagtgaagatatatttgatacaacagaattaatacattgggtaagacaagcaccaggacaaggattagaatggataggatgggtaaaagcagtaagtggagcagtaaattatggaagtctagattttagacatagagtaagtttaacaagagatagagatttaagtacagcacatatggatataagaggattaacacaagatgatacagcaacatatttttgtgcaagacaaaaatttgcaagaggagatcaaggatggttttttgatttatggggaagaggaacattaatagtagtaagtagcgca

SEQ ID NO: 50120 - RNA, 378 nt, synthetic construct
  misc_feature 1..378: note = derived and/or modified sequence opt6 from anti-HIV_Chain
  source 1..378: mol_type = other RNA
caagtacaattacaagaaagcggaccaggattagtaaaaccaagcgaaacattaagcctaacatgtacagtaagcggaggatcaatatcaaaccattactggagctggataagacaaccaccaggaaaaggactagaatggataggatatatatatcactcaggaaatataaattacaaaagctcattaaaaagcagagcaacaatatcaatagatacatcaaacaatcaatttagcttaaaattaagctcagtaatagcagcagacacagcagtatactattgcgcaagaaatttcggaccaggaagcccaaactatggaatggacgtatggggacaaggaacaacagtaacagtatcaagcgcaagcacaaaagga

SEQ ID NO: 50121 - RNA, 378 nt, synthetic construct
  misc_feature 1..378: note = derived and/or modified sequence opt6 from anti-HIV_Chain
  source 1..378: mol_type = other RNA
caagtacaattagtacaaagtggaggaggagtagtacaaccaggaagaagtctaagattaagttgtgcagcaagtggatttacatttagtcatcatggaatacattgggtaagacaagcaccaggagaaggactagaatgggtagcagtaataagtgaagatggaacaaatatacattatgaagatagtgtaagaggaagatttacaataagtagagataatagtaaaaatacagtagatttacaaatgaatagtttaagagcagaagatacagcagtatattattgtgcatcattaataagtatgagagatggagatgcatttgatttatggggacaaggaacaagagtaacagtaagcagtgcaagtacaaaagga

SEQ ID NO: 50122 - RNA, 378 nt, synthetic construct
  misc_feature 1..378: note = derived and/or modified sequence opt6 from anti-HIV_Chain
  source 1..378: mol_type = other RNA
caagtacaattagtagaaagtggaggaggattaggacaaccaggaggaagtttaagattaagttgtgcagcaagtggatttacatttagaaattatgcaatgagttgggtaagacaagcagcaggaaaaggattagaatgggtaagtggagtaagcggaggaggagatacaacatattatggagatagtgtaaaaggaagatttacaataagtagggataatagcaaaaatacattatatttacaaatgaataatttaagagcagaagatacagcagtatattattgtgcaaaagataaaggagtatggggaagtagtgattttgattattggggacaaggaacattagtaacagtaagtagtgcaagtacgaaagga

SEQ ID NO: 50123 - RNA, 378 nt, synthetic construct
  misc_feature 1..378: note = derived and/or modified sequence opt6 from anti-HIV_Chain
  source 1..378: mol_type = other RNA
gaagtacaattagtagaaagtggaggaggagtagtacaaccaggaagaagtttaagattaagttgtgcagcaagtggatttacatttagtcatcatggaatacattgggtaagacaagcaccaggagaaggattagaatgggtagcagtaataagtgaagatggaacaaatatacattatgaagatagtgtaagaggaagatttacaataagcagagataatagtaaaaatacagtagatttacaaatgaatagtttaagagcagaagatacagcagtatattattgtgcaagtttaataagtatgagagatggagatgcatttgatttatggggacaaggaacaagagtaacagtaagcagtgcaagtacaaaagga

SEQ ID NO: 50124 - RNA, 378 nt, synthetic construct
  misc_feature 1..378: note = derived and/or modified sequence opt6 from anti-HIV_Chain
  source 1..378: mol_type = other RNA
agaggaccagtaacactagcagtatcactaggagaaagagcaacaataacatgcaaatcatcacaatcagtattagtacactcaaacaacaaaaactacctatcatggtaccaacaaaaaccaggacaaccaccaaaactactaatatactgggcatcaacaagagaatcaggagtaccagaaagattctcaggatcaggatcaggaacagacttcacactatcaatatcatcactacaagcagaagacgtagcagtatactactgccaccaatacttctcaacaccaagaacattcggacaaggaacaaaagtagaaataaaaggaacagtagcagcaccatcagtattcatattcccaccatcagacgaacaacta

SEQ ID NO: 50125 - RNA, 378 nt, synthetic construct
  misc_feature 1..378: note = derived and/or modified sequence opt6 from anti-HIV_Chain
  source 1..378: mol_type = other RNA
tcagaaatagtaatgacacaatcaccagcaacactatcaatgtcaccaggagaaagagcaacactatcatgcagagcatcactatcagtaaacacaaacctagcatggtaccaacaaaaaccaggacaagcaccaagactactaatatacggagcatcaacaagagcaacaggaataccagcaagattctcaggatcaggatcaggaacagaattcacattaacaatatcatcactacaatcagaagacttcgcactatactactgccaacaatacaaccactggccacaaacattcggacaaggaacaaaagtagaaataaaaagaacagtagcagccccatcagtattcatattcccaccatcagacgaacaaaaa

SEQ ID NO: 50126 - RNA, 378 nt, synthetic construct
  misc_feature 1..378: note = derived and/or modified sequence opt6 from anti-HIV_Chain
  source 1..378: mol_type = other RNA
tcagaaatagtattaacacaatcaccagcaacactatcactatcaccaggagaaagagcaacactaagctgcagagcatcacaatcaataaacaactacctagcatggtaccaacaaaaaccaggacaagcaccaagactactaatatacgacgcatcaaacagagcaacaggaatcccagcaagattctcaggaggaggatcaggaacagacttcacactaacaatatcatcactagaaccagaagacttcgcagtatactactgccaacaaagagcaaattggagactactaacattcggaggaggaacaaaagtagaaataaaaagaacagtagcagcaccatcagtattcatattcccaccatcagacgaacaa

SEQ ID NO: 50127 - RNA, 378 nt, synthetic construct
  misc_feature 1..378: note = derived and/or modified sequence opt6 from anti-HIV_Chain
  source 1..378: mol_type = other RNA
caagtacaattagtacaaagtggaggagcagtaaaaaaaccaggagcaagtgtaaaagtaagttgtgaaacatatggatatacatttacagatcattttatgcattggtggagacaagcaccaggacaaggattagaatggatgggatggataaatccatatagttcagcagtaagttatagtccaagatatcaaggaagagtaacaatgacaagagatacatttttagaaacagtatatatggaattaagaggattaaaatttgatgatacagcaatatattattgtgcaacaccaaaaagtggaagagattattggagttttgatttatggggacaaggaacattagtaacagtatcaagtgcaagtacaaaagga

SEQ ID NO: 50128 - RNA, 378 nt, synthetic construct
  misc_feature 1..378: note = derived and/or modified sequence opt6 from anti-HIV_Chain
  source 1..378: mol_type = other RNA
tcacaagtacaattagtagaaagcggaccaggattagtaaaaccaagcgaaacactatcactaacatgtagcgtaagcaatggaagcatatcaagcggaggatattactggagttggctaagacaatttccaggaaaaggattagaatggataggatcaatacattacacaggaagaacaatgtacaatccatcactaatgggaagaccagcattatcaatggatacatcaaacaatcaatttagcttaaaattaagctcagtaacagcagcagacacagcactatacttttgcgcaagagatctacaatggatattcgtagtagatccatggggacaaggaacattagtaacagtaagctcagcatcaacaaaagga

SEQ ID NO: 50129 - RNA, 378 nt, synthetic construct
  misc_feature 1..378: note = derived and/or modified sequence opt6 from anti-HIV_Chain
  source 1..378: mol_type = other RNA
tcagtagtacaattagtagaaagcggaccaggattagtaaaaccaagcgaaacactaagcctaacatgtagcgtaagtaatggatcaatatcaagtggaggatattactggagctggctaagacaatttccaggaaaaggactagaatggataggatcaatacattacacaggaagaacaatgtacaatccatcactaatgggaagaccagcactatcaatggatacatcaaacaatcaatttagcttaaaattaagatcagtaacagcagcagacacagcattatacttttgcgcaagagatctacaatggatattcgtagtagatccatggggacaaggaacattagtaacagtaagctcagcatcaacaaaagga

SEQ ID NO: 50130 - RNA, 378 nt, synthetic construct
  misc_feature 1..378: note = derived and/or modified sequence opt6 from anti-HIV_Chain
  source 1..378: mol_type = other RNA
agtggaggaagattagtacaaccaggaggaagcctaagattaagctgtagtgcaagcggattcacactatcaaactcggcaatgagctgggtaaggcaagcaccaggaaaaggactagaatgggtaagctcaatattaagttcgggagtaggaacattctatgcagatagcgtaaaaggaagatttacagtaagtagagacaatagtagaaacacactatatctacaaatgaaatcattaagagcagaagatacagcactatattactgtgcaaaagtacaaatacaacaattaaactttggagtaataacagacgcaggattagacgtatggggaaaaggaacaacactaatagtaagcagtgcaagcacaaaagga

SEQ ID NO: 50131 - RNA, 378 nt, synthetic construct
  misc_feature 1..378: note = derived and/or modified sequence opt6 from anti-HIV_Chain
  source 1..378: mol_type = other RNA
caagtacaattagtacaaagtggagcagcagtaaaaaaaccaggagcaagcgtaaaagtaagttgtgaagcatatggatataaatttacagatcattttatgcattggtggagacaagcaccaggacaaggattagaatggatgggatggataaatccatatacatcagcagtaaattatagtccaaaatatcaaggaagagtaacaatgacaagggatacgtttttagaaacagtatatatggaattaagaggattaagagtagatgatacagcaatatattattgtgcaacaccaaaaagtggaagagattattggagttttgatttatggggacaaggaacattagtaacagtatcaagtgcaagtacaaaagga

SEQ ID NO: 50132 - RNA, 378 nt, synthetic construct
  misc_feature 1..378: note = derived and/or modified sequence opt6 from anti-HIV_Chain
  source 1..378: mol_type = other RNA
caagtacaattagtacaaagtggagcagcagtaaaaaaaccaggagcaagtgtaaaagtaagttgtgaaacatatggatataaatttacagatcattttatgcattggtggagacaagcaccaggacaaggattagaatggatgggatggataaatccatatagttcagcagtaagttatagtccaagatatcaaggaagagtaacaatgacaagagatacatttttagaaacagtatatatggaattaagaggattaagatttgatgatacagcaatatattattgtgcaacaccaaaaagtggaagagattattggagctttgatttatggggacaaggaacattagtaacagtatcaagcgcaagtacaaaagga

SEQ ID NO: 50133 - RNA, 378 nt, synthetic construct
  misc_feature 1..378: note = derived and/or modified sequence opt6 from anti-HIV_Chain
  source 1..378: mol_type = other RNA
caagtacaattagtacaaagtggagcagcagtaaaaaaaccaggagcaagtgtaaaagtaagttgtgaaacatatggatatacatttacagatcattttatgcattggtggagacaagcaccaggacaaggattagaatggatgggatggataaatccatatagttcagcagtaagttatagtccaagatatcaaggaagagtaacaatgacaagagatacatttttagaaacagtatatatggaattaagaggattaaaatttgatgatacagcaatatattattgtgcaacaccaaaaagtggaagagattattggagctttgatttatggggacaaggaacattagtaacagtatcaagtgcaagcacaaaagga

SEQ ID NO: 50134 - RNA, 378 nt, synthetic construct
  misc_feature 1..378: note = derived and/or modified sequence opt6 from anti-HIV_Chain
  source 1..378: mol_type = other RNA
caagtacaattagtacaaagcggagcagaagtaaaaaaaccaggaagtagtgtaaaagtaagttgtaaaacaagtggagtaagattttcaagcaatgcaataagttgggtaagacaagcaccaggacaaggattagaatggatgggaagaacaacaccaatgctaggaggagcaaatcatgcaccaagttttaaaggaagagtaacaataagtgcagatgaaagtacaagaacagtatatatggaaatgtcaagtttaagatatgaagatacagcagtatattattgtgcaagtggaagaagagaaggattaaattttttattagattattggggacaaggaacattagtaacagtaagtagtgcaagtacaaaagga

SEQ ID NO: 50135 - RNA, 378 nt, synthetic construct
  misc_feature 1..378: note = derived and/or modified sequence opt6 from anti-HIV_Chain
  source 1..378: mol_type = other RNA
caagtacaattacaagaatcaggaccaggactagtaaaaccatcagaaacattatcactaacatgcacagtatcaggaggatcaatatcaacatactactggtcatggataagacaaccaccaggaaaaggactagaatggataggatacatatcatactcaggatcaacaaactacaacccatcactaaaatcaagagtaacaatatcagtagacacatcaaaaaaccaattctcactaaaactatcatcagtaacagcagcagacacagcagtatactactgcgcaagacacaaatcagtactactatggttcagagaactagactactggggacaaggaacactagtaacagtctcatcagcatcaacaaaagga

SEQ ID NO: 50136 - RNA, 378 nt, synthetic construct
  misc_feature 1..378: note = derived and/or modified sequence opt6 from anti-HIV_Chain
  source 1..378: mol_type = other RNA
caagtacaactagtacaaagcggagcagaagtaaaaaaaccaggagcagcagtaaaaatatcatgcaaagcatcaagattcacattctcatcatactacatacactgggtaagacaagcaccaggacaaggactagaatggatgggaataataaacccatcaggaggatcaacatcaaacgcacaaaaattccaagacagagtaacactaacaagagacatgtcaacaggaacagtatacatggaactatcaagactaacatcagaagacacagcagtatactactgcgcaacaccagaaccatcatcaatagtagcaccattatactactggggacaaggaacactagtaacagtaagcagcgcatcaacaaaagga

SEQ ID NO: 50137 - RNA, 378 nt, synthetic construct
  misc_feature 1..378: note = derived and/or modified sequence opt6 from anti-HIV_Chain
  source 1..378: mol_type = other RNA
caagtacaattagtacaaagcggagcagaaatgaaaaaaccgggagcaagcgtaaaagtaagctgtaaagcaagcggacacacattcacaaactattacatgcactgggtaagacaagcaccaggacaaggattagaatggatgggaatgataaatccaacaggagatagcacaagatatgcacaaagatttcaaggaagagtaacaatgacaagagacacaagcacaagaacagtatatatggaattatcaagcttaagatcggacgatacagcagtatattactgtgcaagagcacatcacgatttctggagagcaccagtagacgtatggggaaaaggaacaacagtaacagtatcaagcgcaagcacaaaagga

SEQ ID NO: 50138 - RNA, 378 nt, synthetic construct
  misc_feature 1..378: note = derived and/or modified sequence opt6 from anti-HIV_Chain
  source 1..378: mol_type = other RNA
caagtagtactaatacaatcaggagcagaagtaaaaagaccaggaagctcagtaaaagtatcatgtaaagcatcaggaggatcatttccaataacatgggtaagacaagcaccaggacacggactagaatggatgggaggaataaatccatttttcggaacaacaaactatgcacaaaaatttcaaggaagagtaagcataacagcagacgaaagcacaagcacaacatatttacatctatcagacttaagatcagaagatacagcagtatatttctgtgcaagagaaaatagagaaaaatggctagtactaagaagctggttcgcaccatggggacaaggaacattagtaacagtaagctcagcatcaacaaaagga

SEQ ID NO: 50139 - RNA, 378 nt, synthetic construct
  misc_feature 1..378: note = derived and/or modified sequence opt6 from anti-HIV_Chain
  source 1..378: mol_type = other RNA
agtcaacaattagtacaaagtggagcacaagtaaaaaaaccaggagcaagtgtaagagtaagttgtcaagcaagtggatatacatttacaaatcattttttacattggtggagacaagcaccaagacaaggattagaatggatgggatggataaatccagtacatggaggaagaaattatgcaagaagatttcaaggaagaataaattttggaagagatgtatatcaagaaacagcatatatggaattaagtggattaagaaatgatgatacagcaacatatttttgtgcaagaggaggaggagatggaagaaattggcatttacatccatggggacaaggaacattagtaatagtaagcgcagcaagtacaaaagga

SEQ ID NO: 50140 - RNA, 378 nt, synthetic construct
  misc_feature 1..378: note = derived and/or modified sequence opt6 from anti-HIV_Chain
  source 1..378: mol_type = other RNA
gaagtacaagtagtagaaagtggaggaggattagtacaaccaggaggaagtttaagattaagttgtgtagcaagtggatttacatttagtgaatattggatgagttgggtaagacaagcaccaggaaaaggattagaatgggtagcaacaataaaaagagatggaagtgaagaaagttatgtagatagtgtaaaaggaagatttacaataagtagagataatgcaaaaaatagtttatatttacaaatgaatagtttaagagcagaagatacagcagtatattattgtgcaagagtaagagatccaaattataatttacattttgatagctggggacaaggaacattagtaacagtaagtagtgcaagtacaaaagga

SEQ ID NO: 50141 - RNA, 378 nt, synthetic construct
  misc_feature 1..378: note = derived and/or modified sequence opt6 from anti-HIV_Chain
  source 1..378: mol_type = other RNA
ttagtacaattagtagaaagtggaggaggagtggtacaaccaggaaaaagtttaagattaagttgtgcaacaagcggatttacatttagtacatatggaatgcattgggtaagacaagcaccgggaaaaggattagaatgggtagcagtaatatggtatgatggaagttataaatattatgcagatagtgtaaaaggaagatttacaataagtagagataatagtaaaaatacattatttttacaaatgaatagtttaagagcagaagatacagcaatgtattattgtggaagagaaatggcagtaggaggaacaaaagcattagatcattggggacaaggaacattagtaacagtaagtagtgcaagtacaaaaggg

SEQ ID NO: 50142 - RNA, 378 nt, synthetic construct
  misc_feature 1..378: note = derived and/or modified sequence opt6 from anti-HIV_Chain
  source 1..378: mol_type = other RNA
gaattccaactagtacaatcaggaggaggactagtaaaaccaggaggatcattaagactatcgtgcacaggatcaacatttagctttagctcagacgatatgaattgggtaagacaagcaccaggaaaaggattagaatgggtatcaagcatgagcgatagcggaagccatatatattacgcagactttgtaaaaggaagattcacaatatcaagagataacgcaaaaaaaagtttatacttacaaatgaactcactaagagcagaagacacagcagtatactattgcgcacaatcaagaccaccacaaagattatacggaatggatgtatggggacaaggaacaacagtaacagtaagctcagcatcaacaaaagga

SEQ ID NO: 50143 - RNA, 381 nt, synthetic construct
  misc_feature 1..381: note = derived and/or modified sequence opt6 from anti-HIV_Chain
  source 1..381: mol_type = other RNA
gaagtgcaattagtagaaagtggaggaggagtagtgcaaccaggaggaagtttaagactaagttgtgcagcaagcggatttatgtttaaaaattatgcaatgcattgggtaagacaaccaccaggaaaaggattagaatgggtagcagtaatatggtatggaggaagagatcaaaattatgcagatagtgtaaaaggaagatttacaataagtagagatgatagtgataatacattatatttacaaatgaatagtttaagagcaggagatacagcagtatatttttgtgcaagaaatagtcaagtaggaagattaatgccagcagcaggagtatggggacaaggaacattagtaacagtaagtagtgcaagtacaaaagga

SEQ ID NO: 50144 - RNA, 381 nt, synthetic construct
  misc_feature 1..381: note = derived and/or modified sequence opt6 from anti-HIV_Chain
  source 1..381: mol_type = other RNA
caaggacatttagtacaaagcggaggaggagtaaaaaaattaggaacaagtgtaacaataagttgtttagcaagtgaatatacatttaatgaatttgtaatacattggataagacaagcaccaggacaaggaccattatggttaggattaataaaaagaagtggaagattaatgacaagttatcaatttcaagatagattaagtttaagaagagatagaagtacaggaacagtatttatggaattaagaggattaagagtagatgatacagcagtatattattgtgcgagagatggattaggagaagtagcaccagcatatttatatggaatagatgcatggggacaaggaacaacagtaatagtaacaagtgcaagtaca

SEQ ID NO: 50145 - RNA, 381 nt, synthetic construct
  misc_feature 1..381: note = derived and/or modified sequence opt6 from anti-HIV_Chain
  source 1..381: mol_type = other RNA
caagtacaattactagaaagcggaggaggactagtacaaagaggaggaagcttaagattaagttgtacagcaagtggattcgtatttaataattattggatgacatgggtaagacaagcaccaggaaacggattagaatgggtagcaaatatagatcaagatggaagtgaaaaacactatttagatagtgtaaaaggaagatttacaataagtagagataatgcaaaaaacagtttatatttacaaatgaatagtttaagagcagaagatacagcaatatattactgtgcaagagtaagatttaaagtaacagcatggcacagattcgatagctgggggcaaggagatttagtaacagtaagcagtacaagtacaaaagga

SEQ ID NO: 50146 - RNA, 381 nt, synthetic construct
  misc_feature 1..381: note = derived and/or modified sequence opt6 from anti-HIV_Chain
  source 1..381: mol_type = other RNA
caatcagcactaacacaaccaccatcagcatcaggaacaccaggccaaagagtaacaatatcatgctcaggatcataccacaacataggatcaaacgcagtaaactggtaccaacaactaccaggaacagcaccaaaattattaatatactcaaacgaccaaagaccatcaggagtaccagacagattctcaggatcaaaatcaggaacatcagcatcactagcaatatcaggactacaatcagaagacgaagcagactactactgcgcagcatgggacgattcactacacgtattcggaacaggaacaaaagtaacagtactaggacaaccaaaagcaaacccaacagtaacactattcccaccatcatcagaagaacta

SEQ ID NO: 50147 - RNA, 381 nt, synthetic construct
  misc_feature 1..381: note = derived and/or modified sequence opt6 from anti-HIV_Chain
  source 1..381: mol_type = other RNA
caaagcgtactaacacaagtactatcagtatcaggaacaccaggacaaagagtaataatatcatgctcaggaacaagctcaaacgtaggaggaaacttagtatcatggtatcaacatctaccaggagcagcaccaagattactaatacacagagacgatcaaagaccatcaggagtaccagatagatttagcggatcaaaaagcggaaactcagcaagtctagtaatatcaggattaagatcagacgatgaagcagactatttctgtgcagcatacgattcaacattctcattaccagtatttggaggaggaacaagattaacagtactatcacaaccaaaagcagcaccaagcgtaacattattcccaccatcaagcgaa

SEQ ID NO: 50148 - RNA, 381 nt, synthetic construct
  misc_feature 1..381: note = derived and/or modified sequence opt6 from anti-HIV_Chain
  source 1..381: mol_type = other RNA
caagtacaattattacaaagtggagcagcagtaacaaaaccaggagcaagtgtaagagtaagttgtgaagcaagtggatataatataagagattattttatacattggtggagacaagcaccagggcaaggattacaatgggtaggatggataaatccaaaaacaggacaaccaaataatccatgtcaatttcaaggaagagtaagtttaacaagacatgcaagttgggattttgatacattttcattttatatggatttaaaagcattaagatcagatgatacagcagtatatttttgtgcaagacaaagaagcgattattgggattttgatgtatggggaagtggaacacaagtaacagtatcaagtgcaagtacaaaa

SEQ ID NO: 50149 - RNA, 381 nt, synthetic construct
  misc_feature 1..381: note = derived and/or modified sequence opt6 from anti-HIV_Chain
  source 1..381: mol_type = other RNA
caagtacaattagtacaaagcggaggagaagtaagaaaaccaggatcaagcgtaaaagtaccatgtaaaataagcggaaacgcattcagtaactatggagtaaactgggtaagacaagcaccaggacaaggactagaatgggtaggaagaataataccagtaataggagtagcacaacatgcaccaaaatttcaaggaagagtaacaataacagcagacaaaagcacaacaacagcatatctagaactatcaagcctaagatcagacgatacagcagtatatttctgtgcaaaagaccatggagatccaagaacaggatattatttcgattactggggacaaggagcattagtaacagtaagttcagcatcaacaaaagga

SEQ ID NO: 50150 - RNA, 381 nt, synthetic construct
  misc_feature 1..381: note = derived and/or modified sequence opt6 from anti-HIV_Chain
  source 1..381: mol_type = other RNA
caagtacaattaggacaatcaggaacagaagtaaaaaaaccaggattttcagtaaaagtttcatgtaaagcatcaggaggatcaagtacagcatatggatattcatgggtaagacaagcaccaggacaaggattcgaatggatgggaagaataataccattttacggaataataacatatgcaccaaaatttcaaggaagagtaacaataacagcagacagatcaacaagcacagtatatatggaactaacatcattaacatttgcagatacagcactatttttctgtgcaagagactttggagatccaagaaacggatactatttcgattcatgggaccaaggattatggttaacagtatcatcagcaagtacaaaagga

SEQ ID NO: 50151 - RNA, 381 nt, synthetic construct
  misc_feature 1..381: note = derived and/or modified sequence opt6 from anti-HIV_Chain
  source 1..381: mol_type = other RNA
caagtacaattagtacaaagcggagcagaagtaaaaaaaccaggatcaagtgtaaaagtaagctgtaaagcaagcggaggaacattcagcaactatgcaataagctgggtaagacaagcaccaggacaaggactagaatggatgggaggaataataccaatattcgaagcagcaagctatgcacaaaaatttcaagatagattaacaataacaacagacgaaagtacaacaacagcatatatggatctatcaagtttaagatcagaagatacagcaatatattactgtgcaagagcacaaggagatatattaacagaaggatatttcgattactggggacaaggaacactagtaacagtgagctcagcatcaacaaaagga

SEQ ID NO: 50152 - RNA, 381 nt, synthetic construct
  misc_feature 1..381: note = derived and/or modified sequence opt6 from anti-HIV_Chain
  source 1..381: mol_type = other RNA
caagtacaactacaagaatcaggaccaggactagtaaaaccatcagaaacattatcactaacatgcacagtatcaggaggatcaatatcatcagcaggatactactggtcatggataagacaacacccagaaaaaggactagaattcataggatacatatactacctaggaacaacatactacaacccatcactaaaatcaagagtatcaatatcaatagacacatcaaacaaccaattctcactagaactatcatcagtatcagcagccgacacagcaatatactactgcgcaagagactacacagcatcaggaagacacttcttcgactactggggacaaggaacactagtaacagtatcatcagcatcaacaaaagga

SEQ ID NO: 50153 - RNA, 381 nt, synthetic construct
  misc_feature 1..381: note = derived and/or modified sequence opt6 from anti-HIV_Chain
  source 1..381: mol_type = other RNA
caagtacaattagtacaaagtggagcagaagtaaaaaaaccaggagcatcagtaaaagtaagttgtaaagcaccaggatatacatttataggacattatatgcattggataagacaagcaccaggacaaggattagaatggatgggatggataaatccaaatagtggagatacaaattatgcacaaacatttcaaggaagagtaacaatgacaagagatacaagtataagtacagcatatatggaattaacaagattaagaagtgatgatacagcagtatattattgtgcaagagatttaagaccaatgagaggaaattgggcaatgcatgtatggggagaaggaacaacagtaacagtaagtagtgcaagtacaaaagga

SEQ ID NO: 50154 - RNA, 381 nt, synthetic construct
  misc_feature 1..381: note = derived and/or modified sequence opt6 from anti-HIV_Chain
  source 1..381: mol_type = other RNA
caagtacaattacaagaatcaggaccaggactagtaaaaccatcagaaacattatcactaacatgcacagtattcggagcatcaataagatcattctactggcactggataagacaatcaccaggaaaaggattagaatggctaggatcagtattcgacaacggactaacaacatacaacccatcactaaaaaacagactatcaatatcagaagacccatcaagaaaccaaatatcattaaacttacgatcaatgacagcagcagacacagcagtatactactgcgcaagagcagactacgacctactaacatcatcataccacttcgactcatggggacaaggaacactagtaacagtatcatcagcatcaacaaaagga

SEQ ID NO: 50155 - RNA, 381 nt, synthetic construct
  misc_feature 1..381: note = derived and/or modified sequence opt6 from anti-HIV_Chain
  source 1..381: mol_type = other RNA
agtcaacaattagtacaatcaggaacacaagtaaaaaaaccaggagcatcagtaagagtaagttgtcaagcaagtggatatacatttacagattatgtattacattggtggagacaagcaccaggacaaggattagaatggatgggatggataaaaccagtatatggagcaagaaattatgcacatagatttcaaggaagaataaattttgatagagatgtatatagagaaatagcatatatggatctaagtggattaagaagtgatgatacagcagtatatttttgtgcaagagatggaagtggagatgcaacaagttggcatttacatccatggggacaaggaacattagtaatagtaagtagtgcaagtacaaaagga

SEQ ID NO: 50156 - RNA, 381 nt, synthetic construct
  misc_feature 1..381: note = derived and/or modified sequence opt6 from anti-HIV_Chain
  source 1..381: mol_type = other RNA
agtcaacaattagtacaaagcggaacacaagtcaaaaaaccaggagcaagcgtaagagtaagttgtcaagcaagtggatacacattcacaaattatatattacactggtggagacaagcaccaggaagaggactagaatggatgggattaataaaaccagtatatggagcagtaaactatgcaagacaatttcaaggaagaatacaattaacaagagacatatacagagaaatagcatttttagatttatcaggactaagaccagatgatacagcagtatattattgtgcaagagatgaaagtggatacgatttaaactggcatttagatagctggggacaaggaacacaagtaatagtaagtccagcatcaacaaaagga

SEQ ID NO: 50157 - RNA, 381 nt, synthetic construct
  misc_feature 1..381: note = derived and/or modified sequence opt6 from anti-HIV_Chain
  source 1..381: mol_type = other RNA
agtcaacaattagtacaaagtggagcacaagtaaaaaaaccaggagcaagtttaagagtaagttgtcaagcaagtggatatacatttatgaattatttattacattggtggagacaagcaccaggacaaggattagaatggatgggatggataaatccagtatatggagcagtaaattatgcacatagatttcaaggaagattaacatttagcagagatgtatatagagaaatagcatatatggatttaaatggattaagaagtgatgatacagcagtatatttttgtgcgagagatggaagtggagatgatagaaattggcatttagatccatggggacaaggaacattagtaatagtaagtagtgcaagtacaaaagga

SEQ ID NO: 50158 - RNA, 381 nt, synthetic construct
  misc_feature 1..381: note = derived and/or modified sequence opt6 from anti-HIV_Chain
  source 1..381: mol_type = other RNA
agtcaacaactagtacaaagtggaacacaagtaaaaaaaccaggggcaagtgtaagaataagttgtcaagcaagtggatatacatttacagattatgtattacattggtggagacaagcaccaggacaaggattagaatggatgggatggataaaaccagtatatggagcaagaaattatgcaagaagatttcaaggaagaataaattttgatagagatatatatagggaaatagcatttttagatttatcaggattaagaagtgatgatacagcaagatatttttgtgcaagagatggaagtggagatgatacaagttggcatttacatccatggggacaaggaacattagtaatagtaagtgcagcaagtacaaaagga

SEQ ID NO: 50159 - RNA, 381 nt, synthetic construct
  misc_feature 1..381: note = derived and/or modified sequence opt6 from anti-HIV_Chain
  source 1..381: mol_type = other RNA
agtcaacaattagtacaaagtggaacacaagtaaaaaaaacaggagcaagtgtaagagtaagttgtcaagcaagtggatatgattttacaaaatatttaatacattggtggagacaagcaccaggacaaggattagaatggatgggatggatgaaaccagtatatggagcaacaaattatgcacatagatttcaaggaagaataagttttacaagagatatatatagagaaatagcatttatggatttaaatggattaagaagtgatgatacagcagtatatttttgtgcaagagatggaggaggagatgatagaacatggttattagatgcatggggacaaggaacattagtaatagtaagtagtgcaagtacaaaagga

SEQ ID NO: 50160 - RNA, 381 nt, synthetic construct
  misc_feature 1..381: note = derived and/or modified sequence opt6 from anti-HIV_Chain
  source 1..381: mol_type = other RNA
agtcaacaattagtacaaagtggaacacaagtaaaaaaaccaggagcaagtgtaagagtaagttgtcaagcaagtggatatacatttatgaattatataatacattggtggagacaagcaccaggacaaagattagaatggatgggatggataaatccagtatttggagcaagaaattatgcacatagatttcaaggaagaataaattttgatagagatataaatagagaaacatttcaaatggatttaacaggattaagaagtgatgatacagcagtatattattgtgcaagagatggaagtggagatgcaagagattggcatttacatccatggggacaaggaacattagtaatagtaagtagcgcaagtacaaaagga

SEQ ID NO: 50161 - RNA, 381 nt, synthetic construct
  misc_feature 1..381: note = derived and/or modified sequence opt6 from anti-HIV_Chain
  source 1..381: mol_type = other RNA
agtcaacatttagtacaaagtggaacacaagtaaaaaaaccaggagcaagtgtaagagtaagctgtcaagcaagtggatatacatttacaaattatatattacattggtggagacaagcaccaggacaaggattagaatggatgggattaataaaaccagtatttggagcagtaaattatgcaagacaatttcaaggaagaatacaattaacaagagatataaatagagaaatagcatttttagatttaagtggattaagaagtgatgatacagcagtatattattgtgcaagagatgaaagtggagatgatttaaaatggcatttacatccatgggggcaaggaacacaagtaatagtaagtccagcaagtacaaaagga

SEQ ID NO: 50162 - RNA, 381 nt, synthetic construct
  misc_feature 1..381: note = derived and/or modified sequence opt6 from anti-HIV_Chain
  source 1..381: mol_type = other RNA
agtcaacaattagtacaaagtggaacacaagtaaaaaaaccaggagcaagtgtaagagtaagttgtcaagcaagtggatatacatttatgaattatataatacattggtggagacaagcaccaggacaaagattagaatggatgggatggataaatccagtatttggagcaagaaattatgcacatagatttcaaggaagaataaattttgatagagatataaatagagaaacattccaaatggaattaacaggattaagaagtgatgatacagcagtatattattgtgcaagagatggaagtggagatgcaagagattggcatttagatccatggggacaaggaacattagtaatagtaagttcagcaagtacaaaagga

SEQ ID NO: 50163 - RNA, 381 nt, synthetic construct
  misc_feature 1..381: note = derived and/or modified sequence opt6 from anti-HIV_Chain
  source 1..381: mol_type = other RNA
agtcaacaattagtacaaagtggaacacaagtaaaaaaaccaggagcaagtgtaagaataagttgtcaagcaagtggatatacatttacagattatgtattacattggtggagacaagcaccaggacaaggattagaatggatgggatggataaaaccagtatatggagcaagaaattatgcaagaagatttcaaggaagaataaattttgatagagatatatatagagaaatagcatatatggatttaagtggattaagaagtgatgatacagcaagatatttttgtgcaagagatggaagtggagatgatacaagttggcatttacatccatggggacaaggaacattagtaatagtaagtgcagcaagcacaaaagga

SEQ ID NO: 50164 - RNA, 381 nt, synthetic construct
  misc_feature 1..381: note = derived and/or modified sequence opt6 from anti-HIV_Chain
  source 1..381: mol_type = other RNA
agtcaacaattagtacaaagtggaacacaagtaaaaaaaccaggagcatcagtaagaataagttgtcaagcaagtggatatagttttacagattatgtattacattggtatagacaagcaccaggacaaggattagaatggatgggatggataaaaccagtatatggagcaagaaattatgcaagaagatttcaaggaagaataaattttgatagggatatatatagagaaatagcatttatggatttaagcggattaagaagtgatgatacagcattatatttttgtgcaagagatggaagtggagatgatacaagttggtatttagatccatggggacaaggaacattagtaatagtaagtgcagcaagtacaaaagga

SEQ ID NO: 50165 - RNA, 381 nt, synthetic construct
  misc_feature 1..381: note = derived and/or modified sequence opt6 from anti-HIV_Chain
  source 1..381: mol_type = other RNA
tcacaacaattagtacaaagtggaacacaagtaaaaaaaccaggagcaagtgtaagaataagttgtcaagcaagtggatatagttttacagattatgtactacattggtggagacaagcaccaggacaaggattagaatggatgggatggataaaaccagtatatggagcaagaaattatgcaagaagatttcaaggaagaataaattttgatagagatatatatagagaaatagcatttatggatttaagtggactaaggagtgatgatacagcattatatttttgtgcaagagatggaagtggagatgatacaagttggcatttagatccatggggacaaggaacattagtaatagtaagtgcagcaagtacaaaagga

SEQ ID NO: 50166 - RNA, 381 nt, synthetic construct
  misc_feature 1..381: note = derived and/or modified sequence opt6 from anti-HIV_Chain
  source 1..381: mol_type = other RNA
agtcaacatttagtacaaagcggaacacaagtaaaaaaaccaggtgcaagtgtaagagtaagttgtcaagcaagtggatatacatttacaaattatatattacattggtggagacaagcaccaggacaaggattagaatggatgggattaataaaaccagtatttggagcagtaaattatgcaagacaatttcaaggaagaatacaattaacaagagatatatatagagaaatagcatttttagatttatcaggattaagatcagatgatacagcagtatattactgtgcaagagatgaaagtggagatgatttaaaatggcatttacatccatggggacaaggcacacaagtaatagtaagtccagcatcaacaaaagga

SEQ ID NO: 50167 - RNA, 381 nt, synthetic construct
  misc_feature 1..381: note = derived and/or modified sequence opt6 from anti-HIV_Chain
  source 1..381: mol_type = other RNA
caagtacaattagtagaaagcggaggaggagtagtacaaccaggaaaaagcttaagattaagttgtgcaataagcggattcttatttaataattatggaggacaatgggtaagacaagcaccaggaaaaggactagaatgggtagcagcaatatcatacgatggaaataacagatactatgcagatagcgcaaaaggaagatttctaataagtagagacacaccaaaaaacatactatatctacaaatatatagtttaagattagacgatacagcagtatattactgtgcaagagactcagtatcaaaatcatactcagcaccaccagaattctggggacaaggaacagtagtaacagtaagctcagcatcaacaaaagga

SEQ ID NO: 50168 - RNA, 381 nt, synthetic construct
  misc_feature 1..381: note = derived and/or modified sequence opt6 from anti-HIV_Chain
  source 1..381: mol_type = other RNA
caagtacacctagaagaaagcggaccaggattagtaaaaacaagccaaacattaagcctaacatgttcagtaagctcatactcaatatcaagatcaggatatttctggacatggataagacaaagaccaggaaaaggattagaatggataggatatatatatttcaatggaagaacaacatacaatccatcactaaaatcaagaataacaatatcaagagatacatcacactcacaatttagcctaacattaaactcactatcagcagcagacacagcagtatactactgcggaagatgtcaagacggattagcatcaagaccaatagatttctggggacaaggaacattagtaacagtaagctcagcatcaacaaaagga

SEQ ID NO: 50169 - RNA, 381 nt, synthetic construct
  misc_feature 1..381: note = derived and/or modified sequence opt6 from anti-HIV_Chain
  source 1..381: mol_type = other RNA
caagtacaattagtagaaagtggaggaggagtagtacaaccaggaagaagtctaagattaagttgtgcaacaagtggatttacaagtaaaaattatggagtacattgggtaagacaagcaccaggaaaaggattagaatgggtagcagtaatatggtatgatggaagtaataaattttatgcagatagtgtaaaaggaagatttacaataagtagagatagaagtaaaaatatggtatatttacaaatgaatagtttaagagtagaagatacagcaatatattattgtgcaagagatagtgtagcatttgtattagaaggaccaatagattattggggacaaggaacattagtaacagtaagtagtgcaagtacaaaagga

SEQ ID NO: 50170 - RNA, 384 nt, synthetic construct
  misc_feature 1..384: note = derived and/or modified sequence opt6 from anti-HIV_Chain
  source 1..384: mol_type = other RNA
caagtacaattagtacaaagcggaggaggagtaaaaaaaccaggaacaagcgcaagctttagctgtagaacaagcgatgacatatacgataacgaattctttgactcagcatttatgcattgggtaagattaataccaggacaaagaccagaatggatgggatggatgaacccaagatcaggagcagtaaattacgcaagacaactacaaccaagagtatcaatgtatagagatagagatctatcaacagcatacatggaatttaaatcactaacaagtgcagacacaggaacatacttttgcgcaagaaaaaaaagaggagatggatttaacttatactttgacttatggggaagaggaagccaagtaatagtatcaagtgca

SEQ ID NO: 50171 - RNA, 384 nt, synthetic construct
  misc_feature 1..384: note = derived and/or modified sequence opt6 from anti-HIV_Chain
  source 1..384: mol_type = other RNA
caaggacatttagtacaaagtggaggaggagtaaaaaaattaggaacaagtgtaacaataagttgtttagcatcagaagatacatttaatgaatttgtaatacattggataagacaagcaccaggacaaggaccattatggttaggattaataaaaagaagcgggagattaatgacaagttatcaatttcaagatagattaagcttaagaagagatagaagtacaggaacagtatttatggaattaagaggattaagagtagatgatacagcagtatattattgtgcaagagatggattaggagaagtagcaccagcatatttatatggaatagatgcatggggacaaggaacaacagtaatagtaacaagtgcaagtacaagt

SEQ ID NO: 50172 - RNA, 384 nt, synthetic construct
  misc_feature 1..384: note = derived and/or modified sequence opt6 from anti-HIV_Chain
  source 1..384: mol_type = other RNA
caatcagcattaacacaaccaccatcagtatcaggagcaccaggacaaagagtaacaatatcatgttcaggaggcccatcaaacgtaggaggaaactacgtatactggtacagacaattcccaggaacagcaccaaaattactaatactaagagacgaccaaagaccatcaggagtaccagacagattctcagcatcaaaatcaggaaactcagcatcattagcaatatcaggactaagaccagacgacgaagcattctacttctgcgcaacatacgactcacaaggatcattcagagtcttcggaggaggaacagcactaacagtactatcacaaccaaaagcagcaccatcagtaacactatacccaccatcatcagaagaa

SEQ ID NO: 50173 - RNA, 384 nt, synthetic construct
  misc_feature 1..384: note = derived and/or modified sequence opt6 from anti-HIV_Chain
  source 1..384: mol_type = other RNA
aacttcatgctaacacaaccaccatcagcatcaggaacaccaggacaaagagtaacaatatcctgctcaggaggaggatcaaacataggaggtaacctagtatcatggtaccaacacttcccaggagcagcaccaaaactattaatatacagaaacgaccaaagaccatcaggagtaccagacagattctcaggatcaaaatcaggaacatccgcatcactagcaatatcaggactaagatcagacgacaaagcaacatacttctgcgcagcatacgactcaacactatcactaagactattcggaggaggaacaacactaacagtactatcacaaccaaaagcagcaccatcagtaacactattcccaccatcatcagaagaa

SEQ ID NO: 50174 - RNA, 384 nt, synthetic construct
  misc_feature 1..384: note = derived and/or modified sequence opt6 from anti-HIV_Chain
  source 1..384: mol_type = other RNA
aacttcatgctaacacaaccaccatcagtatcagcaacaccaggacaaacagtaacaatatcatgctcaggatcaggatcaaacgtaggaggaaaccacgtatactggtacagacaactaccaggagcagcaccaacactagtaatatcaaaaacagaccacagaccatcaagagtacccgatagattctcaggatcaaaatcaggaaactcagcatcactagcaatatcaggactaagaccagacgacgaagcagtatacttctgcgcaacatacgacacaggactatcactaagactattcggaggaggaacaagactaacagtactatcacaaccaaaagcagcaccatcagtaacacaattcccaccatcatcagaagaa

SEQ ID NO: 50175 - RNA, 384 nt, synthetic construct
  misc_feature 1..384: note = derived and/or modified sequence opt6 from anti-HIV_Chain
  source 1..384: mol_type = other RNA
caatcagcactaacacaaccaccctcagcatctggagcaccaggacaaagagtaacaatatcatgctcaggaggaccatcaaacgtaggaggaaactatgtatattggtatagacaattcccaggaacagcaccaaaattactaatactaagagacgatcaaagaccatctggagtaccagacagattttcagcatcaaaatcaggaaactcagcatcactagcaatatcaggattaagaccagacgatgaagcactatatttctgtgcaacatacgattcagatggatcaataagattattcggaggaggaacagcattaacagtactatcacaaccaaaagcagcaccatcagtaacattattcccaccaggatgggaagaa

SEQ ID NO: 50176 - RNA, 384 nt, synthetic construct
  misc_feature 1..384: note = derived and/or modified sequence opt6 from anti-HIV_Chain
  source 1..384: mol_type = other RNA
caagtacaattactacaaagcggagcagcagtaacaaaaccaggagcaagtgtaagagtaagttgtgaagcaagtggatataatataagagattattttatacattggtggagacaagcgccaggacaaggattacaatgggtaggatggataaatccaaaaacaggacaaccaaataatccaagattatttcaaggaagagtaagtttaacaagacatgcaagttgggattttgatacattttcattttatatggatctaaaagcagtaagaagtgacgatacagcagtatatttttgtgcaagacaaagaagtgattattgggattttgatgtatggggaagtggaacacaagtaacagtatcaagtgcaagtacaaaagga

SEQ ID NO: 50177 - RNA, 384 nt, synthetic construct
  misc_feature 1..384: note = derived and/or modified sequence opt6 from anti-HIV_Chain
  source 1..384: mol_type = other RNA
caagtacaattattacaaagtggagcagtagtaacaaaaccaggagcaagtgtaagagtaagttgtgaagcaagtggatataaaataagagattattttatacattggtggagacaagcaccaggacaaggattacaatgggtaggatggataaatccacaaacaggacaaccaaatataccaagaccatttcaaggaagagtaacattaacaagacatgcaagttgggattttgatacattttcattttatatggatttaaaagcactaagaagtgatgatacagcaatatatttttgtgcaagaagaagaagtgattattgtgattttgatgtatggggaagtggaactcatgtaacagtatcaagtgcaagcacaaaagga

SEQ ID NO: 50178 - RNA, 384 nt, synthetic construct
  misc_feature 1..384: note = derived and/or modified sequence opt6 from anti-HIV_Chain
  source 1..384: mol_type = other RNA
caagtacaattattacaaagtggagcagcagtaacaaaaccaggagcaagtgtaagagtaagttgtgaagcaagtggatataatataagagattattttatacattggtggagacaagcaccaggacaaggattacaatgggtaggatggataaatccaaaaacaggacaaccaaataatccaagacaatttcaaggaagagtaagtttaacaagacaagcaagttgggattttgatacaatatcattttatatggatttaaaagcattaagattagatgatacagcagtatatttttgtgcaagacaaagaagtgattattgggattttgatgtatggggaagtggaacacaagtaacagtatcaagtgcaagtacaaaagga

SEQ ID NO: 50179 - RNA, 384 nt, synthetic construct
  misc_feature 1..384: note = derived and/or modified sequence opt6 from anti-HIV_Chain
  source 1..384: mol_type = other RNA
caagtacaattattacaaagtggagcagcagtaacaaaaccaggagcaagtgtaagagtaagttgtgaagcaagcggatataatataagagattattttatacattggtggagacaagcaccaggacaaggattacaatgggtaggatggataaatccaaaaacaggacaaccaaataatccaagacaatttcaaggaagagtaagtttaacaagacatgcaagttgggattttgatacattttcattttatatggatttaaaagcattaagatcagatgatacagcagtatatttttgtgcaagacaaagaagtgattattgggattttgatgtatggggaagtggaacacaagtaacagtatatagtgcaagtacaaaagga

SEQ ID NO: 50180 - RNA, 384 nt, synthetic construct
  misc_feature 1..384: note = derived and/or modified sequence opt6 from anti-HIV_Chain
  source 1..384: mol_type = other RNA
caagtacaattattaccatttggaggagcagtaacaaaaccaggagcaagtgtaagagtaagttgtgaagcaagtggatataatataagagattattttatacattggtggagacaagcaccaggacaaggattacaatgggtaggatggataaatccaaaaacaggacaaccaaataatccatgtcaatttcaaggaagagtaagtttaacaagaccagcaagctgggattttgatacaatatcattttatatggatttaaaagcattaagattagatgatacagcagtatatttttgtgcaagacaaagaagtgattattgggattttgatgtatggggaagtggaacacaagtaacagtatcaagtgcaagtacaaaagga

SEQ ID NO: 50181 - RNA, 384 nt, synthetic construct
  misc_feature 1..384: note = derived and/or modified sequence opt6 from anti-HIV_Chain
  source 1..384: mol_type = other RNA
caagtacatttaagtcaaagtggagcagcagtaacaaaaccaggagcaagtgtaagagtaagttgtgaagcaagtggatataaaataagtgatcattttatacattggtggagacaagcaccaggacaaggattacaatgggtaggatggataaatccaaaaacaggacaaccaaataatccaagacaatttcaaggaagagtaagtttaacaagacaagcaagttgggattttgatacatattcattttatatggatttaaaagcattaagatcagatgatacagcaatatatttttgtgcaagacaaagaagtgatttttgggattttgatgtatggggaagtggaacacaagtaacagtatcaagcgcaagtacaaaagga

SEQ ID NO: 50182 - RNA, 384 nt, synthetic construct
  misc_feature 1..384: note = derived and/or modified sequence opt6 from anti-HIV_Chain
  source 1..384: mol_type = other RNA
caagtacacttaagtcaaagtggagcagcagtaacaaaaccaggagcaagtgtaagagtaagttgtgaagcaagtggatataaaatatcagatcattttatacattggtggagacaagcaccaggacaaggattacaatgggtaggatggataaatccaaaaacaggacaaccaaataatccaagacaatttcaaggaagagtaagtttaacaagacaagcaagctgggattttgatacatattcattttatatggatttaaaagcagtaagatcagatgatacagcaatatatttttgtgcaagacaaagaagtgatttttgggattttgatgtatggggaagtggaacacaagtaacagtatcaagtgcgagtacaaaagga

SEQ ID NO: 50183 - RNA, 384 nt, synthetic construct
  misc_feature 1..384: note = derived and/or modified sequence opt6 from anti-HIV_Chain
  source 1..384: mol_type = other RNA
caagtgcaattattacaaagcggagcagcagtaacaaaaccaggagcaagtgtaagagtaagttgtgaagcaagtggatataaaatatcagatcattttatacattggtggagacaagcaccaggacaaggattacaatgggtaggatggataaatccaaaaacaggacaaccaaataatccaagacaatttcaaggaagaataagtttaacaagacaagcaagttgggattttgatacattttcattttatatggatttaaaagcattaagatcagatgatacagcagtatatttttgtgcaagacaaagaagtgattattgggattttgatgtatggggaagcggaacacaagtaacagtatcaagtgcaagcacaaaagga

SEQ ID NO: 50184 - RNA, 384 nt, synthetic construct
  misc_feature 1..384: note = derived and/or modified sequence opt6 from anti-HIV_Chain
  source 1..384: mol_type = other RNA
caagtacaattattacaaagtggagcagcagtaacaaaaccaggagcaagtgtaagagtaagttgtgaagcaagtggatataatataagagattattttatacattggtggagacaagcaccaggacaaggattacaatgggtaggatggataaatccaaaaacaggacaaccaaataatccaagacaatttcaaggaagagtaagtttaacaagacatgcaagctgggattttgatacattttcattttatatggatctaaaaggattaagatcagatgatacagcaatatatttttgtgcaagacaaagaagtgattattgggattttgatgtatggggaagtggaacacaagtaacggtatcaagtgcaagtacaaaagga

SEQ ID NO: 50185 - RNA, 384 nt, synthetic construct
  misc_feature 1..384: note = derived and/or modified sequence opt6 from anti-HIV_Chain
  source 1..384: mol_type = other RNA
caagtacaattattacaaagtggagcagcagtaacaaaaccaggagcaagtgtaagagtaagttgtgaagcaagtggatataatataagagattattttatacattggtggagacaagcaccaggacaaggattacaatgggtaggatggataaatccaaaaacaggacaaccaaataatccaagacaatttcaaggaagagtaagtttaacaagacatgcgagctgggattttgatacatttagtttttatatggatttaaaagcattaagaagtgatgatacagcagtatatttttgtgcaagacaaagaagcgattattgggattttgatgtatggggaagtggaacacaagtaacagtaagtagtgcaagtacaaaagga

SEQ ID NO: 50186 - RNA, 384 nt, synthetic construct
  misc_feature 1..384: note = derived and/or modified sequence opt6 from anti-HIV_Chain
  source 1..384: mol_type = other RNA
catgtacaattattacaaagtggagcagcagtaacaaaaccaggagcaagtgtaagagtaagttgtgaagcaagtggatataatataagagattattttatacattggtggagacaagcaccaggacaaggattacaatgggtaggatggataaatccaaaaacaggacaaccaaataatccaagacaatttcaaggaagagtaagtttaacaagacaagcaagctgggattttgatacgttttcattttatatggatttaaaagcattaagattagatgatacagcaatatatttttgtgcaagacaaagaagcgattattgggattttgatgtatggggaagtggaacacaagtaacagtatcaagtgcaagtacaaaagga

SEQ ID NO: 50187 - RNA, 384 nt, synthetic construct
  misc_feature 1..384: note = derived and/or modified sequence opt6 from anti-HIV_Chain
  source 1..384: mol_type = other RNA
caagtacatctatcacactcaggagcagcagtaacaaaaccaggagcatcagtaagagtaagttgcgaagcatcaggatataaaatatcagatcactttatacattggtggagacaagcaccaggacaaggattacaatgggtaggatggataaacccaaaaacaggacaaccaaataacccaagacaattccaaggaagaatatcattaacaagacaagcatcatgggatttcgatacattttcattttacatggacttaaaagcactaagatcagatgacacagcagtatacttttgcgcaagacaaagatcagactattgggatttcgatgtatggggatcaggaacacaagtaacagtatcatcagcatcaacaaaagga

SEQ ID NO: 50188 - RNA, 384 nt, synthetic construct
  misc_feature 1..384: note = derived and/or modified sequence opt6 from anti-HIV_Chain
  source 1..384: mol_type = other RNA
caagtacatctatcacaatcaggagcagtagtaacaaaaccaggagcatcagtaagagtatcatgcgaagcatcaggatataaaatatcagatcactttatacattggtggagacaagcaccaggacaaggattacaatgggtaggatggataaacccaaaaacaggacaaccaaataacccaagacaattccaaggaagaatatcactaacaagacaagcatcatgggatttcgatacatttagcttttacatggacttaaaagcactaagaagcgatgacacagcagtatacttttgcgcaagacaaagatcagactattgggatttcgatgtatggggatcaggaacacaagtaacagtaagctcagcatcaacaaaagga

SEQ ID NO: 50189 - RNA, 384 nt, synthetic construct
  misc_feature 1..384: note = derived and/or modified sequence opt6 from anti-HIV_Chain
  source 1..384: mol_type = other RNA
caagtacatctatcacaatcaggagcagtagtaacaaaaccaggagcatcagtaagagtaagttgcgaagcatcaggatataaaatatcagatcactttatacattggtggagacaagcaccaggacaaggattacaatgggtaggatggataaacccaaaaacaggacaaccaaataacccaagacaattccaaggaagaatatcactaacaagacaagcatcatgggatatagatacatttagtttttacatggacttaaaagcactaagatcagatgacacagcagtatacttttgcgcaagacatagatcagactattgggatttcgatgtatggggatcaggaacacaagtaacagtatcatcagcatcaacaaaagga

SEQ ID NO: 50190 - RNA, 384 nt, synthetic construct
  misc_feature 1..384: note = derived and/or modified sequence opt6 from anti-HIV_Chain
  source 1..384: mol_type = other RNA
caagtacatttaagtcaaagtggagcagtagtaacaaaaccaggagcaagtgtaagagtaagttgtgaagcaagtggatataaaatatcagatcattttatacattggtggagacaagcaccaggacaaggattacaatgggtaggatggataaatccaaaaacaggacaaccaaatataccaagacaatttcaaggaagaataagtttaacaagacaagcaagtggagatttcgatacattttcattttatatggatttaaaagcattaagatcagatgatacagcagtatatttttgtgcaagacaaagaagtgattattgggattttggagtatggggaagtggaacacaagtaacagtatcaagtgcaagtacaaaagga

SEQ ID NO: 50191 - RNA, 384 nt, synthetic construct
  misc_feature 1..384: note = derived and/or modified sequence opt6 from anti-HIV_Chain
  source 1..384: mol_type = other RNA
caagtacatctatcacaatcaggagcagtagtaacaaaacccggagcatcagtaagagtaagttgcgaagcatcaggatataaaatatcaggacactttatacattggtggagacaagcaccaggacaaggactacaatgggtaggatggataaacccaaaaacaggacaaccaaataacccaagacaattccaaggaagaatatcactaacaagacaagcatcatgggatttcgatacatttagcttttacatggacttaaaagcactaagatcagatgacacagcagtatacttttgcgcaagacatagatcagactattgggatttcgatgtatggggatcaggaacacaagtaacagtaagctcagcatcaacaaaagga

SEQ ID NO: 50192 - RNA, 384 nt, synthetic construct
  misc_feature 1..384: note = derived and/or modified sequence opt6 from anti-HIV_Chain
  source 1..384: mol_type = other RNA
caagtacatttaagtcaaagtggagcagcagtaacaaaaccaggagcaagtgtaagagtaagttgtgaagcaagtggatataaaatatcagatcattttatacattggtggagacaagcaccaggacaaggattacaatgggtaggatggataaatccaaaaacaggacaaccaaataatccaagacaatttcaaggaagaataagtttaacaagacaagcaagttgggattttgatacattttcattttatatggatttaaaagcattaagatcagatgatacagcagtatatttttgtgcaagacatagaagtgattattgggattttgatgtatggggaagtggaacacaagtaacagtaagtagtgcaagtacaaaagga

SEQ ID NO: 50193 - RNA, 384 nt, synthetic construct
  misc_feature 1..384: note = derived and/or modified sequence opt6 from anti-HIV_Chain
  source 1..384: mol_type = other RNA
caagtacatttaagtcaaagtggagcagcagtaacaaaaccaggagcaagtgtaagagtaagttgtgaagcaagtggatataaaatatcagatcattttatacattggtggagacaagcaccaggacaaggattacaatgggtaggatggataaatccaaaaacaggacaaccaaataatccaagacaatttcaaggaagagtaagtttaacaagacaagcaagttgggattttgatacatattcattttatatgggattaaaagcagtaagatcagatgatacagcaatatatttttgtgcaagacaaagaagtgatttttgggattttgatgtatggggaagtggaacacaagtaacagtatcaagtgcaagtacaaaagga

SEQ ID NO: 50194 - RNA, 384 nt, synthetic construct
  misc_feature 1..384: note = derived and/or modified sequence opt6 from anti-HIV_Chain
  source 1..384: mol_type = other RNA
caagtacatttaagtcaaagtggagcagtagtaacaaaaccaggagcaagtgtaagagtaagttgtgaagcaagtggatataaaatatcagatcattttatacattggtggagacaagcaccaggacaaggattacaatgggtaggatggataaatccaaaaacaggacaaccaaataatccaagacaatttcaaggaagaataagtttaacaagacaagcaagttgggattttgatacattttcattttatatggatttaaaagcattaagatcagatgatacagctgtatatttttgtgcaagacatagaagtgattattgggattttgatgtatggggaagtggaacacaagtaacagtatcaagtgcaagtacaaaagga

SEQ ID NO: 50195 - RNA, 384 nt, synthetic construct
  misc_feature 1..384: note = derived and/or modified sequence opt6 from anti-HIV_Chain
  source 1..384: mol_type = other RNA
caagtacatttaagtcaaagtggagcagtagtaacaaaaccaggagcaagtgtaagagtaagttgtgaagcaagcggatataaaatatcagatcattttatacattggtggagacaagcaccaggacaaggattacaatgggtaggatggataaatccaaaaacaggacaaccaaataatccaagacaatttcaaggaagaataagtttaacaagacaagcaagttgggattttgatacattttcattttatatggatttagaagcattaagatcagatgatacagcagtatatttttgtgcaagacaaagaagtgattattgggattttgatgtatggggaagtggaacacaagtaacagtatcaagtgcaagtacaaaagga

SEQ ID NO: 50196 - RNA, 384 nt, synthetic construct
  misc_feature 1..384: note = derived and/or modified sequence opt6 from anti-HIV_Chain
  source 1..384: mol_type = other RNA
caagtacatttaagtcaaagtggagcagcagtaacaaaaccaggagcaagtgtaagagtaagttgtgaagcaagtggatataaaataagagattatagtatacattggtggagacaagcaccaggacaaggattacaatgggtaggatggataaatccacaaacaggacaaccaaatataccaagaccatttcaaggaagaataagtttaacaagacaagcaagttgggattttgatacattttcattttatatggatttagaagcattaagatcagatgatacagcagtatatttttgtgcaagacaaagaagtgattattgggattttgatgtatggggaagtggaacacaagtaacagtatcaagtgcaagtacaaaagga

SEQ ID NO: 50197 - RNA, 384 nt, synthetic construct
  misc_feature 1..384: note = derived and/or modified sequence opt6 from anti-HIV_Chain
  source 1..384: mol_type = other RNA
caagtacatctatcacaatcaggagcagcagtaacaaaaccaggagcatcagtaagagtatcatgcgaagcatcaggatataaaatatcagatcactttatacattggtggagacaagcaccaggacaaggattacaatgggtaggatggataaacccaaaaacaggacaaccaaataacccaagacaattccaaggaagaatatcattaacaagacaagcatcatgggatttcgatacattttcattttacatggacttaaaagctctaagatcagatgacacagcagtatacttttgcgcaagacaaagaagtgactatagagatttcgatgtatggggatcaggaacacaagtaacagtatcatcagcatcaacaaaagga

SEQ ID NO: 50198 - RNA, 384 nt, synthetic construct
  misc_feature 1..384: note = derived and/or modified sequence opt6 from anti-HIV_Chain
  source 1..384: mol_type = other RNA
caagtacatttaagccaaagcggagcagtagtaacaaaaccaggagcaagtgtaagagtaagttgtgaagcaagtggatataaaatatcagatcattttatacattggtggagacaagcaccaggacaaggaccacaatgggtaggatggataaatccaaaaacaggacaaccaaataatccaagacaatttcaaggaagaataagtttaacaagacaagcaagttgggattttgatacattttcattttatatggatttaaaagcattaagaagtgatgatacagcagtatatttttgtgcaagacatagaagtgattattgggattttgatgtatggggaagtggaacacaagtaacagtaagttcagcgagtacaaaagga

SEQ ID NO: 50199 - RNA, 384 nt, synthetic construct
  misc_feature 1..384: note = derived and/or modified sequence opt6 from anti-HIV_Chain
  source 1..384: mol_type = other RNA
caagtaagattattacaaagtggagcagcagtaacaaaaccaggagcaagtgtaagagtaagttgtgaagcaagtggatatgaaataagagattattttatacattggtggagacaagcaccaggacaaggattacaatgggtaggatggataaatccaaaaacaggacaaccaaataatccaagacaatttcaaggaagagtaagtttaacaagacaagcaagttgggattttgatagttatagtttttatatggatttaaaagcattaagatcagatgatacagcagtatatttttgtgcaagacaaagaagtgattattgggattttgatgtatggggaagtggaacacaagtaacagtatcaagtgcaagtacaaaagga

SEQ ID NO: 50200 - RNA, 384 nt, synthetic construct
  misc_feature 1..384: note = derived and/or modified sequence opt6 from anti-HIV_Chain
  source 1..384: mol_type = other RNA
caagtaagattattacaaagtggagcagcagtaacaaaaccaggagcaagtgtaagagtaagttgtgaagcaagtggatatgaaataagagattattttatacattggtggagacaagcaccaggacaaggattacaatgggtaggatggataaatccaaaaacaggacaaccaaataatccaagacaatttcaaggaagagtaagtttaacaagacaagcaagctgggattttgatagttatagtttttatatggatttaaaagcattaagatcagatgatacaggagtatatttttgtgcaagacaaagaagtgattattgggattttgatgtatggggaagtggaacacaagtaacagtaagtagtgcaagtacaaaagga

SEQ ID NO: 50201 - RNA, 384 nt, synthetic construct
  misc_feature 1..384: note = derived and/or modified sequence opt6 from anti-HIV_Chain
  source 1..384: mol_type = other RNA
caagtaagattattacaaagcggagcagcagtaacaaaaccaggagcaagtgtaagagtaagttgtgaagcaagtggatatgaaataagagattattttatacattggtggagacaagcaccaggacaaggattacaatgggtaggatggataaatccaaaaacaggacaaccaaataatccaagacaatttcaaggaagagtaagtttaacaagacaagcaagctgggattttgatagttatagtttttatatggatttaaaagcattaagatcagatgatacagcagtatatttttgtgcaagacaaagaagtgattattgggattttgatgtatggggaagtggaagtcaagtaacagtaagtagtgcaagtacaaaagga

SEQ ID NO: 50202 - RNA, 384 nt, synthetic construct
  misc_feature 1..384: note = derived and/or modified sequence opt6 from anti-HIV_Chain
  source 1..384: mol_type = other RNA
caagtacaattattacaaagcggagcagcagtaacaaaaccaggagcaagtgtaagagtaagttgtgaagcaagtggatataatataagagattattttatacattggtggagacaagcaccaggacaaggattacaatgggtaggatggataaatccaaaaacaggacaaccaaataatccatgtcaatttcaaggaagagtaagtttaacaagacaagcaagttgggattttgatacaataagtttttatatggatttaaaagcattaagattagatgatacagcagtatatttttgtgcaagacaaagaagtgattattgggattttgatgtatggggaagtggaacacaagtaacagtaagtagtgcaagcacaaaagga

SEQ ID NO: 50203 - RNA, 384 nt, synthetic construct
  misc_feature 1..384: note = derived and/or modified sequence opt6 from anti-HIV_Chain
  source 1..384: mol_type = other RNA
caagtacaattattacaaagtggagcagcagtaacaaaaccaggagcaagtgtaagagtaagttgtgaagcaagtggatataatataagagattattttatacattggtggagacaagcaccaggacaaggattacaatgggtaggatggataaatccaaaaacaggacaaccaaataatccaagacaatttcaaggaagagtaagtttaacaagacatgcaagttgggattttgatacattttcattttatatggatttaaaagcattaagatcagatgatacagcagtatatttttgtgcaagacaaagaagtgattattgggattttgatgtatggggaagtggaacacaagtaatagtatcaagtgcaagtacaaaagga

SEQ ID NO: 50204 - RNA, 384 nt, synthetic construct
  misc_feature 1..384: note = derived and/or modified sequence opt6 from anti-HIV_Chain
  source 1..384: mol_type = other RNA
caagtacaattagtacaaagtggagcagatgtaaaaaaaccaggagcaacagtaacagtaagctgtaaaacagatgaagatgaagatgattttagagcacatttaatgcaatggatgagacaagcaccaggacaaagattagaatgggtaggatggataaaaccacaaacaggacaaccaagttatggacaaaaatttcaaggaagagtaacattaacaagagaagtaagtacaagtacagtatttttacaattaagaaatttaagaagtgatgatacagcagtatattactgtgcaagaccaagaggaggaagagataattggagttttcatgtatggggaagaggaacattagtaacagtaagtagtgcaagtacaaaagga

SEQ ID NO: 50205 - RNA, 384 nt, synthetic construct
  misc_feature 1..384: note = derived and/or modified sequence opt6 from anti-HIV_Chain
  source 1..384: mol_type = other RNA
gaagtacaattagtagaaagtggagcagaagtaaaaaaaccaggagcaagtgtaaaagtaagttgtaaagtaagtggaaatagtttaacagaatttagtatacattgggtaagacaagcaccaggaaaaggattagaatggatgggaggatttgatccagaagaaggagaaacagtaccagcacaaaaatttaaaggaagactaacaatgacagaagatacaagtacaaatacagcatatatggaattaagtagtttaagatcagaagatacagcagtatattactgtagtacagaaccaagagaaatgggaacattgacagcaggatttgaatattggggacaaggaacattagtaacagtaagtagtgcaagtacaaaagga

SEQ ID NO: 50206 - RNA, 384 nt, synthetic construct
  misc_feature 1..384: note = derived and/or modified sequence opt6 from anti-HIV_Chain
  source 1..384: mol_type = other RNA
agagtacaattaggacaaagcggagcagaagtaaaaaaaccaggagcaagtgtaaaagtaagttgtaaagtaagtggaaatagtttaacagaatttagtatacactgggtaagacaagcaccaggaaaaggactagaatggatgggaggatttgatccagaagaaggagaaacagtaccagcacaaaaatttaaaggaagagtaacaatgacagaagatacaagtacaaatacagcatatatggaattaagtagtttaagaagtgaagatacagcagtatattactgtagtacagaaccaagagaaatgggaacattaacagcaggatttgaatattggggacaaggaacattagtaatagtaagtagtgcaagtacaaaagga

SEQ ID NO: 50207 - RNA, 384 nt, synthetic construct
  misc_feature 1..384: note = derived and/or modified sequence opt6 from anti-HIV_Chain
  source 1..384: mol_type = other RNA
caagtacaattagtacaaagcggagcagatgtaaaaaaaccaggagcaagtgtaacagtaagctgtaaaacagatgaagacgaagacgatttcagagcacatctagtacaatggatgagacaagcaccaggacaaagactagaatgggtaggatggataaaaccacaaacaggacaaccaagttatgcacaaaaatttcaaggaagagtaacactaacaagagaagtaagtacaagcacagtatttctacaattaagaaatttaagatcagacgatacagcagtatattactgtgcaagaccaagaggaggaagagataactggagttttcatgtatggggaagaggaacattagtaacagtatcaagtgcaagtacaaaagga

SEQ ID NO: 50208 - RNA, 384 nt, synthetic construct
  misc_feature 1..384: note = derived and/or modified sequence opt6 from anti-HIV_Chain
  source 1..384: mol_type = other RNA
caagtacaactacaagaatcaggaccaggactagtaaaaccatcagaaacactatcactaacatgctcagtatcaggagcatcaatatcaaacttctactggacatggataagacaaccagcaggaaaaggactagaatgggtaggaagattatactcatcagacagaacaaactacaacccatcactaaacggaagagtaacaatgtcactagacacatcaaaaaaccaattctcactaagactaacatcaatgacagacgcagacacagcaatatacttctgcgcaagagaaaaaggacaatggctaacagtaccaccatactacttcgactcatggggacaaggaatactagtaacagtatcatcagcatcaacaaaagga

SEQ ID NO: 50209 - RNA, 384 nt, synthetic construct
  misc_feature 1..384: note = derived and/or modified sequence opt6 from anti-HIV_Chain
  source 1..384: mol_type = other RNA
caagtacaactagtacaatcaggagcagaagtaagaaaaccaggagcatcagtaaaagtatcatgcaaaacatcaggatacacattcacaaactcatacatacactgggtaagacaagcaccaggacaaggactagaatggatgggaataataaacccaccaggaggaaacacatactacgcacaaaaattccacggaagagtaacactaacaagagacacatcaacatcaacagtatacatggaactaaactcactacgatcagaagacacagcagtatacttctgcgcaagaccacactcaccaacaaacataccatcaagaccactagactactggggacaaggaacattagtaacagtatcatcagcatcaacaaaagga

SEQ ID NO: 50210 - RNA, 384 nt, synthetic construct
  misc_feature 1..384: note = derived and/or modified sequence opt6 from anti-HIV_Chain
  source 1..384: mol_type = other RNA
caagtacaactacaagaatcaggaccaggactagtaaaaccatcaggaacactatcactaacatgcaatgtatacggaggatcaatgatatcatactactggtcatggataagacaaccaccaggaaaaggattagaatggataggacacgtatacaactcaggaaacacaaaatactcaccatcattaaaaaacagagtaacaatatcaatggacacatcaagaaacttattctcactaaaagtaacatcagtaacaccagccgacacagcagtatattactgcgcaagagcagactacgacaacatatgggactcaagaggaggattcgacttatggggacaaggaacactagtaacagtatcatcagcatcaacaaaagga

SEQ ID NO: 50211 - RNA, 384 nt, synthetic construct
  misc_feature 1..384: note = derived and/or modified sequence opt6 from anti-HIV_Chain
  source 1..384: mol_type = other RNA
caagtacaactagtacaatcaggagcagaagtaaaaaaaccaggatcatcagtaaaagtatcatgcaaagcatcaggaggaacactaagctcatacacaatatcatgggtaagacaagcaccaggacaaggactagaatggatgggaagactaataccactagtagacataacaacatacgcacaaaaattccaaggaagagtaacaataacagcagacacatcaacaaacacagcatacatggaattatcaaacctaagatcagaagacacagcaatataccactgcgcaacaagcacaatgatagcagcagtaataaacgacgcattcgacctatggggacaaggaacaacagtaacagtatcatcagcatcaacaaaagga

SEQ ID NO: 50212 - RNA, 384 nt, synthetic construct
  misc_feature 1..384: note = derived and/or modified sequence opt6 from anti-HIV_Chain
  source 1..384: mol_type = other RNA
caagtacaattagtacaaagtggagcagaagtaaaaaaaccaggagcaagtgtaaaaataagttgtaaagcaagtggatatagttttagaaattatgcagtacattgggtaagacaagcaccaggacaaggattagaatggatgggagaaataaatggaggaaatggaaatacagaatatagtcaaaaaagtcaaggaagactaacaataacaagggatataagtgcaacaacagcatatatggaattaagtagtttaagaagtgatgatacagcagtatattattgtgcaagagtagcatatgtacatgtagtaacaacaagaagcttagataattggggacaaggaacattagtaacagtaagtagtgcaagtacaaaagga

SEQ ID NO: 50213 - RNA, 384 nt, synthetic construct
  misc_feature 1..384: note = derived and/or modified sequence opt6 from anti-HIV_Chain
  source 1..384: mol_type = other RNA
caagtaagattaagtcaaagtggagcagcagtaatgaaaacaggagcaagtgtaacaataagttgtgaaacagaaggatttaattttgtaaattatataatacattgggtaagaagaccaccaggaagaggatttgaatggttaggaatgatagatccaagaaatggacatccatggtttgcacaaacagtaagaggaagattaagtctaagaagagatacatttaatgaaatagtatatatgacattaagtggattaacaacagatgatacaggattatatttttgtgcaagaaatgaaccacaatatcatagtctaccaggaatgtttgattattggggacaaggaacaccagtaacagtaagtagcgcaagcacaaaagga

SEQ ID NO: 50214 - RNA, 384 nt, synthetic construct
  misc_feature 1..384: note = derived and/or modified sequence opt6 from anti-HIV_Chain
  source 1..384: mol_type = other RNA
caagtaagattatcacaatcaggagcagcagtagtaaaaacaggagcatcagtaacaatatcatgcgaaacagaaggatataactttgtaaattacataatacattgggtaagaagaccaccaggaagaggatttgaatggttaggaatgatagacccaagaaatggacatccatggttcgcacaaacagtaagaggaagactatcactaagaagagatacatttaaagaaacagtatacatgacattaagcggactaacaagcgatgacacaggagtgtacttttgcgcaagaaatgaaccacaatatcactcactaccaggaatgttcgattactggggacatggaacaccagtaacagtaagttcagcatcaacaaaagga

SEQ ID NO: 50215 - RNA, 384 nt, synthetic construct
  misc_feature 1..384: note = derived and/or modified sequence opt6 from anti-HIV_Chain
  source 1..384: mol_type = other RNA
caaggacaattagtacaaagtggaggaggagtaaaaaaactaggaacaagtgtaacaataagctgtctagcaagtgaatatacatttaatgaatttgtaatacactggataagacaagcaccaggacaaggaccattatggttaggattaataaaaagatcaggaagactaatgacatcataccaattccaagacagactaagcctaagaagagatagatcaacaggaacagtattcatggaattaagaggattaagagtagatgacacagcagtatattattgcgcaagagatggattaggagaagtagcaccagcatacctatacggaatagatgcatggggacaaggaacaacagtaatagtaacatcagcaagtacatca

SEQ ID NO: 50216 - RNA, 384 nt, synthetic construct
  misc_feature 1..384: note = derived and/or modified sequence opt6 from anti-HIV_Chain
  source 1..384: mol_type = other RNA
caagtacaattagtacaaagcggagcagaagtaaaaaaaccaggagcaagcgtaaaagtaagttgtaaagcaagtggatatacatttacaagttatgatataaattgggtaagacaagcaacaggacaaggattagaatggatgggatggatgaatccaaatagtggaaatacaggatatgcacaaacatttcaaggaagagtaacaatgacaagaaatacaagtataagcacagcatatatggaattatcaagtttaagatcagaagatacagcagtatattactgtgcaagagacagatggttaccacaatattattattatggaatggatgtatggggacaaggaacaacagtaacagtatcaagtgcaagcacaaaagga

SEQ ID NO: 50217 - RNA, 384 nt, synthetic construct
  misc_feature 1..384: note = derived and/or modified sequence opt6 from anti-HIV_Chain
  source 1..384: mol_type = other RNA
caagtacaattagtacaatcaggagcagaagtaaaaaaaccaggaagctcaatgaaagtatcatgcaaaagctcaggaggaacatttagcaatcacgcaatatcatgggtaagacaagcaccaggaaaaggattagaatggatgggaggaataataccaatgtcaggaacaacaaattacttacaaaaattccaaggaagagtaacaataacagcagatgaatttgcaacaacagcatacatggaattaagctcactaacaagcgaagacacagcagtatactattgcgcaagagcaagagcagactcacacacaccaatagacgcattcgatatatggggaccaggaacaagagtaatagtaagctcagcatcaacaaaagga

SEQ ID NO: 50218 - RNA, 384 nt, synthetic construct
  misc_feature 1..384: note = derived and/or modified sequence opt6 from anti-HIV_Chain
  source 1..384: mol_type = other RNA
caagtacaactagtacaaagtggagcagaagtaaaaaaaccaggagcaagtgtaaaagtaagttgtaaagtaagtggatatacattaacagaattaagtatacattgggtaagacaagcaccaggaaaaagattagaatggatgggaggatttgatccagaagacggagaaagaatatatgcacaaaaatttcaaggaagagtaacaatgacagaagatacaagtacagatacagcatatatggaattaaatagcttaagatcagatgatacagcagtatattactgtgcaacaggaggattatattgttcaagtataagttgtataatggatgtatggggacaaggaacaacagtaacagtatcaagtgcaagtacaaaagga

SEQ ID NO: 50219 - RNA, 384 nt, synthetic construct
  misc_feature 1..384: note = derived and/or modified sequence opt6 from anti-HIV_Chain
  source 1..384: mol_type = other RNA
caagtacaattagtacaaagcggagcagaagtaaaaatgccaggagcaagtgtaaaagtaagctgtaaagtaagcggatactcactaacagaattaagcatacactgggtaagacaagcaccaggaaaaagactagaatggatgggaggattcgatccagaagacgatgaaagaatatatgcacaaaaatttcaagatagagtaacaatgacagaagacacaagcacagacacagcatatatggatctaaatagcttaagatcagaagatacagcagtatattactgtacaacaggaggactatattgctcaagtataagctgtataatggacgtatggggacaaggaacaacagtaatagtatcaagcgcaagtacaaaagga

SEQ ID NO: 50220 - RNA, 387 nt, synthetic construct
  misc_feature 1..387: note = derived and/or modified sequence opt6 from anti-HIV_Chain
  source 1..387: mol_type = other RNA
gaagtacaattaagtgaaagtggaggaggatttgtaaaaccaggaggaagtttaagattaagttgtgaagcaagtggatttacatttaataattatgcaatgagttgggtaagacaagcaccaggaaaaggattagaatgggtaagtgtaacaagtgcacatggaggaagtgcatattatggagaatttgtaaaaggaagatttacaatgagtagagatcattttatagatacagtatatttagaaatgaatggattaacagtagaagatacagcagtatattattgtgtaagagtaacattttatcatgaaggaagtggatattattatagagcaggaaattactttgatagttggggaaaaggaacaagagtagtagtaagtgca

SEQ ID NO: 50221 - RNA, 387 nt, synthetic construct
  misc_feature 1..387: note = derived and/or modified sequence opt6 from anti-HIV_Chain
  source 1..387: mol_type = other RNA
gaagtacaattaagtgagagtggaggaggatttgtaaaaccagggggaagtttaagattaagttgtgaagcaagtggatttacatttaataattatgcaatgagttgggtaagacaagcaccaggaaaaggattagaatgggtaagtgtaacaagtgcacatggaggaagtgcatattatggagaatttgtaaaaggaagatttacaatgagtagggatcattttatagatacagtatatttagaaatgaatagattaacagtagaagatacagcagtatattattgtgtaagagtaacattttatcatgaaggaagtggatattattatagagcaggaaattattttgatagttggggaaaaggaacaagagtagtagtaagtgca

SEQ ID NO: 50222 - RNA, 387 nt, synthetic construct
  misc_feature 1..387: note = derived and/or modified sequence opt6 from anti-HIV_Chain
  source 1..387: mol_type = other RNA
gaagtacaattaagtgaaagtgggggaggagtagtaaaaccaggaggaagtttaagattaagctgtgaagcaagcggatttacatttagtaattatgcaatgagttgggtaagacaagcaccaggaaaaggattagaatgggtaagtgtaacaggaggacatggaacatatggatattatggagaatttgtaaaaggaagatttacaataagtagagatcatagcatggatacagtatatttacaaatgaatagattaagagtagaagatacagcagtatattattgtgtaagaacaccatattatcatgaaagtagtggatattattatagagcaggaaattattttgatttttggggaaaaggaacattagtaatagtaagtgca

SEQ ID NO: 50223 - RNA, 387 nt, synthetic construct
  misc_feature 1..387: note = derived and/or modified sequence opt6 from anti-HIV_Chain
  source 1..387: mol_type = other RNA
gaagtacaattaagtgaaagtggaggaggatttgtaaaaccaggaggaagtttaagattaagttgtgaagcaagtggatttacatttaataattatgcaatgggatgggtaagacaagcaccaggaaaaggattagaatgggtaagtgtaacaagtgcacatggaggaagcgcatattttggagaatttgtaaaaggaagatttacaatgagtagagatcattttatagatacagtatatttagaaatgaatagattaacagtagaagatacagcagtatattattgtgtaagagtaacattttatcatgaaggaagtggatattattatagagcaggaaattattttgatagttggggacaaggaacattagtaatagtaagtgca

SEQ ID NO: 50224 - RNA, 387 nt, synthetic construct
  misc_feature 1..387: note = derived and/or modified sequence opt6 from anti-HIV_Chain
  source 1..387: mol_type = other RNA
caagtacaattagtagaaagtggaggaggattagtacaaccaggaggaagtttaagattaagttgtgcagcaagtggatttacatttagtacacattggatgcattgggtaagacaagcaccaggaaaaggattagtatgggtaagcagaatacatagtgatggaagaagtacaagttatgcagatagtgtaaaaggaagatttacaataagtagagataatgcaaaaaatacattatatttacaaatgaatagcttaagagcagaagatacagcagtatattattgtgcaagaggagcagcagtatttggagtagtaataataggaggaatggatttatggggacaaggaacaacagtaacagtaagcagtgcaagtacaaaagga

SEQ ID NO: 50225 - RNA, 387 nt, synthetic construct
  misc_feature 1..387: note = derived and/or modified sequence opt6 from anti-HIV_Chain
  source 1..387: mol_type = other RNA
caagtacaattagtagaaagcggaggagcattggtacaaccaggaggaagcctaagattaagttgtgcagcaagcggattctcattctcaagctatgcaatgagctgggtaagacaagcaccaggaaaaggactagaatgggtaagcgcaatatcaagatcaggaggaagcacatactatgcagatagtgtaaaaggaagatttacaataagcatagacaatagtaataacacactatatctacaaatgaatagcttaagagtagaagatacagcagtatattactgtgcaaaaagagaagcattttattatggagcaggaggatacggaatggatgtctggggacaaggaacaacagtaacagtaagctcagcatcaacaaaagga

SEQ ID NO: 50226 - RNA, 387 nt, synthetic construct
  misc_feature 1..387: note = derived and/or modified sequence opt6 from anti-HIV_Chain
  source 1..387: mol_type = other RNA
tttcaaggacacttagtacaaagcggaggcggagtaaaaaaaccaggaacaagtgtaacattaagttgtctagcaagcgaatacacattcacagaatttacaatacactggataagacaagcaccaggacaaggaccattatggttaggattaataaaaagatcaggaagactaatgacatcatacagattccaagacagactatcattaagaagagatagatcgacaggaacagtattcatggaattaagatcactaagaacagatgacacagcagtatactattgcgcaagagatggattaggagaactagcaccagcataccattacggaatagatgcatggggacaaggaacaacagtaatagtaacatcagcatcaacatca

SEQ ID NO: 50227 - RNA, 387 nt, synthetic construct
  misc_feature 1..387: note = derived and/or modified sequence opt6 from anti-HIV_Chain
  source 1..387: mol_type = other RNA
caaggactattagtacaaagcggaggaggagtaaaaaaattaggaacaagcgtaacaataagctgtctagcaagtgaatacacattcaatgaatttgtaatacactggataaggcaagcaccaggacaaggaccattatggttaggattaataaaaagatcaggaagactaatgacatcataccaattccaagacagattatcactaagaagagatagatcaacaggaacagtattcatggaattaagaggactaagagtcgatgacacagcagtatactattgcgcaagagatggattaggagaagtagcaccagcatacttatacggaatagatgcatggggacaaggaacaacagtaatagtaacatcagcatcaacaaaagga

SEQ ID NO: 50228 - RNA, 387 nt, synthetic construct
  misc_feature 1..387: note = derived and/or modified sequence opt6 from anti-HIV_Chain
  source 1..387: mol_type = other RNA
aacttcatgctaacacaaccagcatcagtatcaggatcacccggacaatcaataacaatctcatgctcaggaacaggatcagacataggagtatacaactacgtatcatggtaccaacaacacccaggaaaagcaccaagactaatgatatacgacgtaacaaacagaccatccggagtatcaaacagattctcaggatcaaaatcaggattcacagcatcactaacaatatcaggactacaaggagacgacgaagcagactactactgctcatcatactcatcaacaaacacatacgtattcggaacaggaacacacgtcacagtactaggacaaccaaaagcaaacccaacagtaacactattcccaccatcatcagaagaacta

SEQ ID NO: 50229 - RNA, 387 nt, synthetic construct
  misc_feature 1..387: note = derived and/or modified sequence opt6 from anti-HIV_Chain
  source 1..387: mol_type = other RNA
caatcagcactaacacaaccaagatcagtatcaggatcaccaggacaatcagtaacaatatcatgcacaggaacatcatcagacgtaggagcatacaactacgtaagctggtacagacaacacccaggaaaagcaccaaaactaatgataaacgacgtatcaaaaagaccatcaggagtaccagacagattctcaggatcaaaatcaggaaacacagcatcactaacaataagcggactacaagcagaagacgaagcagactactactgctgctcatacgcaggaacatactcatacgtattcggaacaggaacaaaagtaacagtattaggacaaccaaaagcaaacccaacagtaacactattcccaccatcatcagaagaacta

SEQ ID NO: 50230 - RNA, 387 nt, synthetic construct
  misc_feature 1..387: note = derived and/or modified sequence opt6 from anti-HIV_Chain
  source 1..387: mol_type = other RNA
caaggacaattagtacaaagcggaggaggactaaaaaaaccaggaacaagcgtaacaataagctgtctagcaagtgaatacacattcaatgaatttgtaatacactggataagacaagcaccaggacaaggaccattatggttaggattaataaaaagatcaggaagattaatgacagcatacaatttccaagacagattatcactaagaagagatagatcaacaggaacagtattcatggaattaagaggattaagaccagatgacacagcagtatactattgcgcaagagatggattaggagaagtagcaccagattacagatacggaatagatgtatggggacaaggaagtacagtaatagtaacagcagcatcaacaaaagga

SEQ ID NO: 50231 - RNA, 387 nt, synthetic construct
  misc_feature 1..387: note = derived and/or modified sequence opt6 from anti-HIV_Chain
  source 1..387: mol_type = other RNA
aacttcatgttaacacaaccaccatcagcatcaggagcaccaggacaaagagtaacaatatcatgctcaggaggaccatcaaacgtaggaggaaactacgtatactggtacagacaattcccaggcacagcaccaaacttactaatactaagagacgaccaaagaccatcaggagtaccagacagattttcagcatcaaaatcaggaaattcagcatcactagcaatatcaggactaagaccagacgacgaagcattctacttctgcgcaacatacgactcagacggatcaataagactattcggaggaggaacaacattaacagtactatcacaaccaaaagcagcaccatcagtaacactattcccaccatcatcagaagaacta

SEQ ID NO: 50232 - RNA, 387 nt, synthetic construct
  misc_feature 1..387: note = derived and/or modified sequence opt6 from anti-HIV_Chain
  source 1..387: mol_type = other RNA
caattagtactaacacaaccaccatcagtatcaggagcaccaggacaaagagtaacaatatcatgctcaggaggaccatcaaacgtaggaggaaacctagtatactggtacaaacaattcccaggaacagcaccaaaactactaataagaagagacgaccaaagaccatccggagtaccagacagattctcaggatcaaaatcaggaaactcagcatcactaacaatatcaggactaagaccagacgacgaagcattctacttctgcgcaacatacgacagccaaggatcaacaagactattcggaggaggaacagtactaacagtactatcacaaccaaaagcagcaccatcagtaacattattcccaccatcatcagaagaacta

SEQ ID NO: 50233 - RNA, 387 nt, synthetic construct
  misc_feature 1..387: note = derived and/or modified sequence opt6 from anti-HIV_Chain
  source 1..387: mol_type = other RNA
aacttcatgctaacacaaccaccatcagtatcaggagcaccaggacaaagagtaacaatatcatgctcaggaggaccatcaaacgtaggaggaaacctagtatactggtacaaacaattcccaggaacagcaccaaaactactaataagaagagacgaccaaagaccatcaggagtaccagacagattctcaggatcaaaatcaggaaactcagcatcattagcaatatcaggactaagaccagacgacgaagcattctacttctgcgcaacatacgactcacacggatcaataagactattcggaggaggaacactactaacagtactatcacaaccaaaagcagcaccatcagtaacactattcccaccatcttcagaagaatta

SEQ ID NO: 50234 - RNA, 387 nt, synthetic construct
  misc_feature 1..387: note = derived and/or modified sequence opt6 from anti-HIV_Chain
  source 1..387: mol_type = other RNA
caaagcgcactaacaagaacaccatcagtatcaggagcaccaggacaaagagtaacaatatcatgctcgggaggaccatcaaacgtaggaggaaactatgtatattggtatcaacaattcccaggagcagcaccaaaattattaataagaagagacgatcaaagaccatcaggagtaccagatagatttagtggaagcaaaagcggaaactcagcatcactagcaatatcaggattaagattagacgatgaagcatactatttctgtgcaacatacgatagcggatggtcaataagactatttggaggaggaacaagattaacagtactatcacaaccaaaagcagcaccaagcgtgacattattcccaccatcaagtgaagaatta

SEQ ID NO: 50235 - RNA, 387 nt, synthetic construct
  misc_feature 1..387: note = derived and/or modified sequence opt6 from anti-HIV_Chain
  source 1..387: mol_type = other RNA
caatcagcactaacacaacccccatcagtatcagcaacaccaggacaaacagtaacaatatcttgctcaggatcaggatcaaacgtaggaggaaaccacgtatactggtacagacaactaccaggagcagcaccaacactactaatatcaaaaacagaccacagaccatcaagagtaccagacagattctcagcatcaaaatcaggaaactcagcatcactagcaatatcaggattaagaccagacgacgaagcaatatacttctgcgcaacatacgacacaggactatccttaagactattcggaggaggaacaagattaacagtactatcacaaccaaaagcagcaccaagcgtaacactattcccaccatcatcagaagaacta

SEQ ID NO: 50236 - RNA, 387 nt, synthetic construct
  misc_feature 1..387: note = derived and/or modified sequence opt6 from anti-HIV_Chain
  source 1..387: mol_type = other RNA
caagtacaattactagaatcaggaccaggattagtaacaccatcaggaacattatcattagcatgcgcagtatcaggagcaagtataagttcaagtcattggtggacatgggtaagacaatcaccaggaaaaggattagaatggataggagaaatagacagaagaggaacaacaaattataatccatcattaagaagcagagtaacaatattattagataatagtaaaaatcaattttcattaagtttaagatcagtaacagcagcagacacagcagtatattattgtacaaaagtatacgcaggattatttaatgaaagaacatatggaatggacgtatggggacacggaacaacagtattagtatcaagtgcaagtacaaaagga

SEQ ID NO: 50237 - RNA, 387 nt, synthetic construct
  misc_feature 1..387: note = derived and/or modified sequence opt6 from anti-HIV_Chain
  source 1..387: mol_type = other RNA
caagcagtagtaacacaaccaccatcagtatcagcaacaccaggacaaacagtaacaatatcatgctcaggatcaggatcaaacgtaggaggaaaccacgtatactggtacagacaactaccaggagcagcaccaacactattaatatcaaaaacaaaccgaagaccatcacaagtaccagacagattctcaggatcaaaatcaggaaactcagcatcactagccatatcaggactaagaccagacgacgaagcagactacttctgcgcaacatacgacacagacctatcactaagactattcggaggaggaacaagactaacagtactatcacaaccaaaagcagcaccatcagtaacactattcccaccatcatcagaagaatta

SEQ ID NO: 50238 - RNA, 387 nt, synthetic construct
  misc_feature 1..387: note = derived and/or modified sequence opt6 from anti-HIV_Chain
  source 1..387: mol_type = other RNA
caatcagcactaacacaaccaccatcagtatcaggaacaccaggacaaaacgtaacaatatcatgctcaggaggaggatcagacgtaggaggaaacctagtatcatggtaccaacacttcccaggagcagcaccaaaactactaatacacagagacaaccaaagaccatcaggagtaccagacagattctcagcactaaaatcaggaaactcagcatcactagcaatatcaggcttaagatcagacgacgaagcattctacttctgcgcagtatacgactcatcattatcattaggactattcggaggaggaacaaaactaacagtattatcacaaccaaaagcagcaccatcagtaacattattcccaccatcatcagaagaacta

SEQ ID NO: 50239 - RNA, 387 nt, synthetic construct
  misc_feature 1..387: note = derived and/or modified sequence opt6 from anti-HIV_Chain
  source 1..387: mol_type = other RNA
caatcagcactaacacaaccaccatcagcatcaggaacaccaggacaaagagtaacaatatcatgctcaggaggaggatcaaacataggaggaaacctagtatcatggtaccaacacttcccaggaacagcaccaaaactactaatatacagaaacgaccaaagaccatctggagtaccagacagattctcaggatcaaaatcaggaacatcagcatcactaacaatatcaggactcagatcagacgacgaagcaacatacttctgcgcagcatacgactcatcactatcattaagattattcggaggaggaacaacactaaacgtactatcacaaccaaaagcagcaccatcagtaacactattcccaccatcatcagaagaacta

SEQ ID NO: 50240 - RNA, 387 nt, synthetic construct
  misc_feature 1..387: note = derived and/or modified sequence opt6 from anti-HIV_Chain
  source 1..387: mol_type = other RNA
caatcagcattaacacaaccaccatcagtatcagcaacaccaggacaaacagtaacaatatcatgctcaggatcaggatcaaacgtaggaggaaaccacgtatactggtacagacaactaccaggagcagcaccaacactattaatatcaaaaacaaaccacagaccatcccaagtaccagacagattctcagcatcaaaatcaggaaactcagcatcactagcaatatcaggactaagaccagacgacgaagcagactacttctgcggaacatacgacacatcactatcactaagactattcggaggaggaacaagactaacagtactatcacaaccaaaagcagcaccatcagtaacattattcccaccatcatcagaagaacta

SEQ ID NO: 50241 - RNA, 387 nt, synthetic construct
  misc_feature 1..387: note = derived and/or modified sequence opt6 from anti-HIV_Chain
  source 1..387: mol_type = other RNA
caatcagtactaacacaagtactttcagtatcaggaacaccaggacaaagagtaataatctcatgctcaggaacatcatcaaacgtaggaggaaacctagtatcatggtatcaacacctaccaggagcagcaccaagactactaatacacagagacgaccaacgaccatcaggagtaccagacagattctcaggatcaaaatcaggaaactcagcaagtctagtaatatcaggactaagatcagacgacgaagcagactacttctgcggagcatacgactcaacattctcactaccagtattcggaggaggaacaagactaacagtactatcacaaccaaaagcagcaccatcagtaacattattcccaccatcatcagaagaatta

SEQ ID NO: 50242 - RNA, 387 nt, synthetic construct
  misc_feature 1..387: note = derived and/or modified sequence opt6 from anti-HIV_Chain
  source 1..387: mol_type = other RNA
caatcagcactaacacaaccacccgcaacatcaggaacaccaggacaaagagtaacaatatcatgctcaggaggaggatcaaacgtaggaggcaacttagtatcatggtaccaacaattcccaggagcagcaccaaaactaatactacacagagacggacaaagaccatctggagtaccagacagattctcagcatcaaaatcaggaacatcagcatcactaacaatatcaggactaagatcagacgacgaagcaacatacttttgcgcagcattcgactcagcactatcactaccattattcggaggaggaacaaaattaacagtactatcacaaccaaaagcagcaccatcagtaacactattcccaccatcatcagaagaacta

SEQ ID NO: 50243 - RNA, 387 nt, synthetic construct
  misc_feature 1..387: note = derived and/or modified sequence opt6 from anti-HIV_Chain
  source 1..387: mol_type = other RNA
caattagtactaacacaaccaccatcagtatcagcaacaccaggacaaacagtaacaatatcatgctcaggatcaggatcaaacgtaggaggaaaccatgtatactggtatagacaactaccaggagcagcaccaacattagtaatatcaaaaacagaccacagaccatcaagagtaccagacagattctcaggaagtaaatcaggtaactcagcatcactagcaatatcaggactaagaccagacgacgaagcagcatatttctgcgcaacatacgacacaggactatcactaagactatttggaggcggaacaagactagcagtattatcacaaccaaaagcagcaccatcagtaacactattcccaccatcatcagaagaatta

SEQ ID NO: 50244 - RNA, 387 nt, synthetic construct
  misc_feature 1..387: note = derived and/or modified sequence opt6 from anti-HIV_Chain
  source 1..387: mol_type = other RNA
caatcagcattaacacaaccaccatcagtatccggaacaccaggacaaaacgtaacaatatcatgctcaggaggaggatcaaacgtaggaggaaacctagtatcatggtatcaacatttcccaggagcagcaccaaaattactaatacacagagacaaccaaagaccatctggagtaccagacagattctcagtactaaaatcaggaaactcagcatcactagcaatatcaggaccaagatcagacgacgaagcattctatttctgcgcagtatacgacagctcactatcattaggactattcggaggaggaacaaaactaacagtactatcacaaccaaaagcagcaccatcagtaacactattcccaccatcatcagaagaacta

SEQ ID NO: 50245 - RNA, 387 nt, synthetic construct
  misc_feature 1..387: note = derived and/or modified sequence opt6 from anti-HIV_Chain
  source 1..387: mol_type = other RNA
caaacagtagtaacacaaccaccatcagcatcaggaacaccaggacaaagagtaacaatatcatgctccggaggaggatcaaacataggaggaaacctagtctcatggtaccaacacttcccaggagcagcaccaaaactactaatatacagaaacgaccaaagaccatcaggagtaccagacagattctcaggatcaaaatcaggaacatcagcatcactaacaatatcaggactaagatcagacgacgaagcaacatacttctgcgcagcatacgactgcacattatcactaagactattcggaggaggaacaacattaaacgtactatcacaaccaaaagcagcaccatcagtaacactattcccaccatcatcagaagaatta

SEQ ID NO: 50246 - RNA, 387 nt, synthetic construct
  misc_feature 1..387: note = derived and/or modified sequence opt6 from anti-HIV_Chain
  source 1..387: mol_type = other RNA
caaagcgcattaacacaaacaccatcagtatcaggagcaccaggacaaagagtaacaatatcatgctcaggaggaccatcaaacgtaggaggaaactatgtatattggtatcaacaattcccgggagcagcaccaaaattactaataagaagagacgatcaaagaccatcaggagtaccagatagatttagcggaagcaaaagcggaaactcagcatcactagcaatatcaggattaagattagacgatgaagcatactatttctgtgcaacatacgatagcggatggtcaataagactatttggaggaggaacaagattaacagtactatcacaaccaaaagcagcaccaagcgtaacattattcccaccatcaagcgaagaatta

SEQ ID NO: 50247 - RNA, 387 nt, synthetic construct
  misc_feature 1..387: note = derived and/or modified sequence opt6 from anti-HIV_Chain
  source 1..387: mol_type = other RNA
caatcagtactaacacaaccaccatcagcatcaggagcaccaggacaacgagtaacaatatcatgctcaggaggaccatcaaacgtaggaggaaactacgtatactggtacagacaattcccaggaacagcaccaaatttattaatactaagagacgaccaaagaccatcaggagtaccagacagattttcagcatcaaaatcaggaaactcagcatcactagcaatatcaggattaagaccagacgacgaagcattctacttctgcgcaacatacgactcagacggatcagtaagactattcggaggaggaacaacattaacagtactatcacaaccaaaagcagcaccatcagtaacattattcccaccatcaaacggaggaaga

SEQ ID NO: 50248 - RNA, 387 nt, synthetic construct
  misc_feature 1..387: note = derived and/or modified sequence opt6 from anti-HIV_Chain
  source 1..387: mol_type = other RNA
caaggacaattagtacaaagcggaggaggagtaaaaaaaccaggaacaagtgtaacaataagctgtctagcaagcgaatacacattcaatgaatttgtaatacactggataagacaagcaccaggacaaggaccattatggttaggattaataaaaagatcaggaagattaatgacatcatacaaattccaagacagactaaatctaagaagagatagatcaacaggaacagtattcatggaattaagaggattaaggccagatgacacagcagtatactattgcgcaagagatggattaggagaagtagcaccagattacagatacggaatagatgtatggggacaaggatcaacagtaatagtaacagcagcatcaacaaaagga

SEQ ID NO: 50249 - RNA, 387 nt, synthetic construct
  misc_feature 1..387: note = derived and/or modified sequence opt6 from anti-HIV_Chain
  source 1..387: mol_type = other RNA
gaagtacaattagtagaaagtggagcagaagtaaaaaaaccaggagcaagtgtaaaagtagcatgtaaagtaagtggaaaaaaattaagtgatttaagtatacattgggtaagacaagcaccaggaaaaggactagaatggatgggaggatttgatgaagaagatggaaaaataagttatgaaagaaaatttcaaggaagagtaacaatgacagaagatacagcaagagatacagcatttatggaaatgagtagtctaagaagtgatgatacagcagtatatttttgtgcagcagcaccaagactagatttaggagaattaagcagtggatttcatttttggggattaggaacattagtaagtgtaagtagtgcaagtacaaaagga

SEQ ID NO: 50250 - RNA, 387 nt, synthetic construct
  misc_feature 1..387: note = derived and/or modified sequence opt6 from anti-HIV_Chain
  source 1..387: mol_type = other RNA
caaggacaactagtacaaagtggaggaggaggaaaaaaactaggaacaagtgtaacaataagttgtttagcaagtgaatatacatttaatgaatttgtaatacattggataagacaagcaccaggacaaggaccattatggttaggattaataaaaagaagtggaagattaatgacaagctatcaatttcaagatagattaagtttaagaagagatagaagtacaggaacagtatttatggaattaagaggattaagagtagatgatacagcagtatattattgtgcaagagatggattaggagaagtagcaccagcatatttatatggaatagatgcatggggacaaggaacaacagtaatagtaagtagtgcaagtacaaaagga

SEQ ID NO: 50251 - RNA, 387 nt, synthetic construct
  misc_feature 1..387: note = derived and/or modified sequence opt6 from anti-HIV_Chain
  source 1..387: mol_type = other RNA
gaagtacaattagtagaaagtggagcagaagtaaaaaaaccaggagcaagtgtaaaagtaagttgtaaagtaagtggatatacattaagcgatttaagtatgcattgggtaagacaagcaccaggaaaaggactagaatggatgggaggatttgatgaagaagatggagaaataacatatgcacaaaaatttcaaggaagagtaagtatgacagaagatacaagtagagatacagcatatatggaattaagtagtttaagaagtgaagatacagcagtatattattgtgcaacagcaccaagattagaattaggagaattaagtagtggatttcattattggggattaggaacattagtaacagtaagtagtgcaagtacaaaagga

SEQ ID NO: 50252 - RNA, 387 nt, synthetic construct
  misc_feature 1..387: note = derived and/or modified sequence opt6 from anti-HIV_Chain
  source 1..387: mol_type = other RNA
caaggacaattagtacaaagcggaggaggagtaaaaaaaacaggaacaagcgtaacaataagctgtctagcaagcgaatacacattcacagaatttacaatacactggataagacaagcaccaggacaaggaccattatggttaggattaataaaaagatcaggaagactaatgacagcgaacagattccaagacagactaagtctaagaagagatagatcaacaggaacagtattcatggaattaagatcactaaggatagatgacacagcagtatactattgcgcaagagatggattaggagaactagcaccagcataccattacggaatagatgtatggggacaaggaacaacaataatagtaacatcagcatcaacaaaagga

SEQ ID NO: 50253 - RNA, 387 nt, synthetic construct
  misc_feature 1..387: note = derived and/or modified sequence opt6 from anti-HIV_Chain
  source 1..387: mol_type = other RNA
caaggacaattagtacaaagtggaggaggagtaaaaaaattaggaacaagtgtaacaataagttgtttagcaagtgaatatacatttaatgaatttgtaatacattggataagacaagcaccaggacaaggaccattatggttaggattaataaaaagaagcggaagattaatgacaagttatcaatttcaagatagattaagtttaagaagagatagaagtacaggaacagtatttatggaattaagaggattaagagtagatgatacagcagtatattattgtgcaagagatggattaggagaagtagcaccagcatatttatatggaatagatgcatggggacaaggaacaacagtgatagtaacaagtgcaagtacaaaagga

SEQ ID NO: 50254 - RNA, 387 nt, synthetic construct
  misc_feature 1..387: note = derived and/or modified sequence opt6 from anti-HIV_Chain
  source 1..387: mol_type = other RNA
caaggacaattagtacaaagcggaggaggagtaaaaaaattaggaacaagtgtaacaataccatgtttagcaagtgaatatacatttaatgaatttgtaatacattggataagacaagcaccaggacaaggaccattatggttaggattaataaaaagaagtggaagattaatgacaagctatcaatttcaagatagattaagtttaagaagagatagaagtacaggaacagtatttatggaattaagaggattaagagtagatgatacagcagtatattattgtgcgagagatggattaggagaagtagcaccagcatatctatatggaatagatgcatggggacaaggaacaacagtaatagtaacaagtgcaagtacaaaagga

SEQ ID NO: 50255 - RNA, 387 nt, synthetic construct
  misc_feature 1..387: note = derived and/or modified sequence opt6 from anti-HIV_Chain
  source 1..387: mol_type = other RNA
caaggacaattagtacaaagcggaggaggagtaaaaaaaccaggaacaagcgtaacaataagctgtctagcaagcgaatacacattcaatgaatttgtaatacactggataagacaagcaccaggacaaggaccagtatggttaggattaataaaaagatcaggaagattaatgacatcatacaaattccaagacagactatcactaagaagagatagatcaacaggaacagtattcatggaattaagaggactaagactagatgacacagcagtatactattgcgcaagagatggattaggagaagtagcaccagcatacttatacggaatagatgcatggggacaaggatcaaaagtaatagtaacaccagcatcaacaaaagga

SEQ ID NO: 50256 - RNA, 387 nt, synthetic construct
  misc_feature 1..387: note = derived and/or modified sequence opt6 from anti-HIV_Chain
  source 1..387: mol_type = other RNA
caagcaagactagatcaatggggaacaggattattaaaaccatcagaaacactatcattaaaatgcgcagtatttggagtactatttacagattataattggacatgggtaagacaaagcccaggaaaagaattagaatggataggacacttagaccatagaggaggaggaaattataacccatcattagaaagcagagtaacaataagtttagactatagcaaagcacaattttcattacatttaaaaagtgtaacagtagcagatacagcaagatattactgtgcaggagcagtaaaaggattctggtttgatgacccatacacatggtttggaccatggtcacaaggaacattagtaacagtagcaagtgcaagtacaaaagga

SEQ ID NO: 50257 - RNA, 387 nt, synthetic construct
  misc_feature 1..387: note = derived and/or modified sequence opt6 from anti-HIV_Chain
  source 1..387: mol_type = other RNA
caagcaagactagatcaatggggaacaggattattaaaaccatcagaaacattatcattaaaatgcgcagtatttggagtattatttacagattataattggacatgggtaagacaaagcccaggaaaaggattagaatggataggacacttagaccatagaggaggaggaagttataacccaagtctagaatcaagagtaagtataagtttagactatagcaaagcacaattttcattacatttaaaaagtgtaacagtagcagatacagcactatattactgtgcaggagcagtaaaaggattctggtttgatgaaccaagcacatggtttggaccatggtcacaaggaacaatggtaacagtagcaagcgcaagtacaaaagga

SEQ ID NO: 50258 - RNA, 387 nt, synthetic construct
  misc_feature 1..387: note = derived and/or modified sequence opt6 from anti-HIV_Chain
  source 1..387: mol_type = other RNA
caaggacatttagtacaaagtggaggaggagtaaaaaaactaggaacatcagtaacaataagttgtttagcaagcgaagatacatttaatgaatttgtaatacattggataagacaagcaccaggacaaggaccattatggttaggattaataaaaagaagtggaagattaatgacaagttatcaatttcaagatagattaagtttaagaagagatagaagtacaggaacagtatttatggaattaagaggattaagagtagatgatacagcagtatattattgtgcaagagatggattaggagaagtagcaccagcatatttatatggaatagatgcatggggacaaggaacaacagtaatagtaacaagtgcaagtacaaaaggg

SEQ ID NO: 50259 - RNA, 387 nt, synthetic construct
  misc_feature 1..387: note = derived and/or modified sequence opt6 from anti-HIV_Chain
  source 1..387: mol_type = other RNA
caagtacaattagtacaaagcgaagcagaagtaaaaaaaccaggatcaagcgtaaaagtaagctgtaaagcaagcggaggaacattcagaggatatacaataagctgggtaagacaagcaccaggacaaggactagaatggatgggaagaataataccaatactaggaaaagcaatatatgcaccaagctttcaaggaagagtaacattaacagcagacaaaagcacaggaacagcatatatggaattatcaagattaagatcagacgatacagcagtatattactgtgcaaaagtaaaaatgagaggatcaagcggatactattacttattcgatgactggggacaaggaacactagtaacagtaagctcagcatcaacaaaagga

SEQ ID NO: 50260 - RNA, 387 nt, synthetic construct
  misc_feature 1..387: note = derived and/or modified sequence opt6 from anti-HIV_Chain
  source 1..387: mol_type = other RNA
caagcaagattagatcaatggggaacaggattattaaaaccaagtgaaacattaagtttaaaatgtgcagtatttggagtattatttacagattataattggacatgggtaagacaaagtccaggaaaaggattagaatggataggacatttagatcatagaggaggaggaaattataatccaagtttagaaagtagagtaacaataagtttagattatagtaaagcacaatttagcttacatttaaaaagtgtaacagtagcagatacagcattatattattgtgcaggagcagtaaaaggattttggtttgacgaagtatataattggtttggaccatggagtcaaggaacattagtaacagtggcaagtgcaagtacaaaagga

SEQ ID NO: 50261 - RNA, 387 nt, synthetic construct
  misc_feature 1..387: note = derived and/or modified sequence opt6 from anti-HIV_Chain
  source 1..387: mol_type = other RNA
caaggacaattagtacaaagcggaggaggagtaaaaaaaccaggaacaagcgtaacaataagctgtctagcaagcgaatacacattcacagaatttacaatacactggataagacaagcaccaggacaaggaccattatggttaggattaataaaaagaagtggaagactaatgacagcatacagattccaagacagattatcactaagaagagatagatcaacaggaacagtattcatggaattaagaaatctaagaatggatgacacagcagtatactattgcgcaagagatggattaggagaactagcaccagcataccaatacggaatagatgtatggggacaaggaacaacagtaatagtaagctcagcatcaacaaaagga

SEQ ID NO: 50262 - RNA, 387 nt, synthetic construct
  misc_feature 1..387: note = derived and/or modified sequence opt6 from anti-HIV_Chain
  source 1..387: mol_type = other RNA
caagtaagattagtacaaagtggaccacaagtaaaaagaccaggagcaagcataagattaagttgtgaaagtagtggatatagatttcaagattatatagtagcatggataagacaaacaagaggacaaggatttgaatttgtaggaatggtaaatccaagaggaggaagaccatggccaagcagtagatttagagatagagtaacattaacaagagatatagaaagtgaaacattttatttaggattaaatgatttaacaagtgatgatacagcaacatatttttgtgcaagattagaagcagatggaagtgattattcaccaaaaatgtttgatttttggggacaaggaacaaaaatagtagtaagtccagcaagtacaaaagga

SEQ ID NO: 50263 - RNA, 387 nt, synthetic construct
  misc_feature 1..387: note = derived and/or modified sequence opt6 from anti-HIV_Chain
  source 1..387: mol_type = other RNA
caagtaagattagtacaaagcggaccacaagtaaaaacaccaggagcaagcatgagagtaagctgtgaagcaagcggatacagattcttagactatataatagtatggataagacaaacacacggacaacatttcgaatacgtaggaatgataaatccaagaggaggaacaccatggccaagctcaaaatttagagatagattatcattaacaagagacatacacacagacacattctatttaggactaaataacttaggaagcgacgatacagcaatatatttctgtgcaagactagaagcagatggagatgactatagcccaaaaatgttcgatcactggggacaaggaacaagaataatagtaagcgcagcatcaacaaaagga

SEQ ID NO: 50264 - RNA, 387 nt, synthetic construct
  misc_feature 1..387: note = derived and/or modified sequence opt6 from anti-HIV_Chain
  source 1..387: mol_type = other RNA
caagtaagattagtacaaagcggaccacaagtaaaaacaccaggagcaagcataagattaagctgtgaagcaagtggatacagattcttagactattttatagtatgggtaagacaaacaccaggacaaggattcgaatacgtaggaatgataaatccaagaggaggaagaccatggtcaagttggaaatttagagatagattaagtttaacaagagaaatagacacagacacattctatttaggactatcaaacttaagatcagacgatacagcaatatatttctgtgcaagactagaagcagatggagatgactatagtccaaaaatggtagattactggggacaaggaacaaaaataatagtaagcgcagcatcaacaaaagga

SEQ ID NO: 50265 - RNA, 387 nt, synthetic construct
  misc_feature 1..387: note = derived and/or modified sequence opt6 from anti-HIV_Chain
  source 1..387: mol_type = other RNA
caagtaagattagtacaaagcggaccacaagtcaaaagaccaggagcgagcataagattaagctgtgaaacaagcggatacagattccaagactatatagtagcatggataaggcaaacaagaggacaaagattcgaatttgtaggaatggtaaatccaagaggaggaagaccatggccaagctcaaaattcagagatagagtaacattaacaagagacatagaatcagaaacattccatctaggactaaatgacttaacatcagacgatacagcaacatatttctgtgcaagattagaagcagatggagcagactatagcccaaaaatgttcgatttctggggacaaggaacaaaaatagtagtaagtccagcatcaacaaaagga

SEQ ID NO: 50266 - RNA, 387 nt, synthetic construct
  misc_feature 1..387: note = derived and/or modified sequence opt6 from anti-HIV_Chain
  source 1..387: mol_type = other RNA
caagtaagattagtacaaagcggaccacaagtaaaaacaccaggagcaagcatgagaataagctgtgaagcaagcggatacagattccaagactatataatagtatggataagacaaacacacggacaaggattcgaatacgtaggaatgataaatccaagaggaggaacaccatggtcaagctcaaaatttagagatagattatcattaacaagagacatatacacagacacattctatttaggactaaataacttaggaagcgacgatacagcaatatatttctgtgcaagactagaagcagatggaggagactatagcccaaaaatgttcgattactggggacaaggaacaagaataatagtaagcgcagcatcaacaaaagga

SEQ ID NO: 50267 - RNA, 387 nt, synthetic construct
  misc_feature 1..387: note = derived and/or modified sequence opt6 from anti-HIV_Chain
  source 1..387: mol_type = other RNA
caaggacaattagtacaaagtggaggaggagtaaaaaaaccaggagcaagtgtaacaataagttgtttagcaagcgaatatacatttaatgaatttgtaatacattggataagacaagcaccaggacaaggaccattatggttaggattaataaaaagaagtggaagattaatgacagcatataaatttcaagatagattatcattaagaagagatagaagcacaggaacagtatttatggaattaagaggattaagaccagaagatacagcagtatattattgtgcaagagatggattaggagaagtagcaccagattatagatatggaatagatgtatggggacaaggaagtacagtaatagtaagtgcagcaagtacaaaagga

SEQ ID NO: 50268 - RNA, 387 nt, synthetic construct
  misc_feature 1..387: note = derived and/or modified sequence opt6 from anti-HIV_Chain
  source 1..387: mol_type = other RNA
caagtaagattagtacaaagcggaccacaaatgaaaacaccaggagcatcattaagattaagctgtgaagtgagcggatacagattcttagactatttcatagtatgggtaagacaaacaggaggacaaggattcgaatacgtaggaatgataaatccaagaggaggaagaccatggagcagctggaaatttagagatagattatcattaacaagagacatagaaacagacacattctatttaggactaaataacttaagaagcgacgatacagcaatatatttctgtgcaagactagaagcagatggagataactatagtccaaaaatggtagattactggggacaaggaacaaaaataatagtaagtccagcatcaacaaaagga

SEQ ID NO: 50269 - RNA, 387 nt, synthetic construct
  misc_feature 1..387: note = derived and/or modified sequence opt6 from anti-HIV_Chain
  source 1..387: mol_type = other RNA
caagtaagtttagtacaaagcggaccacaagtaaaaacaccaggagcaagcatgagagtaagttgtgaaacaagtggatacagattcttagactatataatagtatggataagacaaacacacggacaacatttcgaatacgtaggaatgataaatccaagaggaggaacaccatggccaagctcaaaatttagagatagattaacaatgacaagagacatacacacagacacattctatctaggactaaataatttaagatcagacgatacagcaatatatttctgtgcaagactagaagcagatggagatgactatagcccaaaaatgttcgattactggggacaaggaacaagaataatagtaagcgcagcatcaacaaaagga

SEQ ID NO: 50270 - RNA, 387 nt, synthetic construct
  misc_feature 1..387: note = derived and/or modified sequence opt6 from anti-HIV_Chain
  source 1..387: mol_type = other RNA
caagtaagattagtacaaagcggaccacaagtaaaaacagcaggagcaagcatgagagtaagctgtgaagcaagcggatacagattcctagactatataatagtatggataagacaaacacacggacaacatttcgaatacgtaggaatgataaatccaagaggaggaacaccatggccaagctcaaaatttagagatagattaacattaacaagagacatatacacagacacattctatctaggattaaataacttaggatcaggagatacagcaatatatttctgtgcaagattagaagcagatggagatgactatagcccaaaaatgttcgattactggggacaaggaacaagaataatagtaagcgcagcatcaacaaaagga

SEQ ID NO: 50271 - RNA, 387 nt, synthetic construct
  misc_feature 1..387: note = derived and/or modified sequence opt6 from anti-HIV_Chain
  source 1..387: mol_type = other RNA
caaggacaattagtacaaagcggaggaggagtaaaaaaaccaggaacaagtgtaacaataagctgtctagcaagcgaatacacattcaatgaatttgtaatacactggataagacaagcaccaggacaaggaccagtatggttaggattaataaaaagatcaggaagactaatgacaagttacaaattccaagacagactatcactaagaagagatagatcaacaggaacagtattcatggaattaagaggactaagactagatgacacagcagtatactattgcgcaagagatggattaggagaagtagcaccagcatacttatacggaatagatgcatggggacaaggatcaacagtaatagtaacatcagcatcaacaaaagga

SEQ ID NO: 50272 - RNA, 387 nt, synthetic construct
  misc_feature 1..387: note = derived and/or modified sequence opt6 from anti-HIV_Chain
  source 1..387: mol_type = other RNA
caaggacaattagtacaaagcggaggaggattaaaaaaaccaggaacaagcgtaacaataagctgtctagcaagtgaatacacattcaatgaatttgtaatacactggataagacaagcaccaggacaaggaccattatggttaggattaataaaaagaagcggaagactaatgacagcatacaatttccaagacagactaagactaagaagagatagatcaacaggaacagtattcatggaattaagaggactaagaccagatgatacagcagtatactattgcgcaagagatggattaggagaagtagcaccagattacagatacggaatagatgtatggggacaaggatcaacagtaatagtaacagcagcatcaacaaaagga

SEQ ID NO: 50273 - RNA, 387 nt, synthetic construct
  misc_feature 1..387: note = derived and/or modified sequence opt6 from anti-HIV_Chain
  source 1..387: mol_type = other RNA
caaggacatttagtacaaagcggaggaggagtaaaaaaattaggaacaagtgtaacaataagttgtttagtaagtgaatatacatttaatgaatttgtaatacattggataagacaagcaccaggacaaggaccattatggttaggattaataaaaagaagtggaagattaatgacaagctatcaatttcaagatagattaagtttaagaagagatagaagtacaggaacagtatttatggaattaagaggattaagagtagatgatacagcagtatattattgtgcaagagatggattaggagaagtagcaccagcatatttatatggaatagatgcatggggacaaggaacaacagtaatagtaacaagtgcaagtacaaaagga

SEQ ID NO: 50274 - RNA, 387 nt, synthetic construct
  misc_feature 1..387: note = derived and/or modified sequence opt6 from anti-HIV_Chain
  source 1..387: mol_type = other RNA
caaggacaattagtacaaagtggaggaggagtaaaaaaattaggaacaagtgtaacaataagttgtttagcaagtgaatatacatttaatgaatttgtaatacattggataagacaagcaccaggacaaggaccattatggttaggattaataaaaagatcaggaagattaatgacaagttatcaatttcaagatagattaagtttaagaagagatagaagtacaggaacagtatttatggaattaagaggattaagagtagatgatacagcagtatattattgtgcaagagatggattaggagaagtagcaccagcatatctatatggaatagatgcatggggacaaggaacaacagtaatagtaagcagtgcaagtacaaaagga

SEQ ID NO: 50275 - RNA, 387 nt, synthetic construct
  misc_feature 1..387: note = derived and/or modified sequence opt6 from anti-HIV_Chain
  source 1..387: mol_type = other RNA
caaggacatttagtacaaagtggaggaggagtaaaaaaattaggaacaagtgtaacaataagttgtttagcaagtgaatatacatttaatgaatttgtaatacattggataagacaagcaccaggacaaggaccattatggttaggattaataaaaagaagtggaagattaatgacaagttatcaatttcaagatagattaagtttaagaagagatagaagtacaggaacagtatttatggaattaagaggattaagagtagatgatacagcagtatattattgtgcaagagatggattaggagaagtagcaccagcatatttatatggaatagatgcatggggacaaggaacaacagtaatagtaacaagtgcaagtacaaaagga

SEQ ID NO: 50276 - RNA, 387 nt, synthetic construct
  misc_feature 1..387: note = derived and/or modified sequence opt6 from anti-HIV_Chain
  source 1..387: mol_type = other RNA
caagtacaattagtacaaagcggaagcgaattaaaaaaaccaggagcaagtgtaaaagtaagctgtaaagcaagcggatacacattcacaagctatgcaataaactgggtaagacaagcaccaggacaaggactagaatggatgggatggataaatacaaatacaggaaacccaacatatgcacaaggatttacaggaagatttgtatttagcttagaaacatcagtaagcacagcatatctacaaataaatagcttaaaagcagaagatacagcagtatattactgtgcaagagacttactagaaagcagaacatattacaatgacataagagattgctggggacaaggaacactagtaacagtaagctcagcaagtacaaaagga

SEQ ID NO: 50277 - RNA, 387 nt, synthetic construct
  misc_feature 1..387: note = derived and/or modified sequence opt6 from anti-HIV_Chain
  source 1..387: mol_type = other RNA
caagtacaactagtacaatcaggagcagaagtaaaaaaaccaggagcatcagtaaaagtatcatgcaaagcatcaggatacacattcacagactactacatacactgggtaagacaagcaccaggacaaggactagaatggatgggatggataaacccatcaacaggcggaacaaacttcgtacaaaaattcctaggaagagtaacaatgacatcagacacatcaataaacacagcatacatggaactaagaagactaaaaaacgacgacgcagcaatatactactgcgcaacatactcaacaagacaattcttccactactactacgtaacagacgtatggggacaaggaacaacagtaacagtatcatcagcatcaacaaaagga

SEQ ID NO: 50278 - RNA, 387 nt, synthetic construct
  misc_feature 1..387: note = derived and/or modified sequence opt6 from anti-HIV_Chain
  source 1..387: mol_type = other RNA
tttcaaggacaattagtccaaagcggaggaggagtaaaaaaaccaggatcaagcgtaacaataagctgtttagcaagcgaatacacattcacagaatttacaatacactggataagacaagcaccaggacaaggaccattatggttaggattaataaaaagatcaggaagactaatgacatcatacggattccaagacagactatcagtaagaagagatagatcaacaggaacagtattcatggaattaagatcactaagaacagatgacacagcagtatactattgcgcaagagatggattaggagaactagcaccagcataccattacggaatagatgtatggggacaaggaacaacagtaatagtaacatcagcatcaacatca

SEQ ID NO: 50279 - RNA, 387 nt, synthetic construct
  misc_feature 1..387: note = derived and/or modified sequence opt6 from anti-HIV_Chain
  source 1..387: mol_type = other RNA
caagtacaattagtagaaagcggaggaggagtagtacaaccaggaagaagtttaagattaagttgtgcagcaagtggatttacatttagtagttatgcaatgcattgggtaagacaagcaccaggaaaaggattagaatgggtagcagtaataagttatgatggatcaaataaatattatgcagatagtgtaaaaggaagatttacaataagtagagatgatagtaaaagtacagtatatttacaaataaatagtttaagagcagcagatacagcagtatatttctgtgcaagagaaggaggattaagatttttagaatggttattttggggacaaggaacattagtaacagtaagtagtggagaaagtagtgcaagtacaaaagga

SEQ ID NO: 50280 - RNA, 390 nt, synthetic construct
  misc_feature 1..390: note = derived and/or modified sequence opt6 from anti-HIV_Chain
  source 1..390: mol_type = other RNA
caagtacaattagtacaaagcggagcagtagtaaaaagtccaggatcatcagcaaaattaagctgtcgattactaggagacgaatttggaacatatttcataagttggataagacaagcaccaggaagaggactagaatgggtaggaggaatagttccacatagtcaactacaaagctcagcacaaaaattccatggaagatttttcataacaggaggagtaacaccaccaataatatttctacaactaacaaacgtaacatttgaagatacaggaacatatttctgtgcaagagaaagaggaagacacagagacccaaaaacaggaaaatcattaagaggaagatatttcgatttctggggaagaggaacaggagtgacagtaagtcca

SEQ ID NO: 50281 - RNA, 390 nt, synthetic construct
  misc_feature 1..390: note = derived and/or modified sequence opt6 from anti-HIV_Chain
  source 1..390: mol_type = other RNA
caaatagaattaagacaaagtggagcagcaatgaaaagtccaggaagtagtgtaaaattaagttgtacagtactaggagaaaatttcggaacatatttcataagctggataagacaagcaccaggacaaggactagaatgggtaggaggaatagtaccacatagtcaactacaaagcagtgcacaaaaatttcacggaagaataaaaataagtggaggaggaacaccaccagtagtaagtctagaattaacaaatgtaacatttgatgatacaggaacatatttctgtgcaagagaaagaggaagacacgtagaaccaaaaacaggagatagattagcaggaagatattttgatatatggggaagaggaacaggattaagagtaagccca

SEQ ID NO: 50282 - RNA, 390 nt, synthetic construct
  misc_feature 1..390: note = derived and/or modified sequence opt6 from anti-HIV_Chain
  source 1..390: mol_type = other RNA
gaagtacaattagtagaaagcggaggaggattagtaaaaccaggagggagcctaagattaagttgtgaagcaagcggattcacattcacaaacgcatggatgaactgggtaagacaagcaccaggaaaaggattagaatgggtaggaagaataaaaagccaaacacatggaggaacaacaagatatgcagcaccagtaaaaggaagatttacaataagcagagacgatagcaaacacacactatatctacaaatggatagattaacaacagaagatacagcagtatattactgtacaggaacaataacaggaagtacattctattactatggaatggacgtatggggacaaggaacaacagtaacagtaagtccagcaagcacaaaagga

SEQ ID NO: 50283 - RNA, 390 nt, synthetic construct
  misc_feature 1..390: note = derived and/or modified sequence opt6 from anti-HIV_Chain
  source 1..390: mol_type = other RNA
gtagtacaattagtacaatcaggaccaggactagtaaaaccctcacaaacactatcactaacatgcacagtatcaggaggatcaatatcatcaggagacttctactggtcatggataagacaaccaccaggaaaaggactagaatggataggatacatatactactcaggatcaacatactacaacccatcactaaaatcaagactaacaatatcagtagacacatcaaaaaaccaattctcattaagactatcatcagtaacagcagcagacacagcagtatactactgcgcaagagacctaaactcaagaatagtaggagcactagacgcattcgacatatggggacaaggaacaatggtaacagtatcatcagcatcaacaaaagga

SEQ ID NO: 50284 - RNA, 390 nt, synthetic construct
  misc_feature 1..390: note = derived and/or modified sequence opt6 from anti-HIV_Chain
  source 1..390: mol_type = other RNA
gaagtacaattagtacaaagcggaggaggattagtacaaccaggaagaagtttaagattaagttgtgcagcaagtggatttacatttgatgattatgcaatgcattgggtaagacaagcaccaggaaaaggattagaatgggtaagtggaataagttggaatagtggaacaataggatatgcagatagtgtaagaggaagatttacaataagcagagatgatgcaaaaagtagtttatatttacaaatgaatagtttaagaacagaagatacagcattatattattgtgcaaaagatggatgggtaggaagtggaagtagtacattaagaggaagtgattattggggacaaggaacattagtaacagtaagtagtgcaagtacaaaagga

SEQ ID NO: 50285 - RNA, 390 nt, synthetic construct
  misc_feature 1..390: note = derived and/or modified sequence opt6 from anti-HIV_Chain
  source 1..390: mol_type = other RNA
caatcagtattaacacaaccaccatcagcatcaggatcaccaggacaatcaataacaatatcatgcacaggaacatcatcagacgtaggaggatacaactacgtatcatggtaccaacaaccaccaggaaaagcaccaaaagtaataatatacgaagtaagcaaaagaccatcaggagtaccagacagattctcaggatcaaaatcaggaaacacagcatcattaacagtctcaggactacaagcagaagacgaagcagactactactgctcatcatacgcaggatcaaacaatttcgtattcggaacaggaacagaagtaacagtagtaggacaaccaaaagcaaacccaacagtaacactattcccaccatcaagcgaagaattacta

SEQ ID NO: 50286 - RNA, 390 nt, synthetic construct
  misc_feature 1..390: note = derived and/or modified sequence opt6 from anti-HIV_Chain
  source 1..390: mol_type = other RNA
caagcagtagtaacacaagaaccatcactaacagtatcaccaggaggaacagtaacattaacatgcgcctcatcaacaggagcagtaacatcaggattctacccacactggttccaacaaaaaccaggacaagcaccaagagcattaatatactcaacatcaaacagatactcatggacaccagcaagattctcaggatcactactaggaggaaaagcagcactaacactatcaggagtacaaccagaagacgaagcagaatactactgcttactactaccatactacggaggaccatggatattcggaggaggaacaaaattaacagtactaggacaaccaaaagcagcaccatcagtaacactattcccaccatcatcagaagaacta

SEQ ID NO: 50287 - RNA, 390 nt, synthetic construct
  misc_feature 1..390: note = derived and/or modified sequence opt6 from anti-HIV_Chain
  source 1..390: mol_type = other RNA
caatcagcactaacacaaccaccatcagcatcaggagcaccaggacaaagagtcacaatatcatgctcaggaggaccatcaaacgtaggaggaaactacgtatactggtacagacaattcccaggaacagcaccaacactactaatactaagagacgaccaaagaccatcaggagtaccagacagattctcagcatcaaaatcaggaaactcagcatcactagcaatatcaggactaagaccagacgacgaaggattctacttctgcgcaacatatgactcagacggatcaataagactattcggaggaggaacagcactaacagtactatcacaaccaaaagcagcaccatcagtaacactattcccaccatcctcagaagaactaaaa

SEQ ID NO: 50288 - RNA, 390 nt, synthetic construct
  misc_feature 1..390: note = derived and/or modified sequence opt6 from anti-HIV_Chain
  source 1..390: mol_type = other RNA
caagtacaattagtagaaagtggaagcgatgtaagaaaaccaggagcaacagtaacagtaagctgtaaagcagatgaagacgaagacgatttcacagcatataattattttatgcactgggtaagacaagcaccaggacacggactagaatggataggatggataaatccaagaacaggacaaccaaatcatgcaaaacaatttcaaggaagagtaacattaacaagagaaagaagtacgagtacagtatttatgaaattaacaaacttaagattagacgatacagcagtatatttctgtgcaagaccattaagaggaggagatacatggcattatcattcatggggaagaggaacatcattaacagtatcaagtgcaagcacaaaagga

SEQ ID NO: 50289 - RNA, 390 nt, synthetic construct
  misc_feature 1..390: note = derived and/or modified sequence opt6 from anti-HIV_Chain
  source 1..390: mol_type = other RNA
gaagtacaattagtagaaagtggaagtgatgtaagaaaaccaggagcaacagtaacagtaagctgtaaagcagatgaagatgaagacgattttacagcatataattattttatgcactgggtaagacaagcaccaggacacggactagaatggataggatggataaatccaagaacaggacaaccaaatcatgcaaaacaatttcaaggaagagtaacattaacaagagaaagaagcacaagtacagtatttatgaaattaacaaatttaagattagacgatacagcagtatatttctgtgcaagaccattaagaggaggagatacatggcattatcattcatggggaagaggaacatcattaacagtatcaagtgcaagtacaaaagga

SEQ ID NO: 50290 - RNA, 390 nt, synthetic construct
  misc_feature 1..390: note = derived and/or modified sequence opt6 from anti-HIV_Chain
  source 1..390: mol_type = other RNA
gaagtacaattagtacaatcaggatcagacgtaagaaaaccaggagcaacagtaacagtatcatgcaaagcagatgaagatgaagatgactttacagcatatgattactttatgcattgggtaagacaagcaccaggacatggactagaatggataggatggataaacccaagaacaggacaaccaaatcacgcaaaacaattccaaggaagagtaacactaacaagagaaagatcaacatcaacagtattcatgaaattaacaaatctaagactagatgacacagcagtatacttttgcgcaagaccactaagaggaggagacacatggcattaccatagctggggaagaggaacatcattaacagtaagttcagcatcaacaaaagga

SEQ ID NO: 50291 - RNA, 390 nt, synthetic construct
  misc_feature 1..390: note = derived and/or modified sequence opt6 from anti-HIV_Chain
  source 1..390: mol_type = other RNA
caagtacaattagtacaatcaggatcagacgtaagaaaaccaggagcaacagtaacagtatcatgcaaagcagatgaagacgaagacgactttacagcatacaattactttatgcactgggtaagacaagcaccaggacacggactagaatggataggatggataaacccaagaacaggacaaccaaatcacgcaaaacaattccaaggaagagtaacactaacaagagaaagatcaacatcaacagtattcatgaaattaacaaatttaagactagacgacacagcagtctacttctgcgcaagaccattaagaggaggagacacatggcattaccattcatggggaagaggaacatcattaacagtatcatcagcatcaacaaaaggc

SEQ ID NO: 50292 - RNA, 390 nt, synthetic construct
  misc_feature 1..390: note = derived and/or modified sequence opt6 from anti-HIV_Chain
  source 1..390: mol_type = other RNA
caagtacaattagtacaaagcggaagcgatgtaagaaaaccaggagcaacagtaacagtaagctgtaaagcagacgaagacgaagacgatttcacagcatataattatttcatgcactgggtaagacaagcaccaggacacggactagaatggataggatggataaatccaagaacaggacaaccaaaccatgcaaaacaatttcaaggaagagtaacattaacaagagaaaggagcacaagtacagtatttatgaaactaacaaacctaagattagacgatacagcagtatatttctgtgcaagaccattaagaggaggagatacatggcattatcattcaagaggaagaggaacaagtctaacagtatcaagcgcaagtacaaaagga

SEQ ID NO: 50293 - RNA, 390 nt, synthetic construct
  misc_feature 1..390: note = derived and/or modified sequence opt6 from anti-HIV_Chain
  source 1..390: mol_type = other RNA
gaagtacaattagtagaaagtggaagtgatgtaagaaaaccaggagcaacagtaacagtaagttgtaaagcagatgaagatgaagatgattttacagcatataattattttatgcattgggtaagacaagcaccaggacaaggactagaatggataggatggataaatccaagaacaggacaaccaaatcatgcaaaacaatttcaaggaagagtaacattaacaagagaaagaagtacaagtacagtatttatgaaattaacaaatttaagattagatgatacagcagtatatttttgtgcaagaccattaagaggaggagatacatggcattatcatagttggggaagaggaacaagtttaacagtaagtagtgcaagcacaaaagga

SEQ ID NO: 50294 - RNA, 390 nt, synthetic construct
  misc_feature 1..390: note = derived and/or modified sequence opt6 from anti-HIV_Chain
  source 1..390: mol_type = other RNA
gtagtacaattagtacaatcaggatcagacgtaagaaaaccaggagcaacagtaacagtatcatgcaaagcagatgaagatgaagatgactttacagcatacaattactttatgcattgggtaagacaagcaccaggacatggattagaatggataggatggataaacccaagaacaggacaaccaaatcacgcaaaacaattccaaggaagagtaacactaacaagagaaagatcaacatcaacagtattcatgaaattaacaaatctaagactagatgacactgcagtatacttttgcgcaagaccactaagaggaggagacacatggcattaccatagttggggaagaggaacaagcctaacagtaagctcagcatcaacaaaagga

SEQ ID NO: 50295 - RNA, 390 nt, synthetic construct
  misc_feature 1..390: note = derived and/or modified sequence opt6 from anti-HIV_Chain
  source 1..390: mol_type = other RNA
gaagtacaattagtacaatcaggatcagacgtaagaaaaccaggagcaacagtaacagtatcatgcaaagcagatgaagatgaagatgactttacagcatacaattactttatgcattgggtaagacaagcaccaggacatggactagaatggataggatggataaacccaagaacaggacaaccaaatcacgcaaaacaattccaaggaagagtaacactaacaagagaaagatcaacatcaacagtattcatgaaattaacaaatctaagactagatgacacagcagtatacttttgcgcaagaccactaagaggaggagacacatggcattaccatagctggggaagaggaacaagtttaacagtaagctcagcatcaacaaaagga

SEQ ID NO: 50296 - RNA, 390 nt, synthetic construct
  misc_feature 1..390: note = derived and/or modified sequence opt6 from anti-HIV_Chain
  source 1..390: mol_type = other RNA
gaagtacaactagtacaatcaggatcagacgtaaaaaaaccaggaacaacagtaacaataagctgcaaagcagatgaagacgaagacgacttcacagcatacaattactttatgcactgggtaagacaagcaccaggacaaggactagaatggataggatggataaacccaagaacaggacaaccaaatcacgcaaaacaattacaaggaagagtaacactaacaagagaaagatcaacatcaacagtattcatgaaattaacaaacttaagactagacgacacagcagtatacttctgcgcaagaccactaagaggaggagacacatggcactaccattcatggggaagaggaacatcattaatagtaagctcagcatcaacaaaagga

SEQ ID NO: 50297 - RNA, 390 nt, synthetic construct
  misc_feature 1..390: note = derived and/or modified sequence opt6 from anti-HIV_Chain
  source 1..390: mol_type = other RNA
caagtacaattagtagaaagtggaggaggattagtaaaaccaggaggaagtctaagattaagttgtgcagcaagtggatttagttttaatgaatattatatgagttggataagacaagcaccaggacaaggattagaatgggtagcaaatataggaagcagtgatgcatatacaatatacgcagatagtgtaaaaggaagatttacaataagtagagataatgcagaaaatacagtatatctacaaatgaatagtttaagaggagaagatacagcagtatattattgtgcaagaatagaaggatattgtagtaatagtagatgtagtaattattttgatccatggggacaaggagcattagtaacagtaagtagtgcaagtacaaaagga

SEQ ID NO: 50298 - RNA, 390 nt, synthetic construct
  misc_feature 1..390: note = derived and/or modified sequence opt6 from anti-HIV_Chain
  source 1..390: mol_type = other RNA
caagtacaattagtacaaagcggagcagaagtaaaaaaaccaggagcaagtgtaaaagtaagttgtaaagtaagtggatatccattagcagaattaagtgtacactgggtaagacaagtaccaggaaaaggattagaatgggtaggaggatttgatccagaagaaggaaaaacagtatatgcacaaaaatttcaaggaagagtaacaatgacagaagacagatcaacagatacagtatatatggaattaataagtttaagatatgaagatacagcagtatattattgtgcaacagataatccagtattacaattaggagaattaagtagtagtctagattattggggacaaggaacattagtaacagtaagtagcgcaagtacaaaagga

SEQ ID NO: 50299 - RNA, 390 nt, synthetic construct
  misc_feature 1..390: note = derived and/or modified sequence opt6 from anti-HIV_Chain
  source 1..390: mol_type = other RNA
gaagtacaattagtacaaagcggagcagaagtaaaaaaaccaggagaaagtttaagaataagctgtaaaacaagcggatataattttaatgacgattggatagcatgggtaagacaaagaccagataaaggaccagaatggatgggaatattttatccaggagactcacaagcaacatatagtccaagttttcaaggacacgtaacatttagtgcagacacaagcataagtacagcatatttacaatggacaagtttaaaagcaagtgacacagcaatatattactgtgcaagaacaagatgctttggagcaaattgtttcaatttcatggacgtatggggaaaaggaacagcactaacagtaacagtatcaagcgcaagtacaaaagga

SEQ ID NO: 50300 - RNA, 390 nt, synthetic construct
  misc_feature 1..390: note = derived and/or modified sequence opt6 from anti-HIV_Chain
  source 1..390: mol_type = other RNA
caagtacaattagtacaattattacaaagtggagcagaagtaaaaaaaccaggaagtagtgtaaaagtaagttgtcaaataagtggatatggatttagtaattatgcaataagttgggtaagacaagcaccaggacaaggattagaatggttaggaagaatagtaccagcagtaggaatgacagaatatgcacaaaaatttcaaggaagagtaacatttacagcagatagaagtacaataacagcatatatggatttaagaggattaagaagtgatgatacagcagtatattattgtgtaagagatccacaagtagaagtaagagggaatgcatttgatatatggggacaaggaacaatggtaacagtaagtagtgcaagcacaaaagga

SEQ ID NO: 50301 - RNA, 390 nt, synthetic construct
  misc_feature 1..390: note = derived and/or modified sequence opt6 from anti-HIV_Chain
  source 1..390: mol_type = other RNA
caagtacatctacaacaatggggagcaggattactaaaaccatcagaaacactatcactaacatgcgcagtatcaggaggcagctttagcggattcttttggacatggataagacaaagcccaggaaaaggattagaatggataggagaagtaaaccatagcggattcacacactctaacccatcattagaaagcagagcaacaataagcgtagcagcaagcaatacacaattctcattaagactagcaagtgtaacagcagcagatacagcaatatatttctgtgcattaagatatttcgattggtcaccatttagaagagacacatacggaacagatgtatggggacaaggaacaacagtaatagtaagctcagcatcaacaaaagga

SEQ ID NO: 50302 - RNA, 390 nt, synthetic construct
  misc_feature 1..390: note = derived and/or modified sequence opt6 from anti-HIV_Chain
  source 1..390: mol_type = other RNA
caagtaagattagaacaaagcggaggagcactaagaaaaccaggagcaagcgtaacattaagttgtcaagcaagtggatacaatttcgtaaaatatataatacactgggtaagacaaagaccaggactaggattcgaatgggtaggaatgatagatccatatagaggaagaccatggtatgcacatagctttgcaggaagattaagtttaagcagagacacaagcacagaaacactatatatgacactaagctcattaaaatcagacgatacagcaacatatttctgtgcaagagcagaagcagcaagcgatagccatagcagaccaataatggattggacatggagaatattatgcttactagcagtagtaccagcaagtacaaaagga

SEQ ID NO: 50303 - RNA, 390 nt, synthetic construct
  misc_feature 1..390: note = derived and/or modified sequence opt6 from anti-HIV_Chain
  source 1..390: mol_type = other RNA
caagtaagattagaacaaagcggagcagcagtaagaaaaccaggagcaagtgtaacattaagctgtcaagcaagtggatataattttgtaaattatataatacactgggtaagacaaagaccaggactagatttcgaatgggtaggaatgatagatccatatagaggaagaccatggtcagcacataaatttcaaggaagattaagtttaagcagagacgtaagtacagaaatattatatatgacattaaatagtttaagatcagatgatacagcaacatatttttgtgcaagagcagaagcagaaagtcaaagtcatagtagaccaataatgtttgattcatggggacaaggaagcagagtaacagtatcaagcgcaagtacaaaagga

SEQ ID NO: 50304 - RNA, 390 nt, synthetic construct
  misc_feature 1..390: note = derived and/or modified sequence opt6 from anti-HIV_Chain
  source 1..390: mol_type = other RNA
caagtaagattagaacaaagtggagcagcagtaaaaaaaccaggagcaagtgtaacaataagttgtcaagcaagcggatataattttgtaaaattttttatacattgggtaagacaaagaccaggacaaggatttgaatgggtgggaatgatagaaccatatagaggaagaccatggtcagcaggaaattttcaaggaagattaagcttaagtagagatgtaagtacagaaacattatatatgacattaaataatctaagatcagatgatacagcagtatatttttgtgcaagactagaagcagaaagtgatagtcatagtagaccaataatgtttgatcattgggggcatggaagtttagtaacagtatcaagtgcaagtacaaaagga

SEQ ID NO: 50305 - RNA, 390 nt, synthetic construct
  misc_feature 1..390: note = derived and/or modified sequence opt6 from anti-HIV_Chain
  source 1..390: mol_type = other RNA
caagtaagactagaacaatcaggagcagcagtaagaaaaccaggagcatcagtaacattatcatgtcaagcatcaggatataattttgtaaattatataatacattgggtaagacaaagaccaggattagattttgaatgggtaggaatgatagatccatatagaggaagaccatggagtgcacataaatttgaaggaagattatcattatcaagagatgtaagtacagaagtattatatatgacattaagttcattaagaagtgatgatacagcaacatatttttgtgcaagagcagaagcagaatcacaatcacattcaagaccaataatgtttgattattggggtcaaggatcaagagtaacagtaagttcagcatcaacaaaagga

SEQ ID NO: 50306 - RNA, 390 nt, synthetic construct
  misc_feature 1..390: note = derived and/or modified sequence opt6 from anti-HIV_Chain
  source 1..390: mol_type = other RNA
caagtaagattagaacaaagtggaacagcagtaagaaaaccaggagcaagtgtaacaataagctgtcaagcaagtggatataattttgtaaaattttttatacatggagtaagacaaagaccaggacaaggatttgaatgggtaggaatgatagaaccttttagaggaagaccatggtcagcaggaaattttcaaggaagattaagtttaagtagagatgtaagtacagaaacattatatatgacattaaataatttaagatcagatgatacagcagtatatttttgtgcaagattagaagcagaaagtgatagccatagtagaccaataatgtttgatcattggggacatggaagtttagtaacagtatcaagtgcaagtacaaaagga

SEQ ID NO: 50307 - RNA, 390 nt, synthetic construct
  misc_feature 1..390: note = derived and/or modified sequence opt6 from anti-HIV_Chain
  source 1..390: mol_type = other RNA
caagtaagattagaacaatcaggaacagcaatgagaaaaccaggagcaagtgtaacattatcatgtcaagcatcaggatataattttgtaaaatatatagtacattgggtaagacaaaaaccaggattaggatttgaatgggtaggaatgatagatccatatagaggaagaccatggagtgcacataaatttcaaggaagactaagtttatcaagagatacatcaatggaaatattatacatgacattaacatcattaaaaagtgatgacacagcaacgtatttttgtgcaagagcagaagcagcatcagactcacattcaagaccaataatgtttgatcactggggacaaggatcaagagtaacagtaagttcagcatcaacaaaagga

SEQ ID NO: 50308 - RNA, 390 nt, synthetic construct
  misc_feature 1..390: note = derived and/or modified sequence opt6 from anti-HIV_Chain
  source 1..390: mol_type = other RNA
caagtaagattagaacaaagcggagcagcaatgagaaaaccaggagcaagcgtaacattatcatgtcaagcaagcggatataattttgtaaaatatatagtacactgggtaagacaaaaaccaggactaggattcgaatgggtaggaatgatagatccatatagaggaagaccatggtcagcacataaatttcaaggaagattaagtttaagcagagacacaagtatggaaatattatatatgacactaacaagtttaaaatcagatgatacagcaacatatttctgtgcaagagcagaagcagcaagcgatagccatagcagaccaataatgtttgaccattggggacaaggaagcagagtaacagtatcaagtgcaagcacaaaagga

SEQ ID NO: 50309 - RNA, 390 nt, synthetic construct
  misc_feature 1..390: note = derived and/or modified sequence opt6 from anti-HIV_Chain
  source 1..390: mol_type = other RNA
caagtaagattagaacaaagtggagcagcaatgagaaaaccaggagcaagtgtaacattaagctgtcaagcaagtggatataattttgtaaaatatataatacactgggtaagacaaaaaccaggattaggatttgaatgggtaggaatgatagatccatatagaggaagaccatggtcagcacataaatttcaaggacgattaagtttaagtagagacacaagtatggaaatattatatatgacattaacaagtttaaaaagtgatgatacagcaacatatttctgtgcaagagcagaagcagcaagtgatagtcatagtagaccaataatgtttgatcattggggacaaggaagtagagtaacagtatcaagtgcaagtacaaaagga

SEQ ID NO: 50310 - RNA, 390 nt, synthetic construct
  misc_feature 1..390: note = derived and/or modified sequence opt6 from anti-HIV_Chain
  source 1..390: mol_type = other RNA
caagtaagattagaacaaagtggaaatgcagtaagaaaaccaggagcaagtgtaacaataagttgtcaagcaagcggatataattttgtaaaattctttatacattgggtaagacaaagaccaggacaaggatttgaatgggtaggaatgatagaaccatttagaggaagaccatggtcagcaggaaattttcaaggaagattaagtttaagcagagatgtaagtacagaaacattatatatgacattaaataatttaagatcagatgatacagcagtatatttttgtgcaagattagaagcagaaagtgatagtcatagtagaccaataatgtttgatcattggggacatggaagtttagtaacagtatcaagtgcaagtacaaaagga

SEQ ID NO: 50311 - RNA, 390 nt, synthetic construct
  misc_feature 1..390: note = derived and/or modified sequence opt6 from anti-HIV_Chain
  source 1..390: mol_type = other RNA
caagtaagattagaacaaagtggagcagcagtaagaaaaccaggagcaagtgtaacattaagttgtcaagcaagtggatataattttgtaagatatataatacattgggtaagacaaagaccaggattagattttgaatgggtaggaatgatagatccatatagaggaagaccatggagtgcacataaatttggaggaagattaagtttaacaagagatgtaagtacagaaatattatatatgacattaacaagtttaagaagcgatgatacagcaacatatttttgtgcaagagcagaagcagaaagtcaaagtcatagcagaccaataatgtttgatagttggggacaaggaagtagagtaacagtaagtagtgcaagtacaaaagga

SEQ ID NO: 50312 - RNA, 390 nt, synthetic construct
  misc_feature 1..390: note = derived and/or modified sequence opt6 from anti-HIV_Chain
  source 1..390: mol_type = other RNA
caagtaagattagaacaatcaggagcagcagtaagaaaaccaggagcatcagtaacattatcatgtcaagcatcaggttataattttgtaaattatataatacattgggtaagacaaagaccaggactagactttgaatgggtaggaatgatagacccatatagaggaagaccatggagtgcacataaatttcaaggaagactatcactaagtagagatgtatcaacagaaatattatatatgacattaagttcattaagaagcgatgacacagcaacatatttttgtgcaagagcagaagcagaatcacaatcacattcaagaccaataatgtttgatttctggggacaaggatcaagagtaacagtaagttcagcaagtacaaaagga

SEQ ID NO: 50313 - RNA, 390 nt, synthetic construct
  misc_feature 1..390: note = derived and/or modified sequence opt6 from anti-HIV_Chain
  source 1..390: mol_type = other RNA
caagtaagattagaacaaagtggaacagcagtaagaaaaccaggagcaagtgtaacaataagttgtcaagcaagtggatataattttgtaaaattttttatacattgggtaagacaaagaccaggacaaggatttgaatgggtaggaatgatagaaccatttagaggaagaccatggagtgcaggaaattttcaaggaagattaagtttaagtagagatgtaagtacagaaacattatatatgacattaaataatttaagatcagatgatacagcagtatatttttgtgcaagattagaagcagaaagtgatagtcatagtagaccaataatgtttgatcattggggacatggaagtttagtaacagtaagtagtgcaagtacaaaagga

SEQ ID NO: 50314 - RNA, 390 nt, synthetic construct
  misc_feature 1..390: note = derived and/or modified sequence opt6 from anti-HIV_Chain
  source 1..390: mol_type = other RNA
caagtaagattagaacaaagcggagcagcaatgagaaaaccaggagcaagtgtaacattaagctgtcaagcaagtggatataattttgtaaaatatatagtacactgggtaagacaaaaaccaggactaggatttgaatgggtaggaatgatagatccatatagaggaagaccatggagtgcacataaatttcaaggaagactaagtttaagcagagacacaagtatggaaatattatatatgacattaacaagtttaacatcagatgatacagcaacatatttctgtgcaagagcagaagcagcaagtgatagtcatagtaggccaataatgtttgatcattggggacaaggaagcagagtaacagtatcaagtgcaagtacaaaagga

SEQ ID NO: 50315 - RNA, 390 nt, synthetic construct
  misc_feature 1..390: note = derived and/or modified sequence opt6 from anti-HIV_Chain
  source 1..390: mol_type = other RNA
gaagtacaattagtacaaagtggaggaggattagtacaaccaggaggaagtttaagattgagttgtgcagcaagtggattaacattcagaaattttgcaatgagttgggtaagacaagcaccaggaaaaggattagaatgggtgagtagtataagtggaagtggaggaagtacatattatgcagacagtgtaaaaggaagatttacaataagtagagataatagtaaaaatacattatatctacaaatgaatagtttaagaggagaagatacagcagtatatttttgtgcaaaaggagtaggatatgatatattaacaggattaggagatgcatttgatatatggggacaaggaacagtagtagcagtaagtagtgcaagtacaaaagga

SEQ ID NO: 50316 - RNA, 393 nt, synthetic construct
  misc_feature 1..393: note = derived and/or modified sequence opt6 from anti-HIV_Chain
  source 1..393: mol_type = other RNA
caagtacaattagtacaatcaggagcagcagtaagaaaaccaggagcatcagtaacagtaagctgtaaatttgcagaagacgatgactattcaccacactgggtaaatccagcaccagaacactatatacatttcttaagacaagcaccaggacaacaattagaatggctagcatggatgaacccaacaaatggagcagtaaattacgcatggcaattacatggaagactaacagcaacaagagatggatcaatgacaacagcattcttagaagtaagatcactaagatcagatgacacagcagtatactattgcgcaagagcacaaaaaagaggaagatcagaatgggcatatgcacattggggacaaggaacaccagtattagtatcatca

SEQ ID NO: 50317 - RNA, 393 nt, synthetic construct
  misc_feature 1..393: note = derived and/or modified sequence opt6 from anti-HIV_Chain
  source 1..393: mol_type = other RNA
caagtacaattacaacaatggggagcaggactattaaaaccatcagaaacattatcattaacatgtgcagtatacgcaggatcattctcaggatattactggacatggataagacaaccaccaggaaaaggactagaatggataggagaagtaaatcacggaggatcaacaaattacaatccatcactaaaatcaagagtaacattatcagtagacacaagcaaaaatcaattttcattaaaattaacatcagtaacagcagcagacacagcagtatactactgcgcaagagtatcaagatacgacttctggtcaggaaactatggatcatacggactagacgtatggggacaaggaacaacagtaacagtatcatcagcatcaacaaaagga

SEQ ID NO: 50318 - RNA, 393 nt, synthetic construct
  misc_feature 1..393: note = derived and/or modified sequence opt6 from anti-HIV_Chain
  source 1..393: mol_type = other RNA
gaagtacaattagtacaaagcggaggaggagtagtacaaccaggaagaagtttaagattaagctgtgtagtaagtggatttacatttagtagttttacatttcattgggtaagacaagcaccaggaaaaggattagaatgggtagcaggaatgagttttcatgcaacatatatatattatgcagatagtgtaaaaggaagatttacaataagcagagatgatagtcaagatacattatatttagaaatggatagtttaagaagtgaagatacagcaatatattattgtgcaagagatccaggaatacatgattatggagattatgcaccaggagcatttgattattggggacaaggaagtccagtaacagtaagtagtgcaagtacaaaagga

SEQ ID NO: 50319 - RNA, 393 nt, synthetic construct
  misc_feature 1..393: note = derived and/or modified sequence opt6 from anti-HIV_Chain
  source 1..393: mol_type = other RNA
caagtacaattagtacaaagtggaacagaagtacaaaaaccaggagcatcagtaaaagtaagttgtaaaacaagtggatatacatttagtaaatattatatacattgggtaagacaagcaccaggacaaggattagaatgggtaggaagaataaatacagatagtggaggaacagattatgcagaaaaatttcaaggaagagtaacaatgacaagagacacaagtataacaacagtatatttagaaatgagaggattaacatcagatgatacagcagcattttattgtgcaagaggaccaccacatgcaggaggatggacaatatattattatggattagatgtatggggacaaggaacaagtgtaatagtaagtagtgcaagtacaaaagga

SEQ ID NO: 50320 - RNA, 393 nt, synthetic construct
  misc_feature 1..393: note = derived and/or modified sequence opt6 from anti-HIV_Chain
  source 1..393: mol_type = other RNA
agaacagtagtaacacaaccaccatcagtatcaggagcaccaggacaaagagtaacaatatcatgcacaggatcatcatcaaacataggagcaggctacgacgtacactggtaccaacaactaccaggaacagcaccaaaactactaatatacggaaactcaaacagaccatcaggagtaccagacagattctcaggatcaaaatcaggaacaagcgcatcactagcaataacaggactacaagcagaagacgaagccgactactactgccaatcatacgactcatcactatcaggatcaggagtattcggaacaggaacaaaagtaacagtactaggacaaccaaaagcaaacccaacagtaacactattcccaccatcatcagaagaacta

SEQ ID NO: 50321 - RNA, 393 nt, synthetic construct
  misc_feature 1..393: note = derived and/or modified sequence opt6 from anti-HIV_Chain
  source 1..393: mol_type = other RNA
caagtacaactacaacaatggggaagtggattattaaaaccaagtgaaacattaagtttaacatgtgcagtatatggaggaagttttagaagttattattggaattggataagacaaagtccaggaaaaggattagaatggataggagaagtaagtcatagtggaagtacaaattataatccagcattaaaaagtagagtaacaataagtgtagatacaagtaaaaatcaatttagcttaaaagtaaaaagtgtaacagcagcagatacagcactatattattgtagtagaggaagaggaaaaagatgtagtggagcatattgttttgcaggatattttgatagttggggacaaggaggattagtagtagtaagcagtgcaagtacaaaagga

SEQ ID NO: 50322 - RNA, 393 nt, synthetic construct
  misc_feature 1..393: note = derived and/or modified sequence opt6 from anti-HIV_Chain
  source 1..393: mol_type = other RNA
caagtacatttagtacaatcaggagcagaagtaaaaaaaccaggaagttcagtaagagtatcatgcgaagcatcaggatggacatttggatcagtaaatagtgcaataacatgggtaagacaagcaccaggacaaggattagaatggatgggaagaacaataccattcttaggaataagcaattacgcacaaaaattccaaggaagagtaacaataacagcagataaaagtacaaatatagcatacgtagacgtaacatcactaacaagtcaagacacagcagtatactattgcgcaagactaataacaggaatgacagcaccatggttctattatatggatgtatggggaaaaggaacaacagtaacagtatcaagcgcaagcacaaaagga

SEQ ID NO: 50323 - RNA, 393 nt, synthetic construct
  misc_feature 1..393: note = derived and/or modified sequence opt6 from anti-HIV_Chain
  source 1..393: mol_type = other RNA
caagtacacctacaagaatcaggaccaagactagtaagatcatcagaaacactatcactaacatgctcagtaccaggaggatcaatagtaaacccaataacaaactactactggtcatggataagacaatcaccaagaaaaggactacaatggataggagacatatactacacaggaacaagctcaagaaacccatcactagactcaagagtatcaatatcaatggacgtatcaagaaaacaaatatcattaacactatactcagtaacagcagcagacacagcagtacactactgcgcatcacaaagcctatcatggtacagaccatcaggatacttcgaatcatggggacaaggaatactagtaacagtatcatcagcatcaacaaaagga

SEQ ID NO: 50324 - RNA, 393 nt, synthetic construct
  misc_feature 1..393: note = derived and/or modified sequence opt6 from anti-HIV_LightChain
  source 1..393: mol_type = other RNA
atgaaactaccagtaagactattagtactaatgttctggataccagcatcatcatcagacatagtaatgacacaatcaccactatcactaccagtaacaccaggagaaccagcatcaatatcatgcagatcatcacaaagactactatcatcatacggacacacatacctacactggtacctacaaaaaccaggacaatcaccacaactactaatatacgaagtatcaaacagattctcaggagtaccagacagattctcaggatcaggatcaggaacagacttcacactaaaaatatcaagagtagaagcagaagacgtaggagtatactactgctcacaatcaacacacgtaccactaacattcggacaaggaacaaaagtagaaataaaa

SEQ ID NO: 50325 - RNA, 396 nt, synthetic construct
  misc_feature 1..396: note = derived and/or modified sequence opt6 from anti-HIV_Chain
  source 1..396: mol_type = other RNA
caagtacaattacaagaaagcggaccaggattagtaaaaccaagcgaaacattaagcgtaacatgtagcgtaagtggagactcaatgaataactattactggacatggataagacaatcaccaggaaaaggactagaatggataggatatatctcagacagagcctcagcaacatacaatccatcactaaatagcagagtagtaatatcaagagatacaagcaaaaatcaattaagcctaaaattaaactcagtaacaccagcagacacagcagtatactattgcgcaacagcaagaagaggacaaagaatatacggagtagtatcatttggagaatttttctactattacagtatggatgtatggggaaaaggaacaacagtaacagtaagctca

SEQ ID NO: 50326 - RNA, 396 nt, synthetic construct
  misc_feature 1..396: note = derived and/or modified sequence opt6 from anti-HIV_Chain
  source 1..396: mol_type = other RNA
caagtacaattacaagaaagcggaccaggattagtaaaaccaccagaaacactaagcttaacatgtagcgtaagcggagcatcagtaaatgacgcatactggagctggataagacaatcaccaggaaaaagaccagaatgggtaggatatgtacatcactcaggagatacaaattacaatccatcactaaaaagaagagtaacattctcactagatacagcaaaaaatgaagtaagcttaaaattagtcgcactaacagcagcagactcagcagtatacttttgcgcaagagcactacatggaaaaagaatatacggaatagtagcattaggagaactatttacatatttctatatggatgtatggggaaaaggaacaacagtaacagtaagctca

SEQ ID NO: 50327 - RNA, 396 nt, synthetic construct
  misc_feature 1..396: note = derived and/or modified sequence opt6 from anti-HIV_Chain
  source 1..396: mol_type = other RNA
caagtacaattacaagaaagcggaccaggattagtaaaaccaagcgaaacattatcattaacatgtagcgtaagtggagcatcaatatcagactcatactggagctggataagaagatcacccggaaaaggactagaatggataggatatgtacataaatcaggagatacaaattactcaccatcactaaaaagcagagtaaatctatcactagatacaagcaaaaatcaagtaagtttatcattagtagcagcaacagcagcagacagcggaaaatactattgcgcaagaacactacatggaagaagaatatacggaatagtagcatttaacgaatggtttacatatttctatatggatgtatggggaaatggaacacaagtaacagtaagctca

SEQ ID NO: 50328 - RNA, 396 nt, synthetic construct
  misc_feature 1..396: note = derived and/or modified sequence opt6 from anti-HIV_Chain
  source 1..396: mol_type = other RNA
caagtacacttacaagaaagcggaccaggattagtaaaaccaagcgaaacactatcactaacatgtaacgtaagcggaacattagtaagagacaattactggagctggatgagacaaccactaggaaaacaaccagaatggataggatatgtacatgactcaggagatacaaattacaatccatcactaaaaagcagagtacatctatcactagataaatcaaacaatctagtatcattaagattaacagcagtaacagcagcagactcagcaacatactattgcgcaaccacaaaacatggaagaagaatatacggaatagtagcatttaacgaatggtttacatatttctatatggatgtatggggaaaaggaacaacagtaacagtatcatca

SEQ ID NO: 50329 - RNA, 396 nt, synthetic construct
  misc_feature 1..396: note = derived and/or modified sequence opt6 from anti-HIV_Chain
  source 1..396: mol_type = other RNA
caagtacaattacaagaaagcggaccaggattagtaaaaccaagcgaaacattaagcgtaacatgtagcgtaagcggagactcaatgaataactattactggacatggataagacaatcaccaggaaaaggactagaatggataggatatatatcagacagagaatcagcaacatacaatccatcattaaatagcagagtagtaatatcaagagatacatcaacaaatcaattaagcctaaaattaaactcagtaacaccagcagacacagcagtatactattgcgcaacagcaagaagaggacaaagaatatacggagtagtatcatttggagaatttttctactattacagcatggatgtatggggaagaggaacaacagtaacagtaagctca

SEQ ID NO: 50330 - RNA, 396 nt, synthetic construct
  misc_feature 1..396: note = derived and/or modified sequence opt6 from anti-HIV_Chain
  source 1..396: mol_type = other RNA
caagtacaattagtagaaagcggaccaggattagtaacaccaagcgaaacattatcattaacatgtacagtaagtaatggatcagtatcaggaagattctggagctggataagacaatcaccaggaagaggactagaatggataggatatttctcagacacagacagaagcgaatactcaccatcactaagaagcagattaacattatcactagatgcatcaagaaatcaattaagcctaaaattaaaatcagtaacagcagcagactcagcaacatactattgcgcaagagcacaacaaggaaaaagaatatacggaatagttagctttggagaatttttctactattactatatggacgcatggggaaaaggaacagcagtaacagtaagttca

SEQ ID NO: 50331 - RNA, 396 nt, synthetic construct
  misc_feature 1..396: note = derived and/or modified sequence opt6 from anti-HIV_Chain
  source 1..396: mol_type = other RNA
caagtacaattacaagaaagcggaccaggactagtaaaaccaccagaaacattaagtctaacatgttcagtaagtggagcatcaataaatgacgcatactggagctggataagacaatcaccaggaaaaagaccagaatgggtaggatatgtacatcactcaggagatacaaattacaatccatcactaaaaagaagagtaacattctcattagatacagcaaaaaatgaagtaagcttaaaattagtagatctaacagcagcagactcagcagtatacttttgcgcaagagcactacatggaaaaagaatatacggaatagtagcattaggcgaactatttacatatttctatatggatgtatggggaaaaggaacaacagtaacagtatcatca

SEQ ID NO: 50332 - RNA, 396 nt, synthetic construct
  misc_feature 1..396: note = derived and/or modified sequence opt6 from anti-HIV_Chain
  source 1..396: mol_type = other RNA
caagtacaattacaagaaagcggacccggactagtaaaaccaccagaaacattatcattaacatgtagcgtaagcggagcatcaataaatgacgcatactggagctggataagacaatcaccaggaaaaagaccagaatgggtaggatatgtacatcactcaggagatacaaattacaatccatcactaaaaagaagagtatcattctcactagatacagcaaaaaatgaagtaagtctaaaattagtagatctaacagcagcagactcagcaatatacttttgcgcaagagcactacatggaaaaagaatatacggaatagtagcattaggagaactatttacatatttctatatggatgtatggggaaaaggaacaacagtaacagtaagctca

SEQ ID NO: 50333 - RNA, 396 nt, synthetic construct
  misc_feature 1..396: note = derived and/or modified sequence opt6 from anti-HIV_Chain
  source 1..396: mol_type = other RNA
caagtacaattacaagaaagcggacccggattagtaaaaccaagcgaaacattaagcgtaacatgtagcgtaagcggagactcaatgaataactcatactggacatggataagacaatcaccaggaaaaggactagaatggataggatatatatcaaaatcagaatcagcaaattacaatccctcactaaatagcagagtagtaatatcaagagatacaagcaaaaatcaactaagcctaaaattaaactcagtaacaccagcagacacagcagtatactattgcgcaacagcaagacatggacaaagaatatacggagtagtatcatttggagaatttttcacatattactcaatggatgtatggggaaaaggaacaacagtaacagtaagttca

SEQ ID NO: 50334 - RNA, 396 nt, synthetic construct
  misc_feature 1..396: note = derived and/or modified sequence opt6 from anti-HIV_Chain
  source 1..396: mol_type = other RNA
caagtacaactacaagaatcaggaccaggattagtaaaaccatcagaaacactatcactcacatgctcagtatcaaacggatcagtatcaggaagattctggtcatggataagacaatcaccaggaagaggactagaatggataggatacttcagcgacacagaaaaatcaaactacaacccatcactaagatcaagactaacactatcagtagacgcatcaaaaaaccaactatcactaaaactaaactcagtaacagcagcagactcagcaacatactactgcgcaagaacacaacaaggaaaaagaatatacggagtagtatcattcggagaattcttccactactactacatggacgcatggggaaaaggaacagcagtaacagtatcatca

SEQ ID NO: 50335 - RNA, 396 nt, synthetic construct
  misc_feature 1..396: note = derived and/or modified sequence opt6 from anti-HIV_Chain
  source 1..396: mol_type = other RNA
caagtacaattagtacaaagcggaacagcactaaaaagtccaggatcaagcgcaaaattaagctgtacagtactaggagacgaatttggaacatatttcataagctggataagacaagcaccaggacaaggactagaatgggtaggaggaatagtaccacatagccaactacaaagctcagcacaaaaattccacggaagaataataataagcgcaggagcaggagtaacaccaccagtagtatcactacaactaacaaacttaacatttgaagatacaggaacatatttctgtgcaagagaaagaggaagacacagagacccaaaaacaggagatgcattaagaggaagatatttcgatttctggggaagaggaacaggagtaagtgtaagtgca

SEQ ID NO: 50336 - RNA, 396 nt, synthetic construct
  misc_feature 1..396: note = derived and/or modified sequence opt6 from anti-HIV_Chain
  source 1..396: mol_type = other RNA
caagtacaattagtacaaagcggaacagcactaaaaagcccaggatcaagcgcaaaattaagctgtacagtactaggagacgaatttggaacatatttcataagctggataagacaagcaccaggacaaggactagaatgggtaggaggaatagtaccacatagccaactacaaagctcagcacaaaaattccacggaagaataataataagcgcaggagcaggagtaacaccaccagtagtatcactacaactaacaaacttaacatttgaagatacaggaacatatttctgtgcaagagaaagaggaagacacagagacccaaaaacaggaaaagccccaagaggaagatatttcgatttctggggaagaggaacaggagtaacagtaagcgca

SEQ ID NO: 50337 - RNA, 396 nt, synthetic construct
  misc_feature 1..396: note = derived and/or modified sequence opt6 from anti-HIV_Chain
  source 1..396: mol_type = other RNA
caagtacaattagtacaaagcggaacagcactaaaaagtccaggatcaagcgcaaaactaagttgtacagtactaggagacgaatttggaacatatttcataagttggataagacaagcaccaggacaaggactagaatgggtaggaggaatagtaccacatagccaactacaaagcagtgcacaaaaattccacggaagaataacaataagcgcaggagcaggagtaacaccaccagtagtatcactacaactaacaaacttaacatttgaagatacaggaacatatttctgtgcaagagaaagaggaagacacagagacccaaaaacaggagatgcattaagaggaagatatttcgatttctggggaagaggaacaggagtaagagtaagcaca

SEQ ID NO: 50338 - RNA, 396 nt, synthetic construct
  misc_feature 1..396: note = derived and/or modified sequence opt6 from anti-HIV_Chain
  source 1..396: mol_type = other RNA
caagtacaattagtacaaagtggagcagcagtaaaaagtccgggaagtagtgcaaaattaagttgtacagtattaggagatgaatttggaacatattttataagttggataagacaagcaccaggacaaggattagaatgggtaggaggaatagtaccacatagtcaattacaaagtagtgcacaaagatttcatggaagaataacaataagtgcaggagcaggagtaacaccaccagtagtaagtttacaattaacaaatttaacatttgatgatgcaggaacatatttttgtgcaagagaaagaggaagacatagagatccaaaaacaggagatgcattaagaggaagatattttgatttttggggaagaggaacaggaataagtgtaagccca

SEQ ID NO: 50339 - RNA, 396 nt, synthetic construct
  misc_feature 1..396: note = derived and/or modified sequence opt6 from anti-HIV_Chain
  source 1..396: mol_type = other RNA
gaagtacaattagtacaaagcggagcagaagtaaaaaaaccaggagcaagcgtaaaagtaagctgtaaagtaagcggatacacactaacagaattaagtatacactgggtaagacaagcaccaggaaaaggactagaatggatgggaggatttgatccagaagacgatgaagcaatatatgaaccaaaatttcaaggaagactaacaatgacagaagacacaagtacagacacagcatatatggaattatcaagtttaagatcagaagatacagcagtatattactgtgcaacagcagatccatttaaagtagcacaagatgaaggattatacgtaatatttgactattggggacaaggaacattagtaacagtatcaagtgcaagtacaaaagga

SEQ ID NO: 50340 - RNA, 396 nt, synthetic construct
  misc_feature 1..396: note = derived and/or modified sequence opt6 from anti-HIV_Chain
  source 1..396: mol_type = other RNA
gaagtacaattagtagaaagtggaggaggattattacaaccaggaggaagtttaagattaagttgtgcagcaagtggatttagttttaatgattttgaaatgaattgggtaagacaagcaccaggaaaaggattagaatgggtaagctatataagtaatgatggaacaatgatacattatgcagatagtgtaaaaggaagatttacaataagtagagataatgcaaaaaaaagtttatttttacaaatgaatagtttaagagcagaagatacagcagtatattattgtgcaagattagcagaagtaccaccagcaataagaggaagttattattatggaatggatgtatgggggcaaggaacaacagtaacagtagcaagtgcaagtacaaaagga

SEQ ID NO: 50341 - RNA, 396 nt, synthetic construct
  misc_feature 1..396: note = derived and/or modified sequence opt6 from anti-HIV_Chain
  source 1..396: mol_type = other RNA
caagtacaattaatgcaaagtggagcagaagtaaaaagaccaggagcaagtgtaaaagtaagttgtaaagcatttagacatagtctaaataatttaggaataagttggataagaagagcaccaggaagaggactagaatggttaggatggataaatgtatatgaaggaaatacaaaatatggaagaagatttcaaggaagagtaacaatgacaacagatagaagtacaaatacagtaagtatggaattaagaagtttaacaagtgatgatacagcagtatattattgtgcaagagataatcatttttggagtggaagtagtagatattattattttggaatggatgtatggggacaaggaacaacagtaatagtaagtagcgcaagtacaaaagga

SEQ ID NO: 50342 - RNA, 396 nt, synthetic construct
  misc_feature 1..396: note = derived and/or modified sequence opt6 from anti-HIV_Chain
  source 1..396: mol_type = other RNA
caagtacaattagtacaatggggagcaggattattaaaaccattagaaacattaagtttaacatgtgcagtatatggaggaagttttaatggatatttttggagttggataagacaaacaccaggaaaaggattagaatggataggagaaataaatcatggaggaagtgcaaattttaatccaagtttaaaaagtagagtaacaatgagtgtagatacaagtaaaaatcaatttagtttaaaattagcaagtgtaacagcagcagatacagcaatatattattgtgcaagaggaagaataacaatggtaagaggagatccacaaagaggaggagtaagaatggatgtatggggacaaggaacaagtgtaacagtaagtagtgcaagtacaaaagga

SEQ ID NO: 50343 - RNA, 396 nt, synthetic construct
  misc_feature 1..396: note = derived and/or modified sequence opt6 from anti-HIV_Chain
  source 1..396: mol_type = other RNA
ctagtacaattagtacaaagtggagcagaagtaaaaaaaccaggagcaagtgtaaaagtaagttgtaaagtaagcggacatacattaagtgaattaagtataaattgggtaagacatgtaccaggaaaaggattagaatggatgggaggattagatccagaagatggagaagcaatacatgaaccaaaatttcaaggaagattaacaatgacagaagatacaagtacagatacagcatatagtacattatcagtatgggcaccagtagcagcagcaatgtattattgtgcaacagcagatccatttaaagtagcacaagatgaaggattatatgtaatatttgattattggggacaaggaacattagtaacagtaagtagtgcaagtacaaaagga

SEQ ID NO: 50344 - RNA, 396 nt, synthetic construct
  misc_feature 1..396: note = derived and/or modified sequence opt6 from anti-HIV_Chain
  source 1..396: mol_type = other RNA
caagtacaattattacaaagcggaggagaagtaaaaaaaccaggagcaagcgtaaaagtaagctgtaaagtaagcggatacacactaacagaattaagcatacactgggtaagacaagcaccaggaaaaggactagaatggatgggaggattcgatccagaagacgatgaagcaatatatgaaccaaaattccaaggaagattaacaatgacagaagacacaagcacagacacagcatatatggaactatcaagcttaagatcagaagatacagcagtatattactgtgcaacagcagatccatttaaagtagcacaagacgaaggactatacgtaatatttgactattggggacaaggaacattagtaacagtctcaagcgcaagcacaaaagga

SEQ ID NO: 50345 - RNA, 396 nt, synthetic construct
  misc_feature 1..396: note = derived and/or modified sequence opt6 from anti-HIV_Chain
  source 1..396: mol_type = other RNA
caagtacaattagtacaaagcggagcagaagtaaaaaaaccaggagcaagcgtaaaagtaagctgcaaagtaagcggatacacactaacagaattaagtatacactgggtaagacaagcaccaggaaaaggactagaatggatgggaggatttgatagcgaagacggagaagcattctataaacaaaactttcaaggaagagtaacaatgacagaagacacaagtacagacacagcatatatggaactaagaagattaagatcagaagatacagcagtatattactgtgcaacagcagatagatttaaagtagcacaagacgaaggattattcgtaatatttgattattggggacaaggaacattagtaacagtatcaagcgcaagcacaaaagga

SEQ ID NO: 50346 - RNA, 396 nt, synthetic construct
  misc_feature 1..396: note = derived and/or modified sequence opt6 from anti-HIV_Chain
  source 1..396: mol_type = other RNA
caagtacatctagtacaatcaggagcagaagtaaaaaaaccaggagcatcagtaagagtatcatgcaaagcatcaggatatacatttacaacatacggaatatcatgggttagacaagcaccaggacaaggattagaatggatgggatggataagtgcacacagtggagatacaaattacgcacaaaaactacaagcaagagtaacaatgacaacagatacatcaacaaatacagcatacatggaattaagatcactaacaagcgatgacacagcagtatactattgcgcaagagatagaccaagacattactatgacagaggaggatactatagcccattcgattactggggacaaggaacactagtaacagtaagctcagcatcaacaaaagga

SEQ ID NO: 50347 - RNA, 396 nt, synthetic construct
  misc_feature 1..396: note = derived and/or modified sequence opt6 from anti-HIV_Chain
  source 1..396: mol_type = other RNA
ctagtacaattactacaaagcggagcagaagtaaaaaaaccaggcgcaagcgtaaaagtaagctgtaaagtaagtggatacacactaacagaattaagtatacactgggtaagacaagcaccaggaaaaggattagaatggatgggaggatttgatccagaagacgatgaagcaatatatgaaccaaaatttcaaggaagattaacaatgacagaagacacaagcacagacacagcatatatggaactatcaagcttacgatcagaagatacagcagtatattactgtgcaacagcagatccatttaaagtagcacaagacgaaggattatacgtaatatttgactattggggacaaggaacattagtaacagtatcaagcgcaagcacaaaagga

SEQ ID NO: 50348 - RNA, 396 nt, synthetic construct
  misc_feature 1..396: note = derived and/or modified sequence opt6 from anti-HIV_Chain
  source 1..396: mol_type = other RNA
caagtacaattagtacaaagtggagcagaagtaaaaaaaccaggagcaagtgtgaaagtaagttgtaaagtaagcggacatacattaagtgaattaagtataaattgggtaagacatgtaccaggaaaaggattagaatggatgggaggattagatccagaagacggagaagcaatacatgaaccaaaatttcaaggaagattaacaatgacagaagatacaagtacagatacagcatatgtagaattaagtagtttaagaagtgaagatacagcaatgtattattgtgcaacagcagatccatttaaagtagcacaagatgaaggattatatgtaatatttgattattggggacaaggaacattagtaacagtaagtagtgcaagtacaaaagga

SEQ ID NO: 50349 - RNA, 396 nt, synthetic construct
  misc_feature 1..396: note = derived and/or modified sequence opt6 from anti-HIV_Chain
  source 1..396: mol_type = other RNA
caagtacaattactacaaagcggagcagaagtaaaaaaaccaggagcaagcgtaaaagtaagctgtaaagtaagcggatacacactaacagaattaagcataaactgggtaagacaagcaccaggaaaaggactagaatggatgggaggattcgatccagaagacgatgaagcaatatatgaaccaaaatttcaaggaagattaacaatgacagaagacacaagcacagacacagcatatatggaactaagtagcttaagatcagaagatacagcagtatattactgtgcaacagcagatccatttaaagtagcacaagacgaaggattatacgtaatatttgactattggggacaaggaacattagtaacagtatcaagcgcaagcacaaaagga

SEQ ID NO: 50350 - RNA, 396 nt, synthetic construct
  misc_feature 1..396: note = derived and/or modified sequence opt6 from anti-HIV_Chain
  source 1..396: mol_type = other RNA
caaccacaattagtacaatcaggatcaggagcagaagtaaaaaaaccaggagcatcagtaagaatatcatgtgaagcatcagaatataatgtatttgatcattttatgcaatgggtaagacaagcaccaggacaaggattagaatggatgggatggataaatccaagaggaggatatccatcatatagtccaacatttcaaggaagattaacatttacaagacaaccaagttgggatgattcaacaataacatttcatatggaattaagaggattaggacatgatgatacagcagtatattattgtgcaagaccacatagtccagatgatgcatggtcattagatgtatggggaagaggaacattagtaacagtaagttcagcatcaacaaaagga

SEQ ID NO: 50351 - RNA, 396 nt, synthetic construct
  misc_feature 1..396: note = derived and/or modified sequence opt6 from anti-HIV_Chain
  source 1..396: mol_type = other RNA
caaccacaattagtacaaagtggaagtggagcagaagtaaaaaaaccaggagcaagtgtaagaataagttgtgaagcaagtgaatataatgtatttgatcattttatgcaatgggtaagacaagcaccaggacaaggattagaatggatgggatggataaatccaagaggaggatatccaagttatagcccaagatttcaaggaagattaacatttacaagacaaccaagttgggatgatagtagtgtaacatttcatatggaattaagaggattaagacatgatgatacagcagtatattattgtgcaagaccacatagtccagatgatgcatggagcttagatgtatggggaagaggaacattagtaacagtatcaagtgcaagtacaaaagga

SEQ ID NO: 50352 - RNA, 396 nt, synthetic construct
  misc_feature 1..396: note = derived and/or modified sequence opt6 from anti-HIV_Chain
  source 1..396: mol_type = other RNA
gaagtacaattagtagaaagtggaggaggagtagtagaaccaggagaaagtttaagattaagttgtgcagcaagtggatttacatttagaagttatgatatgttttgggtaagacaagcgacaggaaaatcattagaatgggtaagtgcaataggaatagcaggagatacatattattcaggatcagtaaaaggaagatttacaataagtagagaaaatgcaagaacaagtttatatttacaattaagtggattaagagtagaagattcagcagtatatttttgtgtaagaggaagtccaccaagaatagcagcaacagaatataattattattatggattggatgtatggggacaaggaacaacagtatcagtatttagtgcaagtacaaaagga

SEQ ID NO: 50353 - RNA, 396 nt, synthetic construct
  misc_feature 1..396: note = derived and/or modified sequence opt6 from anti-HIV_Chain
  source 1..396: mol_type = other RNA
caagtacaattagtacaaagtggagcagaagtaaaaaaaccaggaagtagtgtaaaagtaagttgtaaagcaagtggaggaacatttacaacatatgatataagttgggtaagacaagcaccaggacaaggattagaatggatgggaggaatattaccagatttcggagcaccaagttatgcacaaaaatttcaagatagagtaacaataacaacagatgaaagcagtagtacagcatatatggaattaaatagtctaagaagtgaagatacagcaatatattactgtgcaagaggaagaggagatgatttttggagtggagaaagcccaagttggtattttgattattggggacaaggaacattagtaacagtaagtagtgcaagtacaaaagga

SEQ ID NO: 50354 - RNA, 396 nt, synthetic construct
  misc_feature 1..396: note = derived and/or modified sequence opt6 from anti-HIV_Chain
  source 1..396: mol_type = other RNA
caaccacaattagtacaatcaggatcaggagcagaagtaaaaaaaccaggagcatcagtaagaatatcatgtgaagcatcagaatataatgtatttgatcattttatgcaatgggtaagacaagcaccaatggaaggattagaatggatgggatggataaatccaagaggaggatatccatcatattcaccaacatttcaaggaagattaacatttacaagacaaccatcatgggatgattcaacaataacatttcatatggaattaagaggattaagacatgatgatacagcagtatattattgtgcaagaccacattcaccagatgatgcatggtcattagatgtatggggaagaggaacattagtaacagtaagttcagcatcaacaaaagga

SEQ ID NO: 50355 - RNA, 396 nt, synthetic construct
  misc_feature 1..396: note = derived and/or modified sequence opt6 from anti-HIV_Chain
  source 1..396: mol_type = other RNA
gaagtaagattactagaaagcggaggaggattagtacaaccaggaggaagtttaagattaagttgtagtgcaagtggattcacattttcaaattcagcattaagttgggtaagacaagcaccaggaaaaggactagaatgggtaagttcagtagtaagctcaggaggagacacattttatgcagatagtgtaaaaggaagatttacaataagtagagacaatagtagaaatacattatatttacaaatgaaaagtttaagagcagaagatacagcattatattactgtgcaaaagtacaaatacaacaattaaattttggagtaataacagacgcaggaatggacgtatggggaaaaggaacaacagtaatagtatcaagtgcaagcacaaaagga

SEQ ID NO: 50356 - RNA, 396 nt, synthetic construct
  misc_feature 1..396: note = derived and/or modified sequence opt6 from anti-HIV_Chain
  source 1..396: mol_type = other RNA
caagtacaattagtagaaagtggaggaggagtagtacaaccaggaagaagtttaagattaagctgtgtaggaagtggatttacatttagtagttcaggaatgcattgggtaagacaagcaccaggaaaaggattagaatgggtagcagtaataagtagcgatggatcagatgaatattatggagatagtgtagaaggaagatttacaataagcagagataatagtaaaaatacattatttttacaattagatagtttagaagcagaagatagtgcagtatattattgtgcaaaaacaccaccacattatgatgcattaacaggatatccaagtagtgtattagaattttggggattaggaacattagtaacagtaagtagtgcaagtacaaaagga

SEQ ID NO: 50357 - RNA, 396 nt, synthetic construct
  misc_feature 1..396: note = derived and/or modified sequence opt6 from anti-HIV_Chain
  source 1..396: mol_type = other RNA
gaagtacaattagtacaaagtggagcagaagtaaaaaaaccaggaagtagtgtaaaagtaagttgtaaagcaagcggaggaacatttacaacatatgatataagttgggtaagacaagcaccaggacaaggattagaatggataggaggaatattaccagattttggagcaccaagttatgcacaaaaatttcaagatagagtaacaataacaacagatgaaagtagtagaacagcatatatggaattaaatagtttaagaagtgaagatacagcaatatattattgtgcaagaggaagaggagatgatttttggtcaggagaaagtccaagttggtattttgattattggggacaaggaacacaagtaacagtaagtagtgcaagtacaaaagga

SEQ ID NO: 50358 - RNA, 396 nt, synthetic construct
  misc_feature 1..396: note = derived and/or modified sequence opt6 from anti-HIV_Chain
  source 1..396: mol_type = other RNA
caagtacaattactacaaagcggaacagaagtaaaaaaaccaggatcaagtgtaaaagtaagctgtagagcaagcggatggacactaggaaactcgccaaatagcgcaataggatgggtaagacaagcaccaggacaaggattagaatggataggaagaataataccaatattagacgtaacaaattacgcacaaaaattccaaggaagagtaacaatatcagcagataaatcaacaaatatagcatacatggaaataagctcattaggaagtgaagacacagcattttactattgcgcaagagtaataacaggaatgacatcaccatggtacttttacatggacgtatggggagaaggaacaacagtaatagtatcaagcgcaagtacaaaagga

SEQ ID NO: 50359 - RNA, 396 nt, synthetic construct
  misc_feature 1..396: note = derived and/or modified sequence opt6 from anti-HIV_Chain
  source 1..396: mol_type = other RNA
caagtacacttagtacaaagcggagcagaagtaaaaaaaccaggatcaagtgtaagagtaagctgtaaagcaagcggatggacgttcggagattcagtaaatagcgcaataacatgggtaagacaagcaccaggacaaggattagaatggatgggaagatttataccaatattaggattaagcaattacgcacaaaaattccaagacagagtaacaataaatgtagatagatcaacaaatacagcatacatggaattaagcggactaagaagtgaagacacagcagtatactattgcgcaagattaataacaggaatgaatgcaccatggttctattacatggacgtatggggaaaaggaacaacaataacagtatcaagcgcaagcacaaaagga

SEQ ID NO: 50360 - RNA, 396 nt, synthetic construct
  misc_feature 1..396: note = derived and/or modified sequence opt6 from anti-HIV_Chain
  source 1..396: mol_type = other RNA
caagtacatttagtacaaagcggagcagaagctaaaagaccaggaagtagtgtaagagtaagttgtagagcaagtggaggagatttttcaagttatacattaagctgggtaagacaagcaccaggacaaggattagaaagaatgggaggagtagtaccaatgttagatacagtacattatgcacaaaaatttcaaggaagattaacattaagtgtagatgaaggaacaagcacagcatatatggaattatcaagtttaagatcagaagatacagcaatgtattactgtacaagaggaagacaaacattcagagcaatatggtcaggaccaccagtagtatttgatatatggggacaaggaacattagtatcagtatcaagtgcaagtacaaaagga

SEQ ID NO: 50361 - RNA, 396 nt, synthetic construct
  misc_feature 1..396: note = derived and/or modified sequence opt6 from anti-HIV_Chain
  source 1..396: mol_type = other RNA
caagtacatttagtacaaagtggagcagaagcaaaaagaccaggaagtagtgtaagagtaagttgtagagcaagtggaggagattttagtagttatacattaagttgggtaagacaagcaccaggacaaggaatagaatggatgggaggagtagtaccaatgttagatacagtacattatgcacaaaaatttcaaggaagattaacattaagtgtagatgaagggacaagtacagcatatatggaattaagtagtttaagaagtgaagatacagcaatgtattattgtacaagaggaagacaaacatttagagcaatatggagtggaccaccagcagtatttgatatatggggacaaggaacattagtaatagtaagtagtgcaagtacaaaagga

SEQ ID NO: 50362 - RNA, 396 nt, synthetic construct
  misc_feature 1..396: note = derived and/or modified sequence opt6 from anti-HIV_Chain
  source 1..396: mol_type = other RNA
caagtacaattagtacaaagcggagcagaactaaaaaaaccaggatcaagcgtaaaagtaagctgtaaagcaagcggaggaacattcaataaccatacatttaactgggtaagacaagcaccaggacaaggactagaatggatgggaagaacaataccaatactaggaagtagagactatgcaaaaacattccaagatagagtaacaataatagcagacaaaagcacaagtacagtatatctagaattaagaagattaaaatcagaagatacaggagtatattactgtgcaacaagcatgtactatttcgatagcggaggatattacagaaacacagacttagacaaatggggacaaggaagcttagtaacagtatcaagcgcaagcacaaaagga

SEQ ID NO: 50363 - RNA, 396 nt, synthetic construct
  misc_feature 1..396: note = derived and/or modified sequence opt6 from anti-HIV_Chain
  source 1..396: mol_type = other RNA
caagtatacttagtacaaagcggaccagaattaaaaaaaccaggagcaagcgtaaaaataagctgtaaagcaagcggatacaatttcccaaaatatgcaatacactgggtaagacaagcaccaggacaaggactacaatggatgggatggataaatggagataacggagacgcaagatatagccaaaaattacaaggaagagtaacaccgagcacagacacaagcgcaagcgtagtatatatggaactaaaaagattaagatcagaagatacagcagtatattactgtgcaagagcattatacccatgggaaataggaggagtaccatcaacaatgggagatgactattggggacaaggaacattaataacagtatcaagcgcaagcacaaaagga

SEQ ID NO: 50364 - RNA, 396 nt, synthetic construct
  misc_feature 1..396: note = derived and/or modified sequence opt6 from anti-HIV_Chain
  source 1..396: mol_type = other RNA
caagtacaattagtacaatcaggacctgaattaatgaaaccaggatcatcagtaaaagtatcatgcagagcaagcggagataattttctaacatcaacatttaattggttaagacaagcaccaggacaaagattagaatggatgggaagatttataccatcattaggattaataacatcagcaccaaaattttcagacagactaacaataactgcagatcaagcaacattaacagcatatatggaattaacaggattaacaagtgaagacactgcattatattattgtgcaagaggattatgtagaggaggaaattgtagactaggaccatcaggatggctagatccatggggaagaggaacacaagtaacagtatcaagtgcatcaacaaaagga

SEQ ID NO: 50365 - RNA, 396 nt, synthetic construct
  misc_feature 1..396: note = derived and/or modified sequence opt6 from anti-HIV_Chain
  source 1..396: mol_type = other RNA
ggagtacactttcaaggacacttagtacaaagcggaggaggagtaaaaaaaccaggatcaagtgtaacaataagctgtctagcaagtgaatacacatttacagaatttacaatacactggataagacaagcaccaggacaaggaccattatggttaggattaataaaaagatcaggaagactaatgacatcatacagattccaagacagactatcattaagaagagatagatcaacaggaacagtattcatggaattaagaggattaagaatagatgacacagcagtatactattgcgcaagagatggattaggagaagtagcaccagcatacctatacggaatagatgtatggggacaaggatcaacagtaatagtaacatcagcatcaacatca

SEQ ID NO: 50366 - RNA, 396 nt, synthetic construct
  misc_feature 1..396: note = derived and/or modified sequence opt6 from anti-HIV_Chain
  source 1..396: mol_type = other RNA
caagtacaattactacaaagcggagcagaagtaaaaaaaccaggagcaagcgtaaaagtaagctgtaaagtaagcggatacacactaacagaattaagtatacactgggtaagacaagcaccaggaaaaggactagaatggatgggaggattcgatccagaagacgatgaagcaatatatgaaccaaaatttcaaggaagattaacaatgacagaagacacaagcacagacacagcatatatggaattatcaagcttaagatcagaagatacagcagtatattactgtgcaacagcagatccatttaaagtagcacaagacgaaggattatacgtaatatttgactattggggacaaggaacattagtaacagtatcaagcgcaagcacaaaagga

SEQ ID NO: 50367 - RNA, 396 nt, synthetic construct
  misc_feature 1..396: note = derived and/or modified sequence opt6 from anti-HIV_Chain
  source 1..396: mol_type = other RNA
caagtacaattagtacaaagcggagcagaagtaaaaaaaccaggagcaagtgtaaaagtaagttgtaaagtaagtggatatacattaacagaattaagtatacattgggtaagacaagcaccaggaaaaggactagaatggatgggaggatttgatccagaagacggagaagcaagttttgaaccaaaatttcaaggaagattaacaatgacagaagacacaagtacagatacagcatatatggaattatcaagtttaagatcagaagatacagcagtatattactgtgcaacagcagatccatttaaagtagcacaagatgaaggattatatgtaatatttgattattggggacaaggaacattagtaacagtatcaagtgcaagtacaaaagga

SEQ ID NO: 50368 - RNA, 396 nt, synthetic construct
  misc_feature 1..396: note = derived and/or modified sequence opt6 from anti-HIV_Chain
  source 1..396: mol_type = other RNA
ggagtacactttcaaggacacttagtacaaagcggaggaggagtaaaaaaaccaggatcaagtgtaacaataagttgtttagcaagcgaatacacattcacagaatttacaatacactggataagacaagcaccaggacaaggaccattatggctaggattaataaaaagatcaggaagactaatgacatcatacagattccaagatagattatcactaagaagagatagatcaacaggaacagtattcatggaattaagaggattaagaatagatgacacagcagtatattattgcgcaagagatggattaggagaagtagcaccagcatacttatacggaatagatgtatggggacaaggaacaacagtaatagtaacatcagcatcaacatca

SEQ ID NO: 50369 - RNA, 396 nt, synthetic construct
  misc_feature 1..396: note = derived and/or modified sequence opt6 from anti-HIV_Chain
  source 1..396: mol_type = other RNA
caagtacaattaggagaaagtggaggaggattagtagaaccaggaggaagtttaagattaagttgtgcagcaagtggatttttgttttcagattatcaaatgagttggataagattagcaccaggaaaaggattagaatggataagttttatatcaggatttggatcagtatattatgcagattcagtagaaggaagatttacaatatcaagagataatgcaagaaatagtttatatttacaaatgaataatttaagagcagaagatacagcagtatattattgtgcaagagcatatggaacaggaaattggagaggattatattattattattatggaatggatgtatggggacatggaacaacagtaacagtatcaagtgcaagtacaaaagga

SEQ ID NO: 50370 - RNA, 399 nt, synthetic construct
  misc_feature 1..399: note = derived and/or modified sequence opt6 from anti-HIV_Chain
  source 1..399: mol_type = other RNA
caagtacaattagtacaaagtggaacagcattaaaaagcccaggatcaagcgcaaaactatcatgtacagtactaggagacgaatttggaacatatttcataagctggataagacaagcaccaggacaaggactagaatgggtaggaggaatagtaccacatagccaactacaatcatcagcacaaaaattccacggaagaataataataagtgcaggagcaggagtaacaccaccagtagtatcactacaactaacaaacttaacatttgaagatacaggaacatatttctgtgcaagagaaagaggaagacacagagacccaaaaacaggagatgcattaagaggaagatatttcgatttctggggaagaggaacaggattaagagtatcaacaagc

SEQ ID NO: 50371 - RNA, 399 nt, synthetic construct
  misc_feature 1..399: note = derived and/or modified sequence opt6 from anti-HIV_Chain
  source 1..399: mol_type = other RNA
gaagtacaattagtacaaagtggaggaggattagtaaaaccaggaggaagtttaagattaagttgtgcagcaagtggatttacatttaaaaatgcatggatgagttgggtaagacaagcaccaggaaaaggattagaatgggtaggacatataaaaagtaaaacagatggaggaacaatagattatgcagcaccagtaaaaggaagatttacaataagcagagatgatagcaaaaatacactatatttacaaatgaatagtttaaaaatagaagatacagcagtatattattgtacaacagatataggaagtggaagaggatgggattttcattattatgatagtaatgattggggacaagggacattagtaacagtaagcagtgcaagtacaaaagga

SEQ ID NO: 50372 - RNA, 399 nt, synthetic construct
  misc_feature 1..399: note = derived and/or modified sequence opt6 from anti-HIV_Chain
  source 1..399: mol_type = other RNA
caagtacaattagtagaaagtggaggaggagtagtacaaccaggaagaagtttaagattattttgtgcagcaagtggatttgcatttaatacatatggaatgcattgggtaagacaagcaccaggaaaaggactagaatgggtagcagtaacatggcacgatggatcacaaaaatattatgcagatagtgtaaaaggaagatttacaataagtagagataatagtaaaaatacgttatatttacaaatgaatagcttaagagcagaagatacagcaatatattattgtgcaagtgatcaaggaggatttgatgatagtagtggatattttgcaccaggaggaatggatgtatggggaagaggaacaacagtaatagtaagtagtgcaccaacaaaagga

SEQ ID NO: 50373 - RNA, 399 nt, synthetic construct
  misc_feature 1..399: note = derived and/or modified sequence opt6 from anti-HIV_Chain
  source 1..399: mol_type = other RNA
ggatactcagaagtacaattagtacaaagtggaccaggattagtaaaaccaagccaaacactatcattaacatgtacagtaagtggaggatcaatatcaaacggaggacattactggaactggataagacaacatccaggaaaaggactagaatggataggacatatatataatatagcaacaacatattacaatccatcactaaaaagtagagtatcaatatcagtagatacaagcaaaaatcaatttagtttaaaattaagctcagtaacagcagcagacacagcagtatactattgcgcaagaggaagcggaagatggacaataggagcaagaatatactttgacaattggggacaaggagcattagtagcagtatcaagcgcaagcacaaaagga

SEQ ID NO: 50374 - RNA, 399 nt, synthetic construct
  misc_feature 1..399: note = derived and/or modified sequence opt6 from anti-HIV_Chain
  source 1..399: mol_type = other RNA
caattacaattaaaagaaagcggaccaggaatggtaaaaccaagcgaaacattatcattaacatgtagcgtaagcggagcatcagtagtaagcgcaaacgattactggggatggataagacaagcaccaggaaaaggactagaatgcataggaataatattatacacaggatcaacattttacaatccatcgctacaaagcagagtaacaatatcaagagatccaagcaaaaatcacgtatcattaacattaacaagcgtaacagcagcagactcagcagtatactattgcgcaagaataccatatcactcagaatcatactataacgtagtaataggaggattcgatgtatggggacaaggaacaagagtaacagtaagctcagcatcaacaaaagga

SEQ ID NO: 50375 - RNA, 399 nt, synthetic construct
  misc_feature 1..399: note = derived and/or modified sequence opt6 from anti-HIV_Chain
  source 1..399: mol_type = other RNA
tgtcaagtacaattagtagaaagtggaggaggagtagtacaaccaggaagaagtttaagattaagttgtgtaggaagtggatttacatttagtagtagtggaatgcattgggtaagacaagcaccaggaaaaggattagaatgggtagcagtaataagtagtgatggatcagatgaatattatggagatagtgtagaaggaagatttacaataagtagagataatagtaaaaatacattatttttacaattagatagtttagaagcagaagatagtgcagtatattattgtgcaaaaacaccaccacattatgatgcattaacaggatatccaagtagtgtattagaattttggggattaggaacattagtaacagtaagtagtgcaagtacaaaagga

SEQ ID NO: 50376 - RNA, 399 nt, synthetic construct
  misc_feature 1..399: note = derived and/or modified sequence opt6 from anti-HIV_Chain
  source 1..399: mol_type = other RNA
caagtacaattagtacaaagtggagcagatgtaaaaaaaccaggagcaagtgtaaaagtaagttgtaaagtaagtggatatacagtaagtgaattaagtatacattgggtaagacaagcaccaggaaaaggattagaatggatgggaggatttgatccagaagatggaaaaacagtaagtgcacaaaattttcaaggaagagtaacaatgacagaagataaaagtacaggaacagcaaatatggaattaagaagtttaaggagtgaagatacagcagtatattattgtgcaacaacagtacaattaatagtagatttttgtaatggaggaccatgttataattttgatgattggggacaaggaacattagtaacagtaagcagtgcaagtacaaaagga

SEQ ID NO: 50377 - RNA, 399 nt, synthetic construct
  misc_feature 1..399: note = derived and/or modified sequence opt6 from anti-HIV_Chain
  source 1..399: mol_type = other RNA
ggattagatttagaacatgatggacatcataaagaagaaccaagagcaagtgtaacagtaagttgtgaagcaagcggatataattttgtaaattatataatacattgggtaagattaacaccaggaagaggatttgaatggatgggaatgatagatccaagaagaggaagaccatggagtgcacaaaaatttcaaggaagattaacattaacaagagatatagatagtgaaagattatatatgcaattaagtggattaagaggagatgatacagcagtatatttttgtgcaagacaagaaccagattttcatgatggacatggacatacattaagaggaatgtttgatagctggggacaaggaagtccagtaagtgtaagtagtgcaagtacaaaagga

SEQ ID NO: 50378 - RNA, 399 nt, synthetic construct
  misc_feature 1..399: note = derived and/or modified sequence opt6 from anti-HIV_Chain
  source 1..399: mol_type = other RNA
caagtaagattagtacaaagtggagcacaattaaaaaaaccaggagcaagtgtaacagtaagttgtgaagcaagtggatataattttgtaaattatataataaattgggtaagacaaacaccaggaagaagttttgaatgggtaggaatgatagatccaagaagaggaagaccatggagtgcacaaaaatttcaaggaagattaacattaacaagagatatagatagtgaaaaattatatatgcatttaagtggattaagaggagatgatacagcagtatattattgtgcaagacaagatagtgattttcatgatggacatggacatacattaagaggaatgtttgatagttggggacaaggaagtccagtaacagtatcaagtgcaagcacaaaagga

SEQ ID NO: 50379 - RNA, 399 nt, synthetic construct
  misc_feature 1..399: note = derived and/or modified sequence opt6 from anti-HIV_Chain
  source 1..399: mol_type = other RNA
caagtaagattaagtcaaagtggagcagcagtagtaaaaacaggagcaagtgtaacaataagttgtgaaacagaaggatatacatttgtaaattatataatacattgggtaagacaaccaccaggaagaggatttgaatggttaggaatgatagatccaagaaatggacatccatggtttggacaaagatttagaggaagattaagtttaagaagagatagaagtacagaaacagtatttatgacattaagtggattaacaagtgatgataatggaatatacttttgtgcaagaaatgaaccacaatattatgatggaagtggacatagtttaccaggaatgtttgattattggggacaaggtacaagagtagtagtaagcagtgcaagtacaaaagga

SEQ ID NO: 50380 - RNA, 399 nt, synthetic construct
  misc_feature 1..399: note = derived and/or modified sequence opt6 from anti-HIV_Chain
  source 1..399: mol_type = other RNA
caagtaagattatcacaaagcggagcagcagtaatgaaaacaggagcatcagtaacaataagttgtgaaacagaaggatataattttgtaaattatataatacattgggtaagaagaccaccaggaagaggatttgaatggttaggaatgatagatccaaaaaatggacatccatggtttgcacaagcagtaagaggaagattaagtttaagaagagatacatttaatgaagtagtatatatgacattaagtggactaacaagtgatgatacaggattatatttttgtgcaagaaatgaaccacaatatcatgatggaaatggacatagtttaccaggaatgtttgatttttggggacaaggaacattagtaacagtaagtagtgcaagtacaaaagga

SEQ ID NO: 50381 - RNA, 399 nt, synthetic construct
  misc_feature 1..399: note = derived and/or modified sequence opt6 from anti-HIV_Chain
  source 1..399: mol_type = other RNA
caagtaagattaagtcaaagcggagcagcagtagtaaaaacaggagcaagtgtaacaataagttgtgaaacagaaggatatacatttgtaaattatataatacattgggtaagacaaccaccaggaagaggatttgaatggttaggaatgatagatccaagaaatggacatccatggtttggacaaagattacaaggaagattaagtttaagaagagatagaagtacagaaacagtatttatgacattaagtggattaacaagtgatgatacaggaatatatttttgtgcaagaaatgaaccacaatattatgatggaagtggacatagtttaccaggaatgtttgattattggggacaaggaacaagagtagtagtaagtagtgcaagtacaaaagga

SEQ ID NO: 50382 - RNA, 399 nt, synthetic construct
  misc_feature 1..399: note = derived and/or modified sequence opt6 from anti-HIV_Chain
  source 1..399: mol_type = other RNA
caagtaagattaagccaaagcggagcagcagtagtaaaaacaggagcaagtgtaacaataagttgtgaaacagaaggatatacatttgtaaatcatataatacattgggtaagacaaccaccaggaagaggatttgaatggttaggaatgatagatccaagaaatggacatccatggtttggacaaagattaagaggaagactaagtctaagaagagatagaagtacagaaacagtatttatgacattaagtggattaacaagtgatgatataggaatatatttttgcgcaagaaatgaaccacaatattttgatggaagtggacattcattaccaggaatgtttgattattggggacaaggaacaagagtagtagtaagtagtgcaagtacaaaagga

SEQ ID NO: 50383 - RNA, 399 nt, synthetic construct
  misc_feature 1..399: note = derived and/or modified sequence opt6 from anti-HIV_Chain
  source 1..399: mol_type = other RNA
caagtacaatttttccaatcaggaagctcaatgaaaaaatcaggagcaagtgtaacaataagctgtgaagcaacaggatacaatataaaaaaccatatattacactgggtaagacaaaaaccaggaagaggattcgaatgggtaggaatgatagatccaataaacggaagaccatggtttggacaagcatttagaggaagattaacattaacaagagacttaagcacagaaacattctatatgtcactatcaggattaacatcagacgatacagcaacatatttctgtgcaagaagagaagcagattaccatgacggaaacggacacacactaccaggaatgttcgatttctggggaccaggaacactagtaacagtaagttcagcatcaacaaaagga

SEQ ID NO: 50384 - RNA, 399 nt, synthetic construct
  misc_feature 1..399: note = derived and/or modified sequence opt6 from anti-HIV_Chain
  source 1..399: mol_type = other RNA
caagtaagattaagtcaaagcggagcagcagtagtaaaaacaggagcaagtgtaacaataagttgtgaaacagaaggatatacatttgtaaattatataatacattgggtaagacaatcaccaggacgaggatttgaatggttaggaatgatagatccaagaaatggacatccatggtttggacaaagattaagaggaagattaagtttaagaagagatagaagtacagaaacagtatttatgacattatcaggattaacatcagatgatacagcaatatatttttgtgcaagaaatgaaccacaatattatgatggaagtggacattcattaccaggaatgtttgattattggggacaaggaacaagagtagtagtaagttcagcatcaacaaaagga

SEQ ID NO: 50385 - RNA, 399 nt, synthetic construct
  misc_feature 1..399: note = derived and/or modified sequence opt6 from anti-HIV_Chain
  source 1..399: mol_type = other RNA
caagtaagattaagtcaaagtggagcagcaatgaaaaaaccaggagcaagtgtaacaataagttgtgaaacagaaggatatacatttataaattatataatacattgggtaagacaaccaccaggaagaggatttgaatggttaggaatgatagatccaagaaatggaagaccatggtttggacaaagcgtacaaggaagattaagtttaagaagagatacatatacagaagtagtatatatgacattatcaggattaacatcagatgatgcaggattatatttttgtgcaagaaatgaaccacaatatcatgatggaaatggacattcattaccaggaatgtttgattattggggacaaggaacattagtagcagtaagttcagcatcaacaaaagga

SEQ ID NO: 50386 - RNA, 399 nt, synthetic construct
  misc_feature 1..399: note = derived and/or modified sequence opt6 from anti-HIV_Chain
  source 1..399: mol_type = other RNA
caagtaagattagtacaaagtggagcacaattaaaaaaaccaggagcaagtgtaacagtaagttgtgaagcaagtggatataattttgtaaattatataataaattgggtaagacaaacaccaggaagaggatttgaatgggtaggaatgatagatccaagaagaggaagaccatggagtgcacaaaaatttcaaggaagattaacattaacaagagatatagattcagaaaaattatatatgcatttaagtggattaagaggagatgatacagcagtatattattgtgcaagacaagatagtgattttcatgatggacatggacatacattaagaggaatgtttgatagttggggacaaggaagtccagtaacagtaagtagtgcaagtacaaaagga

SEQ ID NO: 50387 - RNA, 399 nt, synthetic construct
  misc_feature 1..399: note = derived and/or modified sequence opt6 from anti-HIV_Chain
  source 1..399: mol_type = other RNA
caagtacacacattccaaagcggaagctcaatgaaaaaatcaggagcaagcgtaacaatatcatgtgaagcaacaggatacaatataaaaaactatatattacactgggtaagacaaaaaccaggaagaggattcgaatgggtaggaatgatagatccaataaacggaagaccatggtttggacaaccatttagaggaagattaacactaacaagagacttaagtacagaaacattctatatgtcactatcaggattaacatcagacgatacagcaacatatttctgtgcaagaagagaagcagattaccatgacggaaacggacacacattaccaggaatgttcgatttctggggaccaggaacactaataacagtaagctcagcatcaacaaaagga

SEQ ID NO: 50388 - RNA, 399 nt, synthetic construct
  misc_feature 1..399: note = derived and/or modified sequence opt6 from anti-HIV_Chain
  source 1..399: mol_type = other RNA
caagtaagattatttcaaagtggagcagcaatgaaaaaaccaggagcaagtgtaacaataagttgtgaagcaagtggatataattttatgaattattttgtacattgggtaagacaaagaccaggaagaggatttgaatggttaggaatgataaatccaagaggaggaagaccatggagcgcacaaagtgtacaaggaagattaacattaacaagagatataagtacagaaatgttttatatgagattagatggattaagaagtgatgatacagcaacatatttttgtgcaagaaatgaagcagattatcatgatggaaatggacatagtttaagaggaatgtttgattattggggacaaggaagtttaataacagtaagtagtgcaagtacaaaagga

SEQ ID NO: 50389 - RNA, 399 nt, synthetic construct
  misc_feature 1..399: note = derived and/or modified sequence opt6 from anti-HIV_Chain
  source 1..399: mol_type = other RNA
caagtacaattatttcaaagtggagcagcaatgagaaaaccaggagcaagcgtaacaataagttgtgaagcaagtggatataattttatgaattattttgtacattgggtaagacaaagaccaggaagaggatttgaatggttaggaatgataaatccaagaggaggaagaccatggagtgcacaaagtgtacaaggaagattaacattaacaagagatacaagtacagaaatgttttatatgagattagatggattaagaagtgatgatacagcaacatatttttgtgcaagaaatgaagcagattatcatgatggaaatggacatagtctaagaggaatgtttgattattggggacaaggaagtttaataacagtaagtagtgcatcaacaaaagga

SEQ ID NO: 50390 - RNA, 399 nt, synthetic construct
  misc_feature 1..399: note = derived and/or modified sequence opt6 from anti-HIV_Chain
  source 1..399: mol_type = other RNA
caagtaagattaagtcaaagtggagcagcaataaaaaaaccaggagcaagcgtaacaataagttgtgaaacagaaggatatacatttataaattatataatacattgggtaagacaaccaccaggaagaggatttgaatggttaggaatgatagatccaagaaatggaagaccatggtttggacaaagtgtacaaggaagattaagcttaagaagagatacatatacagaagtagtatatatgacattatcaggattaacatcagatgatacaggattatatttttgtgcaagaaatgaaccacaatatcatgatggaaatggacattcattaccaggaatgtttgatagctggggacaaggaacattagtagcagtaagtagtgcatcaacaaaagga

SEQ ID NO: 50391 - RNA, 399 nt, synthetic construct
  misc_feature 1..399: note = derived and/or modified sequence opt6 from anti-HIV_Chain
  source 1..399: mol_type = other RNA
caagtaagattatttcaaagtggagcagcaatgagaaaaccaggagcaagcgtaacaataagttgtgaagcaagtggatataattttttaaattattttgtacattgggtaagacaaagaccaggaagaggatttgaatggttaggaatgataaatccaagaggaggaagaccatggagtgcacaaagtgtacaaggaagattaacattaacaagagatacaagtacagaaatgttttatatgagattagatggattaaggagtgatgatacagcaacatatttttgtgcaagaaatgaagcagattatcatgatggaaatggacatagtttaagaggaatgtttgattattggggacaaggaagtttaataacagtaagtagtgcaagtacaaaagga

SEQ ID NO: 50392 - RNA, 399 nt, synthetic construct
  misc_feature 1..399: note = derived and/or modified sequence opt6 from anti-HIV_Chain
  source 1..399: mol_type = other RNA
caagtaagattaagtcaaagtggagcagcagtaaaaaaacctggagcaagtgtaacaatagtatgtgaaacagaaggatataattttatagattatataatacattgggtaagacaaccaccaggaagaggatttgaatggttaggaatgatagatccaagaaatggaagaccatggagtggacaaaaagtacatggaagattaagtttatggagagatacaagtacagaaaaagtatatatgacattaacaggattaacaagtgatgatacaggattatacttttgtggaagaaatgaaccacaatatcatgatgataatggacatagtttaccaggaatgatagattattggggacaaggaacaatggtaacagtaagcagtgcaagtacaaaagga

SEQ ID NO: 50393 - RNA, 399 nt, synthetic construct
  misc_feature 1..399: note = derived and/or modified sequence opt6 from anti-HIV_Chain
  source 1..399: mol_type = other RNA
caagtaagattaagtcaaagtggagcagcaataaaaaaaccaggagcaagcgtaacaataagttgtgaaacagaaggatatacatttataaattatataatacattgggtaagacaaccaccaggaagaggatttgaatggttaggaatgattgatccaagaaatggaagaccatggtttggacaaagtgtacaaggaagattaagtctaagaagagatacatatacagaagtagtatatatgacattatcaggattaacatcagatgatgcaggacattatttttgtgcaagaaatgaaccacaatatcatgatggaaatggacattcattaccaggaatgtttgattattggggacaaggaacattagtagcagtaagttcagcatcaacaaaagga

SEQ ID NO: 50394 - RNA, 399 nt, synthetic construct
  misc_feature 1..399: note = derived and/or modified sequence opt6 from anti-HIV_Chain
  source 1..399: mol_type = other RNA
caagtaagattatttcaaagtggagcagcaatgagaaaaccaggagcaagtgtaacaataagttgtgaagcaagtggatataattttatgaattattttgtacattgggtaagacaaagaccaggaagaggatttgaatggttaggaatgataaatccaagaggaggaagaccatggagtgcacaaagtgtacaaggaagattaacattaacaagagatacaagtacagaaatgttttatatgagactagatggattaagaagtgatgatacagcaacatatttttgtgcaagaaatgaagcagattatcatgatggaaatggacatagcttaagaggaatgtttgattattggggacaaggaagtttaataacagtaagttcagcaagtacaaaagga

SEQ ID NO: 50395 - RNA, 399 nt, synthetic construct
  misc_feature 1..399: note = derived and/or modified sequence opt6 from anti-HIV_LightChain
  source 1..399: mol_type = other RNA
atgaaactaccagtaagactattagtactaatgttctggataccagcatcctcatcagacatagtaatgacacaatcaccactatcactaccagtaacaccaggagaaccagcatcaatatcatgcagatcatcacaaagactactatcatcatacggacacacctacctacactggtacctacaaaaaccaggacaatcaccacaactactaatctacgaagtatcaaacagattctcaggagtaccagacagattctcaggatcaggatcaggaacagacttcacactaaaaatatcaagagtagaagcagaagacgtaggagtatactactgctcacaatcaacacacgtaccactaacattcggacaaggaacaaaagtagaaataaaaagaaaa

SEQ ID NO: 50396 - RNA, 402 nt, synthetic construct
  misc_feature 1..402: note = derived and/or modified sequence opt6 from anti-HIV_Chain
  source 1..402: mol_type = other RNA
caaccatatatagtacaatcaggaccagcagtaaaaggagcaggaagttcagtaacagtaacatgtaaagtagatggagatgatgatggaatattttcatttggaacatatttcatggtatgggtaagacaagcaccaggacaaggattacaatatatgggaggattagtaccatcatatgcaccaacatatgcacataaatttgaaggaagaataacaatatcagcagcaggaacaccaccagtagtaagtttaacattattaaatctaacaaatgatgacgcagcaacatatttttgtgcaagagaaagaggaagacattatgatagtaaaacaagagaaaatagaagaggaagatattttgatatgtggggaagaggaacaagaataacagtatcacca

SEQ ID NO: 50397 - RNA, 402 nt, synthetic construct
  misc_feature 1..402: note = derived and/or modified sequence opt6 from anti-HIV_Chain
  source 1..402: mol_type = other RNA
caaccatatatagtacaatcaggaccagcagtaaaaggagcaggaagttcagtaacagttacatgtagagtagatggagatgatgatggaatatttaattttggaacatattttatggtatgggtaagacaagcaccaggacaaggattacaatatatgggaggattagtaccaagttatgcaccaacatatgcacataaatttgaaggaagaataacaatatcagcagcaggaacaccaccagtagtaagtttaacattaataaatttaacaaatgcagatgcagcaacatatttttgtgcaagagaaagaggaagacattatgatagtaaaacaagagaaaatagaagaggaagatattttgatatgtggggaagaggaacaagaataacagtaagtcca

SEQ ID NO: 50398 - RNA, 402 nt, synthetic construct
  misc_feature 1..402: note = derived and/or modified sequence opt6 from anti-HIV_Chain
  source 1..402: mol_type = other RNA
agagtacacagccaagtacaattagtagaatcaggaccaggattagtaaaaccatcacaaacactatcactaacatgcacagtatcaggaggaagtatatcaaacggaggacattactggaactggataagacaacacccaggaaaaggactagaatggataggacacatatacaacatagcaacaacatactacaacccatcactaaaatcaagagtatcaatatcagtagacacaagtaaaaaccaattctcactaaaactatcatcagtaacagcagcagacacagcagtatactactgcgcaagaggatcaggaagatggacaataggagcaagaatatactttgacaactggggacaaggagcattagtagcagtatcatcagcatcaacaaaagga

SEQ ID NO: 50399 - RNA, 402 nt, synthetic construct
  misc_feature 1..402: note = derived and/or modified sequence opt6 from anti-HIV_Chain
  source 1..402: mol_type = other RNA
agcgtagacgaaagattattagaatttggaggaagattagtacaaccaggaggaagtttaagattaagctgtagtgcaagcggattcacattctcaaactcagcaatgagctgggtaagacaagcaccaggaaaaggactagaatgggtaagctcaatattaagctcaggagtaggaacattctatgcagatagcgtaaaaggaagattcacagtaagcagagacaatagcagaaacacactatatctacaaatgaaaagcctaagagcagaagatacagcactatattactgtgcaaaagtacaaatacaacaattaaactttggagtaataacagacgcaggattagacgtatggggaaaaggaacaacactaatagtatcaagtgcaagcacaaaagga

SEQ ID NO: 50400 - RNA, 402 nt, synthetic construct
  misc_feature 1..402: note = derived and/or modified sequence opt6 from anti-HIV_Chain
  source 1..402: mol_type = other RNA
gtacaaagtcaagtatatttagtacaaagtggaggagaagtaaaaaaaccaggaagcagtgtaaaagtaagttgtaaagcaagtggagatagctttagtagtagtgtaataacatgggtaagacaagcaccagggcaaggaccagaatggatgggaagaataataccagtattaggagtagcagcatatgcacaaaatttttatgggagagtaacaataagtgcagatacaagtagtaatacagcatatatggaattaagtagcttaagatttgaagatacagcagtattttattgtgcaagagaaacaggaagaggaggaaatttagcattaagacaatatttttttgatagttggggacaaggaacattagtaacggtaagtagtccaagtacaaaagga

SEQ ID NO: 50401 - RNA, 402 nt, synthetic construct
  misc_feature 1..402: note = derived and/or modified sequence opt6 from anti-HIV_Chain
  source 1..402: mol_type = other RNA
caactacaattacaagaatcaggaccaggattagtaaaaccatcagaaacactatcactaacatgctcagtatcagacggaagtataaactcaaactcatactattgggcatggataagacaaagcccaggaaaaggactagaatggataggaagcgtatactatttcggaggaacatactatagcccaagcctaaaatcaagagtaacaatgagcgtagacagaagcaaaaaccaattctcactaaatgtatcaagcgtaacagcagcagatacagcaatatattactgtgcaagacacgtaagaccatacgatagatcaggatatccagaaagaccaaactggttcgatccatggggaagaggaacattagtaacagtaagttcagcatcaacaaaagga

SEQ ID NO: 50402 - RNA, 402 nt, synthetic construct
  misc_feature 1..402: note = derived and/or modified sequence opt6 from anti-HIV_Chain
  source 1..402: mol_type = other RNA
caagtacaattacatcaatggggagcaggattactaaaaccatcagacacactatcactaacatgcggaatattaggagtaagcccaccaggatcattaacaggatactattggacatggataagacaaccaccaggaaaaggattagaatggataggagaagtataccattcaggatcaacaaactataacccatcattagcatcaagagtaacaatatcaatgggaacaacaaaaacacaattctcattaagactaacatcagtaacagcagcagattcagcagtatattactgtgcatcaggaaaagtatggggaataacagcaagaccaagagatgcaggactagatgtatggggacaaggaactacagtaacagtaacatcagcatcaacaaaagga

SEQ ID NO: 50403 - RNA, 402 nt, synthetic construct
  misc_feature 1..402: note = derived and/or modified sequence opt6 from anti-HIV_Chain
  source 1..402: mol_type = other RNA
caagtacaattagtacaaagtggagcagaagtaaaaaaaccaggaagtagcgtaaaagtaagttgtagagcaagtggaggatcatttggaaattatgcaataaattgggtaagacaagcaccaatgcaaggattagaatggatgggaggaataataccaatatttggaacaacaaattatgcacaaaattttagaggaagagtaacaataaatgcagatacatttacaaatacagtaaatatggatttaagtagtttaagaagtgaagatacagcagtatattattgtggaagaagtataaatgcagcagtaccaggattagaaggagtatattattattatggaatggcagtatggggacaaggaacaacagtaacagtaagtagtgcaagtacaaaagga

SEQ ID NO: 50404 - RNA, 402 nt, synthetic construct
  misc_feature 1..402: note = derived and/or modified sequence opt6 from anti-HIV_Chain
  source 1..402: mol_type = other RNA
tttgtacaattagtagaaagtggaggaggattagtacaaccaggaggaagtttaagattaagttgtgcagcaagtggatttaattttaatacatattggatgaattgggtaagacaagcaccaggaaaaggattagaatgggttgcaaatatgaaagaagatggaagtgaaaaatattatgtagatagtgtaaaaggaagatttacaataagtagagataatgcaaaaaatagtttatatttacaaatgaatagcttaagagcagaagatacagcagtatattattgtgcaagaaatccagaaagtagatgtatagtaggaagaaatagaggatggtgtagatattttgatttatggggaagaggaagtctagtaacagtaagtccagcaagtacaaaagga

SEQ ID NO: 50405 - RNA, 405 nt, synthetic construct
  misc_feature 1..405: note = derived and/or modified sequence opt6 from anti-HIV_Chain
  source 1..405: mol_type = other RNA
caactacaactagatcaaccaggagcagcaatgaaatcactaggatcatcactaacaataacatgcagagtatcaggagatgacttaggatcattccatttcggaacatatttcatgatatgggtaagacaaggaccaggacaaggactagaatacatgggaggaatactaccatcaacaaaaacaccaacatatgcacataaatttagaggaagagtatcaatatcagcaccaggagtaccaccagtactatcactagcactaacaaacctaacatatgacgatacagcaacatatttctgtgcaagagaaagaggaagacactttgaaccaaaaaatagagatcacttagaaggaaaatttctagatctatggggaagaggaacattcgtaagagtatcacca

SEQ ID NO: 50406 - RNA, 405 nt, synthetic construct
  misc_feature 1..405: note = derived and/or modified sequence opt6 from anti-HIV_Chain
  source 1..405: mol_type = other RNA
caagtacaattagtacaaccaggaacagcaatgaaatcactaggaagctcactaacaataacatgcagagtatcaggagatgacttaggatcattccatttcggaacatatttcatgatatgggtaagacaagcaccaggacaaggactagaatacatgggaggaatattaccatcaacaaaaacaccaacatatgcacataaatttagaggaagagtaagcatatcagcaccaggagtaccaccagtattatcactagcactaacaaacttaacatatgacgatacagcaacatatttctgtgcaagagaaagaggaagacactttgaacccaaaaatagagataacttagaaggaaaatttttcgatttatggggaagaggaacattcgtaagagtaagccca

SEQ ID NO: 50407 - RNA, 405 nt, synthetic construct
  misc_feature 1..405: note = derived and/or modified sequence opt6 from anti-HIV_Chain
  source 1..405: mol_type = other RNA
caagtacaattagtacaaccaggaacagcaatgaaaacattaggaagttcattaacaatatcatgtagagtatcaggagacgatggaaatttccatttcggaacatatttcatggcatgggtaagacaagtaccaggacaaggactagaatacatgggaggaatactaccatcaacaaaatcaccaacatatgcacataaatttagaggaagagtatcaatatcaacagcaggagtaccaccagtagtatcactagcactaacaaacttaacatatgacgatacagcaacatatttctgtgcaagagaaagaggaagacactatgactcaaaaaaacaagaaaactatagaggaaaatttttcgatctatggggaagaggaacatgggtaagagtatcaccaaca

SEQ ID NO: 50408 - RNA, 405 nt, synthetic construct
  misc_feature 1..405: note = derived and/or modified sequence opt6 from anti-HIV_Chain
  source 1..405: mol_type = other RNA
catctagtacaatcaggaacagaagtaaaaaaaccaggaagctcagtaacagtatcatgcaaagcatatggagtaaacacattcggactatatgcagtaaactgggtaagacaagcaccaggacaatcactagaatacataggacaaatatggagatggaaatcaagcgcaagtcatcactttagaggaagagtattaataagcgcagtagatttaacaggatcaagcccaccaataagctcactagaaataaaaaacttaacatcagacgatacagcagtatatttctgtacaacaacatcaacatatgaccaatggtcaggactacaccatgacggagtaatggcatttagctcatggggacaaggaacactaatatcagtatcagcagcaagcacaaaagga

SEQ ID NO: 50409 - RNA, 405 nt, synthetic construct
  misc_feature 1..405: note = derived and/or modified sequence opt6 from anti-HIV_Chain
  source 1..405: mol_type = other RNA
caagtacaattagtacaatcaggagcagaagtaaaaaaaccaggaagctcagtaaaagtatcatgcaaagcatcaggaggaacatttagcacatacgcattctcatgggtaagacaagcaccaatagaaggattagaatggatgggaggaataataccaatattcggaacagaaaattacgcacaaaaattccaaggaagagtaacaataacagcagataaatcgacatcaacagcatacatggaattaagttcactaagaagcgaagacacagcagtatactattgcgcaagagatagatcaagcgcaataggatactgtagttcaatatcatgctataaaggaagctttgacatatggggacaaggaacaatggtaacagtatcaagcgcaagcacaaaagga

SEQ ID NO: 50410 - RNA, 405 nt, synthetic construct
  misc_feature 1..405: note = derived and/or modified sequence opt6 from anti-HIV_Chain
  source 1..405: mol_type = other RNA
caagtacaattagtacaaagtggagcagaagtaaaaaaaccaggaagtagtgtaaaagtaagttgtaaagcaagtggaggaacatttagtacatatgcatttagttgggtaagacaagcaccaggacaaggattagaatggatgggaggaataataccaatatttggaacagaaaattatgcacaaaaatttcaaggaagagtaacaataacagcagataaaagtacaagtacagcatatatggaattaagtagtttaagaagtgaagatacagcagtatattattgtgcaagagatagaagcagtgcaataggatattgtagtagtataagttgttataaaggaagttttgatatatggggacaaggaacgatggtaacagtaagcagcgcaagtacaaaagga

SEQ ID NO: 50411 - RNA, 405 nt, synthetic construct
  misc_feature 1..405: note = derived and/or modified sequence opt6 from anti-HIV_Chain
  source 1..405: mol_type = other RNA
gaagtacaattagtagaatcaggaggaggactagtacaaccaggaggatcattaagattatcatgtgcagcatcaggattcacattctcatcatattcaatgaactgggtaagacaagcaccaggaaaaggattagaatgggtatcatatatatcaggaagttcatatacaatatactatgcagattcagtaagaggaagatttacaatatcaagagacaatgcaaaaaactcactatatctacaaatgaatagcttaagagatgaagatacagcagtatatttctgtgcaagagcaacaccaccaaacccactaaatctatataactatgactcatcaggaagctcattcgattactggggacaaggaacactagtaacagtatcaagtgcatcaacaaaagga

SEQ ID NO: 50412 - RNA, 405 nt, synthetic construct
  misc_feature 1..405: note = derived and/or modified sequence opt6 from anti-HIV_Chain
  source 1..405: mol_type = other RNA
gaagtacaattagtacaaagtggagcagaagtaaaaaaaccaggaagttcagtaaaagtatcatgcaaagcatcaggaggaacatttagtacatacgcattctcatgggtaagacaagcaccaggacaaggattagaatggatgggaggaattataccaatatttggaacagaaaattatgcacaaaaatttcaaggaagagtaacaataacagcagataaatcaacatcaacagcatatatggaattaagctcattaagaagtgaagacacagcagtatattattgtgcaagagatagatcaagtgcaataggatactgtagctcaataagttgttataaaggaagttttgacatatggggacaaggaacaatggtaacagtatcaagcgcaagtacaaaagga

SEQ ID NO: 50413 - RNA, 405 nt, synthetic construct
  misc_feature 1..405: note = derived and/or modified sequence opt6 from anti-HIV_Chain
  source 1..405: mol_type = other RNA
gaagtacaattagtagaatcaggagcagaagtaaaaaaaccaggaagttcagtaaaagtatcatgcaaagcatcaggaggaacatttagcacatacgcattctcatgggtaagacaagcaccaggacaaggattagaatggatgggaggaataataccaatatttggaacagaaaattacgcacaaaaatttcaaggaagagtaacaataacagcagataaatcaacatcaacagcatatatggaattaagttcattaagaagtgaagacacagcagtatattattgcgcaagagatagatcaagtgcaatagggtactgtagttcaatatcatgttataaaggaagttttgatatatggggacaaggaacaatggtaacagtatcaagtgcaagtacaaaagga

SEQ ID NO: 50414 - RNA, 405 nt, synthetic construct
  misc_feature 1..405: note = derived and/or modified sequence opt6 from anti-HIV_Chain
  source 1..405: mol_type = other RNA
ccactagtacaattagaaccaagtggagtagaagtaaaaaaaagaggagcaagtgtaaaagtaagctgtaaagtaagtggatattcattaacagaattaagtatgcattgggtaagacaagcaccaggaaaaggattagaatggatgggaagttttgatccattagatggagatacaatatatgcacaaaaattccaaggaagagtaacaatgacagtagatacaagtacagatacagcatatatggatttaagtagtttaagattcgaagatacagcagtatattattgtgcaacaccatcaaaagcatattattatgatagtccaaattatgaaggagatttttatatggatgtatggggaaaaggaacaacagtaatagtatcaagtgcaagtacaaaagga

SEQ ID NO: 50415 - RNA, 408 nt, synthetic construct
  misc_feature 1..408: note = derived and/or modified sequence opt6 from anti-HIV_HeavyChain
  source 1..408: mol_type = other RNA
caaatacatctagtacaatcaggaacagaagtaaaaaaaccaggaagctcggtaacagtatcatgcaaagcatatggagtaaacacattcggactatatgcagtaaactgggtaagacaagcaccaggacaatcactagaatacataggacaaatatggagatggaaatcaagcgcaagccatcactttagaggaagagtactaataagcgcagtagatctaacaggatcaagcccaccaataagctcactagaaataaaactaacaagcgatgacacagcagtatacttttgcacaacaacaagcacatacgataaatggagcggactacatcacgatggagtaatggcattctcaagcagaggacaaggaacactaataagcgtaagtgcagcatcaacaaaagga

SEQ ID NO: 50416 - RNA, 408 nt, synthetic construct
  misc_feature 1..408: note = derived and/or modified sequence opt6 from anti-HIV_HeavyChain
  source 1..408: mol_type = other RNA
caaatacatctagtacaatcaggaacagaagtaaaaaaaccaggaagttcagtaacagtatcatgcaaagcatatggagtaaatacattcggactatatgcagtaaactgggtaagacaagcaccaggacaaggactagaatacataggacaaatatggagatggaaatcaagcgcaagccatcactttagaggaagagtactaataagcgcagtagatctaacaggatcaagcccaccaataagctcactagaaataaaagtaacaagcgatgacacagcagtatacttttgcacaacaacaagcacatacgatgaatggagcgatctacatcacgatggagtaatggcattctcaagctggggacaaggaacactaataagcgtaagcgcagcatcaacaaaagga

SEQ ID NO: 50417 - RNA, 408 nt, synthetic construct
  misc_feature 1..408: note = derived and/or modified sequence opt6 from anti-HIV_HeavyChain
  source 1..408: mol_type = other RNA
caaatacatctagtacaatcaggaacagaagtaaaaaaaccaggaagctcagtaacagtatcatgcaaagcatatggagtaaacacattcggactatatgcagtaaactgggtaagacaagcaccaggacaatcattagaatacataggacaaatatggagatggaaatcaagcgcaagccatcactttagaggaagagtattaataagcgcagtagatctaacaggatcaagtccaccaataagttcactagaaataaaactaacaagtgatgacacagcagtatacttttgcacaacaacaagcacatacgatagatggagcggactacatcacgatggagtaatggcattctcaagctggggacaaggaacattaataagcgtaagcgcagcatcaacaaaagga

SEQ ID NO: 50418 - RNA, 408 nt, synthetic construct
  misc_feature 1..408: note = derived and/or modified sequence opt6 from anti-HIV_Chain
  source 1..408: mol_type = other RNA
tgtaatccaagagtacatagtgaagtacaattagtagaaagtggagcagaagtaaaaaaaccaggagcaagtgtaaaagtagcatgtaaagtaagtggaaaaaaattaagtgatttaagtatacattgggtaagacaagcaccaggaaaaggattagaatggatgggaggatttgatgaagaagatggaaaaataagttatgaaagaaaatttcaaggaagagtaagtatgacagaagatacagcaagagatacagcatttatggaaatgagtagtctaagaagtgatgatacagcagtatatttttgtgctgcagcaccaagattagatttaggagaattaagtagcggatttcatttttggggattaggaacattagtaacagtaagtagtgcaagtacaaaagga

SEQ ID NO: 50419 - RNA, 408 nt, synthetic construct
  misc_feature 1..408: note = derived and/or modified sequence opt6 from anti-HIV_Chain
  source 1..408: mol_type = other RNA
atatgggcaccactaatagcagtaacatttctagtattacattgcgaatcattaggaacatgctgttgctgtcaagcatcaggaggaacattcaatacatttgcaataaactgggtaagacaagcaccaggacaaggattagaatgggtaggaggaataataccagtattcggaacagcatcatatgcacaaaaatttcaaggaagagtaacagtaacaacagacgaatcaagaggaacagcatatatggaactaaattcattaagatcagaagatacagcagtatattactgtgcaagaggacaaacagatttaaatgacgatttatggtcagattattcaacaccaggatttgactattggggacaaggaacattagtaacagtatcatcagcatcaacaaaagga

SEQ ID NO: 50420 - RNA, 408 nt, synthetic construct
  misc_feature 1..408: note = derived and/or modified sequence opt6 from anti-HIV_Chain
  source 1..408: mol_type = other RNA
ttacaaccaagagtacatagtgaagtacaattagtagaaagtggagcagaagtaaaaaaaccaggagcaagtgtaaaagtaagttgtaaagtaagcggatatacattaagtgatttaagtatgcattgggtaagacaagcaccaggaaaaggattagaatggatgggaggatttgatgaagaagatggagaaataacatatgcacaaaaatttcaaggaagagtaagtatgacagaagatacaagtagagatacagcatatatggaattaagtagtttaagaagtgaagatacagcagtatattattgtgcaacagcaccaagattagaattaggagaattaagtagtggatttcattattggggattaggaacattagtaacagtaagtagcgcaagtacaaaagga

SEQ ID NO: 50421 - RNA, 408 nt, synthetic construct
  misc_feature 1..408: note = derived and/or modified sequence opt6 from anti-HIV_Chain
  source 1..408: mol_type = other RNA
caatcacaagtacacttagtacaaagcggagcagaagtaaaaaaaccaggatcaagcgtaaaagtaagctgtcaagcaagcggaggaacattcaatacatttgcaataaactgggtaagacaagcaccaggacaaggactagaatgggtaggaggaataataccagtattcggaacagctagctatgcacaaaaatttcaaggaagagtaacagtaacaacagacgaaagcagaggaacagcatatatggaactaaatagcctaagatcagaagatacagcagtatattactgtgcaagaggacaaacagatctaaatgacgatctatggagcgattactcaacaccaggatttgactattggggacaaggaacattagtaacagtatcaagcgcaagtacaaaagga

SEQ ID NO: 50422 - RNA, 408 nt, synthetic construct
  misc_feature 1..408: note = derived and/or modified sequence opt6 from anti-HIV_Chain
  source 1..408: mol_type = other RNA
ggatcagaagtacaattagtagaaagtggagcagaagtaaaaaaaagaggagcaagtgtgaaagtaagttgtaaagtaagtggatattcattaacagaattaagcatgcattgggtaagacaagcaccaggaaaaggattagaatggatgggatcatttgatccattagacggagatacaatatatgcacaaaaatttcaaggaagagtaacaatgacagtagatacaagtacagatacagcatatatggatttatcaagtttaagatttgaagatacagcagtatattattgtgcaacaccatcaaaagcatattattatgatagcccaaattatgaaggagatttttatatggatgtatggggaaaaggaacaacagtaatagtatcaagcgcaagtacaaaagga

SEQ ID NO: 50423 - RNA, 408 nt, synthetic construct
  misc_feature 1..408: note = derived and/or modified sequence opt6 from anti-HIV_Chain
  source 1..408: mol_type = other RNA
caagtacaattagtacaaagcggaggagaagtaaaaaaaccaggagcaagcgtaaaagtaagctgtaaagtaagcggatactcactaacagaattaagcatgcactgggtaagacaagcaccaggaaaaggactagaatggatgggagtattcgatccactagaaggagacggagtatatgtacaaaaatttagaggaagagtaataatgacagaagacacaagcacagacacagcatatatggaactaacaagcttaagatcagaagatacagcaatatattactgtgcaacaaaagcaaaagattactattacgaaagctcagactatagtccatactattactattacatggacgtatggggaaaaggaacaacagtaacagtatcaagcgcaagcacaaaagga

SEQ ID NO: 50424 - RNA, 408 nt, synthetic construct
  misc_feature 1..408: note = derived and/or modified sequence opt6 from anti-HIV_Chain
  source 1..408: mol_type = other RNA
gaagtacaattagtacaaagcggagcagaagtaaaaaaaccaggagcaagcgtaaaagtaagctgtaaagtaagcggatacacactaacagaattaagcatgcactgggtaagacaagcaccaggaaaaggactagaatggatgggagtattcgatccattagaaggagacggagtatatgcagaaaaatttagaggaagagtaataatgacagaagacacaagcacagacacgggatatatggaactaacaagcttaagatcagaagatacagcaatatattactgtgcaacaaaagcaaaagattactattacgaaagctcagactatagtccatactattactattacatggacgtatggggaaaaggaacaacagtaacagtatcaagcgcaagcacaaaagga

SEQ ID NO: 50425 - RNA, 408 nt, synthetic construct
  misc_feature 1..408: note = derived and/or modified sequence opt6 from anti-HIV_Chain
  source 1..408: mol_type = other RNA
caagtacaattagtacaaagcggagcagaagtaaaaaaaccaggagcaagcgtaaaagtaagctgtaaagcaagcggatacacattcacaagatatcacatacactgggtaagacacgcaccaggacaaggactagaatggatgggaaaaataaatccatcaagagcaagcacaaaatatgcaaaaaaatttcaagatagagtaacaatgacaagagacacaagcacaagcacagtatatatggaactatcaagcctaagaggagacgatacagcagtatattactgtggaagagaaatgggaacattcacactattaggagtagtaatagaccattacgatttctatccaatggacgtatggggacaaggaacaccagtaacagtatcaagcgcaagcacaaaagga

SEQ ID NO: 50426 - RNA, 408 nt, synthetic construct
  misc_feature 1..408: note = derived and/or modified sequence opt6 from anti-HIV_Chain
  source 1..408: mol_type = other RNA
tcacgtccaccttcatgtctacttggatgttggtgttgttctggatttctattaccagctgtaattctacctaaccttcactctccatgtctatctctacttgaatctcaacctccatctctagctgaccttgtatctgcttttgcagttatggatatacctatatatataggtacatatagatctcaagcatcattacactcttcatccacaaaattccctacagatttccttggatctcaaactggatccgtagctgtaggtcaaggtcaaatttcacatctacgttcagttgaatggagacttagaatgtgggaatttattacagctctaaaagtacatatgttcctatctagatctgaccgtggacctagatggaaaaatgtatcttcacttctaaattcacgt

SEQ ID NO: 50427 - RNA, 411 nt, synthetic construct
  misc_feature 1..411: note = derived and/or modified sequence opt6 from anti-HIV_HeavyChain
  source 1..411: mol_type = other RNA
caaatacacctagtacaatcaggaacagaagtaaaaaaaccaggatcatcagtaacagtatcatgcaaagcatacggagtaaacacattcggtctatacgcagtaaactgggtaagacaagcaccaggacaatcattagaatacataggacaaatatggagatggaaatcatcagcatcacaccacttcagaggaagagtcataatatcagctgtagacctaacaggctcatcaccaccaatatcaccactagaaataaaaaacctaacatcagacgacacagcagtatacttctgcacaacaacatcaacatcagacagatggtcaggactacaccacgacggagtaatggcattctcatcatggggacaaggaacattaatatcagtatcagcagcatcaacaaaagga

SEQ ID NO: 50428 - RNA, 411 nt, synthetic construct
  misc_feature 1..411: note = derived and/or modified sequence opt6 from anti-HIV_HeavyChain
  source 1..411: mol_type = other RNA
caaatacacctagtacaatcaggaacagaagtaaaaaaaccaggatcaagcgtaacagtatcatgcaaagcatacggagtaaacacattcggactatacgcagtaaactgggtaagacaagcaccaggacaatcactagaatacataggacaaatatggagatggaaaagctcagcatcacaccacttcagaggaagagtaataatatcagcagtagacttaacaggatcatcaccaccaatatcatcattagaaataaaaaacctaacatcagacgacacagcagtatacttctgcacaacagcatcaacatacgacaaatggtcaggattacaccacgacggagtaatggcattctcatcatggggacaaggaacactaatatcagtaagcgcagcatcaacaaaagga

SEQ ID NO: 50429 - RNA, 411 nt, synthetic construct
  misc_feature 1..411: note = derived and/or modified sequence opt6 from anti-HIV_HeavyChain
  source 1..411: mol_type = other RNA
caaatacacctagtacaatcaggaacagaagtaaaaaaaccaggatcatcagtaacagtatcatgcaaagcctacggagtaaacacattcggactatacgcagtaaactgggtaagacaagcaccaggacaatcactagaatacataggacaaatatggagatggaaatcatcagcatcacaccacttcagaggaagagtactaataagcgcagtagatctaacaggaccaagcccaccaatatcatcactagaaataaaaaacctaacaagtgacgacacagcagtatatttctgcacaaccacatcaacatacgacaaatggtcaggattacaccacgacggagtaatggcattctcatcatggggacaaggaacactaatatcagtatcagcagcatcaacaaaagga

SEQ ID NO: 50430 - RNA, 411 nt, synthetic construct
  misc_feature 1..411: note = derived and/or modified sequence opt6 from anti-HIV_HeavyChain
  source 1..411: mol_type = other RNA
caaatacacttagtacaatcaggaacagaagtaaaaaaaccaggatcatcagtagcagtatcatgcaaagcatacggagtaaacacattcggactatatgcagtaaactgggtaagacaagcaccaggacaatcactagaatacataggacaaatatggagatggaaatcatcagcatcacatgacttcagaggaagagtaataatatcagcagtagatctaacaggatcatcaccaccaatatcatcactagaaataaaaaacttaacatcagacgacacagcagtatatttctgcacagcaacatcaacaccagactattggtcaggactacaccatgacggagtaatggcattttcatcatggggacaaggaacattaatatcagtatcagcagcatcaacaaaagga

SEQ ID NO: 50431 - RNA, 411 nt, synthetic construct
  misc_feature 1..411: note = derived and/or modified sequence opt6 from anti-HIV_HeavyChain
  source 1..411: mol_type = other RNA
caaatacatttagtacaatcaggaacaggagtaaaaaaaccaggaagctcagtaacagtatcatgcaaagcatatggagtaaacacattcggactatatgcagtaaactgggtaagacaagcaccaggacaaggactagaatacataggacaaatatggagatggaaaagtagtgcaagccatcactttagaggaagagtactaataagtgcagtagatctaacaggaagtagtccaccaataacatcactagaaataaaaaatgtaacatcagacgatacagcagtatatttctgtacaacaacaagtacatatgacaaatggtcaggactataccatgacggagtaatggcatttagttcatggggacaaggaacattaatatcagtaagtgcagcaagtacaaaagga

SEQ ID NO: 50432 - RNA, 411 nt, synthetic construct
  misc_feature 1..411: note = derived and/or modified sequence opt6 from anti-HIV_HeavyChain
  source 1..411: mol_type = other RNA
caaatacacctagtacaatcaggaacagaagtaaaaaaaccaggatcatcagtaacagtatcatgcaaagcatacggagtaaacacattcggactatacgcagtaaactgggtaagacaagcaccaggacaatcactagaatacataggacaaatatggagatggaaatcatcagcatcacaccacttcagaggaagagtaataatatcagcagtagacctaacaggatcatcaccaccaatatcatcactagaaataaaaaacctaacatcagacgacacagcagtatacttctgcacaacaacatcaacatcagactactggtcaggactacaccacgacggagtaatggcattctcatcatggggacaaggaacactaatatcagtatcagcagcatcaacaaaagga

SEQ ID NO: 50433 - RNA, 411 nt, synthetic construct
  misc_feature 1..411: note = derived and/or modified sequence opt6 from anti-HIV_HeavyChain
  source 1..411: mol_type = other RNA
caaatacacttagtacaaagcggaacagaagtaaaaaaaccaggaagtagcgtaacagtaagctgtaaagcatacggagtaaatacatttggattatacgcagtaaattgggtaagacaagcaccaggacaaagcttagaatatataggacaaatatggagatggaaaagttcagcatcacaccatttcagaggaagagtattaatatcagcagtagacttaacaggaagttcaccaccaatatcaagcttagaaataaaaaatctaacaagtgatgacacagcagtatacttttgcacaacaacaagcacatacgatagatggagcggactacatcacgatggagtaatggcattctcaagttggggacaaggaacactaataagcgtaagcgcagcatcaacaaaagga

SEQ ID NO: 50434 - RNA, 411 nt, synthetic construct
  misc_feature 1..411: note = derived and/or modified sequence opt6 from anti-HIV_HeavyChain
  source 1..411: mol_type = other RNA
caaatacatctagtacaatcaggaacagaagtaagaaaaccaggaagctctgtaacagtatcatgcaaagcatatggagtaaacacattcggactatatgcagtaaactgggtaagacaagcaccaggacaatcactagaatacataggacaaatatggagatggaaatcaagtgcaagccatcactttagaggaagagtactaataagcgcagtagatttaacaggatcaagcccaccaataagttcactagaaataaaaaacttaacatcagacgatacagcagtatatttctgtacaacaacatcaacatatgacaaatggtcaggattacaccatgacggagtaatggcatttagttcatggggacaaggaacattaatatcagtatcagcagcaagcacaaaagga

SEQ ID NO: 50435 - RNA, 411 nt, synthetic construct
  misc_feature 1..411: note = derived and/or modified sequence opt6 from anti-HIV_HeavyChain
  source 1..411: mol_type = other RNA
caaatacatctagtacaatcaggaacagaagtaaaaaaaccaggatcatcagtaacagtatcatgcaaagcatacggagtaaacacattcggactatatgcagtaaactgggtaagacaagcaccaggacaatctctagaatacataggacaaatatggagatggaaatcatcagcatcacatcactttagaggaagagtattaatatcagcagtagacctaacaggatcatcaccaccaataagctcactagaaataaaaaacttaacatcagacgacacagcagtatatttctgcacaacaacatcaacatatgaccaatggtctggactacaccatgacggagtaatggcattctcatcatggggacaaggaacattaatatcagtatcagcagcatcaacaaaagga

SEQ ID NO: 50436 - RNA, 411 nt, synthetic construct
  misc_feature 1..411: note = derived and/or modified sequence opt6 from anti-HIV_HeavyChain
  source 1..411: mol_type = other RNA
caaatacacttagtacaatcaggaacagaagtaaaaaaaccaggaagttcagtaacagtatcatgtaaagcatacggagtaaatacattcggactatacgcagtatcatgggtaagacaagcaccaggacaaagactagaatacataggacaaataagaagatggaaatcatcagcatcacaccatttcagaggaagagtaacagtatcagcagtagacccaacaggatcatcaccaccaatatcaagcctagaaataagagacctaacaacagacgacacagcagtatacttctgcacaacaacatcaacatcagactactggtcaggcctacataacgaaagaggaacagcattctcaagctggggacaaggaacactaatatcagtatcagcagcatcaacaaaagga

SEQ ID NO: 50437 - RNA, 411 nt, synthetic construct
  misc_feature 1..411: note = derived and/or modified sequence opt6 from anti-HIV_HeavyChain
  source 1..411: mol_type = other RNA
caaatacatctagtacaatcaggaacagaagtaaaaaaaccaggaagctcagtaacagtatcatgcaaagcatatggagtaaacacattcggattatatgcagtaaactgggtaagacaagcaccaggacaaggattagaatacataggacaaatatggagatggaaatcaagcgcaagccatcactttagaggaagagtactaataagcgcaatagacttaacaggatcaagtccaccaataagctcactagaaataaagaacgtaacatcagacgatacagcagtatatttctgtacaacaatgtcaacatatgacaaatggtcaggattacaccatgacggagtaatggcatttagctcgtggggacaaggaacattaatatcagtatcagcagcaagcacaaaagga

SEQ ID NO: 50438 - RNA, 411 nt, synthetic construct
  misc_feature 1..411: note = derived and/or modified sequence opt6 from anti-HIV_HeavyChain
  source 1..411: mol_type = other RNA
caaatacacctagtacaatcaggaacagaagtaaaaaaaccaggatcatcagtaacagtatcatgcaaagcatacgaagtaaacacattcggactatacgcagtaaactgggtaagacaagcaccaggacaatcactagaatacataggacaaatatggagatggaaaagctcagcatcacaccacttcagaggaagagtactaatatcagcagtagacctaacaggatcatcaccaccaatatcatcactagaaataaaaaacgtaacatcagacgacacagcagtatacttctgcacaacaacatcaacacacgacaaatggtcaggactacaccacgacggagtaatggcattctcaagctggggacaaggaacactaatatcagtatcagcagcatcaacaaaagga

SEQ ID NO: 50439 - RNA, 411 nt, synthetic construct
  misc_feature 1..411: note = derived and/or modified sequence opt6 from anti-HIV_HeavyChain
  source 1..411: mol_type = other RNA
caaatacatctagtacaatcaggaacagaagtaaaaaaaccaggaagctcagtaacagtatcatgcaaagcatatggagtaaacacattcggactatatgcagtaaactgggtaagacaagcaccaggacaaggactagaatacataggacaaatatggagatggaaatcatcagcaagccatcactttagaggaagagtactaataagcgcagtagatctaacaggatcgagcccaccaataagctcactagaaataaaaaacgtaacatcagacgatacagcagtatatttctgtacaacaacatcaacatatgacaaatggtcaggattacaccatgacggagtagtagcatttagctcatggggacaaggaacattaatatcagtatcagcagcaagcacaaaagga

SEQ ID NO: 50440 - RNA, 411 nt, synthetic construct
  misc_feature 1..411: note = derived and/or modified sequence opt6 from anti-HIV_Chain
  source 1..411: mol_type = other RNA
caagtaacattagtacaaagtggagcagaagtaaaaaaaccaggagcaagtgtaagaataagttgtagagcaagtggatttacatttgatgattatagtgattattcatttataccaacaacatatttaatacactggttcagacaagcaccaggacaaggattagaatggatggcatggataaatagtgtaaatggaggaagaaatatagcaagacaatttcaaggaagagtaacagtagcaagagacagaagtaatagcatagcatttttagaattttcaggattacgacatgatgatacagcagtatatttctgtgcaagagacagaagagatgacgatagagcatggttattagatccatggggacaaggaacaagagtaacagtaagctcagcatcaactaaagga

SEQ ID NO: 50441 - RNA, 411 nt, synthetic construct
  misc_feature 1..411: note = derived and/or modified sequence opt6 from anti-HIV_Chain
  source 1..411: mol_type = other RNA
caaatacatctagtacaatcaggaactgaagtaaaaaaaccaggatcatcagtaacagtatcctgcaaagcatacggagtaaacacattcggactatacgcagtaaactgggtaagacaagcaccaggacaatcactagaatacataggacaaatatggagatggaaatcatcagcatcacaccacttcagaggaagagtactaataagcgcagtagacttaacaggatcatcaccaccaatatcatcactagaaataaaaaacctaacatcagacgacacagcagtatacttctgcacaacaacatcaacatacgacaaatggtcaggactacaccacgacggagtaatggcattctcatcatggggacaaggaacactaatatcagtatcagcagcatcaacaaaagga

SEQ ID NO: 50442 - RNA, 414 nt, synthetic construct
  misc_feature 1..414: note = derived and/or modified sequence opt6 from anti-HIV_Chain
  source 1..414: mol_type = other RNA
gtagtacaattagtacaaagtggagcagaagtaagaaaaccaggaagcagtttaaaagtaagttgtaaaagtagtggaggaacatttagtagatttgtagtaaattgggtaagacaagcaccaggacaaggactagaatggatgggaggaatgataccaatatttggaatagcaaaatatgcacaaaaatttcaagatagagtaacaatgacagcagatgaaagtaaaaatacagtatatttagattttagtagtttaagaagtgatgatacagcagtatattattgtgcaagagatagaggagatacaagattattagattatggagattatgaagatgaaagatattattatggaatggatgtatggggacaaggaacaacagtaatagtaagcagtgcaagtacaaaagga

SEQ ID NO: 50443 - RNA, 414 nt, synthetic construct
  misc_feature 1..414: note = derived and/or modified sequence opt6 from anti-HIV_Chain
  source 1..414: mol_type = other RNA
caagtacaattagtacaaagtggagcagaagtaagaaaaccaggaagtagtttaaaagtaagctgtaaaagtagtggaggaacatttagtagatttgtagtaaattgggtaagacaagcaccaggacaaggattagaatggatgggaggaatgataccaatatttggaatagcaaaatatgcacaaaaatttcaagatagagtaacaatgacagcagatgaaagtaaaaatacagtatatttagattttagcagtttaagaagcgatgatacagcagtatattattgtgcaagagatagaggagatacaagattattagattatggagattatgaagatgaaagatattattatggaatggatgtatggggacaagggacaacagtaatagtaagtagtgcaagtacaaaagga

SEQ ID NO: 50444 - RNA, 414 nt, synthetic construct
  misc_feature 1..414: note = derived and/or modified sequence opt6 from anti-HIV_Chain
  source 1..414: mol_type = other RNA
gaagtacaattagtagaaagtggagcagaagtaagaaaaccaggaagtagtttaaaagtaagttgtaaaagtagtggaggaacatttagtagatttgtagtaaattgggtaagacaagcaccaggacaaggattagaatggatgggaggaatgataccaatatttggaatagcaaaatatgcacaaaaatttcaagatagagtaacaatgacagcagacgaaagtaaaaatacagtatatttagattttagtagtttaagaagtgatgatacagcagtatattattgtgcaagagatagaggagatacaagattattagattatggagattatgaagatgaaagatattattatggaatggatgtatggggacaaggaacaacagtaatagtaagtagtgcaagtacaaaagga

SEQ ID NO: 50445 - RNA, 414 nt, synthetic construct
  misc_feature 1..414: note = derived and/or modified sequence opt6 from anti-HIV_Chain
  source 1..414: mol_type = other RNA
caagtacaattagtagaaagtggagcagaagtgagaaaaccaggaagtagtttgaaagtaagttgtaaatcaagtggaggaacatttagtagatatgtagtaaattgggtaagacaagcaccaggacaaggattagaatggatgggaggaataataccaatatttggaatagcaaaatatgcacaaaaatttcaagatagagtaacaatgacagcagatgaaccaaaaaatacagtatatttagattttaatagtttaagaagtgatgatacagcagtatattattgtgcaagagatagaggagatacaagattattagattatggagattatgaagatgaaagatattattatggaatggatgtatggggacaaggaacaacagtaatagtaagtagtgcaagtacaaaagga

SEQ ID NO: 50446 - RNA, 414 nt, synthetic construct
  misc_feature 1..414: note = derived and/or modified sequence opt6 from anti-HIV_Chain
  source 1..414: mol_type = other RNA
caagtacaattagtacaaagtggagcagaagtaagaaaaccaggatcaagtctaaaagtaagttgtaaatcaagtggaggaacatttagcagatatgtagtaaattgggtaagacaagcaccaggacaaggattagaatggatgggaggaatgataccaatattcggaatagcaaaatatgcacaaaaatttcaagatagagtaacaatgacagcagatgaaagtaaaaatacagtatatttagattttagtagtttaagatcagatgatacagcagtatattattgtgcaagagatagaggagatacaagattattagattatggagattatgaagatgaaagatattattatggaatggatgtatggggacaaggaacaacagtaatagtaagtagtgcaagtacaaaagga

SEQ ID NO: 50447 - RNA, 414 nt, synthetic construct
  misc_feature 1..414: note = derived and/or modified sequence opt6 from anti-HIV_Chain
  source 1..414: mol_type = other RNA
caagtacaattagtacaaagtggagcagaagtaagaaaaccaggaagtagtttaaaagtaagttgtaaatcaagtggaggaacatttagtagatatgtagtaaattgggtaagacaagcaccaggacaaggattagaatggatgggaggaataataccaatatttggaatagcaaaatatgcacaaaaatttcaagatagagtaacaatgacagcagatgaaagtaaaaatacagtatatttagattttagtagtttaagaagtgatgatacagcagtatattattgtgcaagagatagaggagatacaagattattagattatggagattatgaagatgaaagatattattatggaatggatgtatggggacaaggaacaacagtaatagtaagtagtgcaagcacaaaagga

SEQ ID NO: 50448 - RNA, 414 nt, synthetic construct
  misc_feature 1..414: note = derived and/or modified sequence opt6 from anti-HIV_Chain
  source 1..414: mol_type = other RNA
caagtacaattagtagaaagcggagcagaagtaagaaaaccaggaagtagtttaaaagtaagttgtaaaagcagtggaggaacatttagtagatatgtagtaaattgggtaagacaagcaccaggacaaggattagaatggatgggaggaataataccaatatttggaatagcaaaatatgcacaaaaatttcaagatagagtaacaatgacagcagatgaaagtaaaaatacagtatatttagattttagcagtttaagaagtgatgatacagcagtatattattgtgcaagagacagaggagatacaagattattagattatggagattatgaagatgaaagatattattatggaatggatgtatggggacaaggaacaacagtaatagtaagtagtgcaagcacaaaagga

SEQ ID NO: 50449 - RNA, 414 nt, synthetic construct
  misc_feature 1..414: note = derived and/or modified sequence opt6 from anti-HIV_Chain
  source 1..414: mol_type = other RNA
caagtacaattagtacaaagtggagcagaagtaagaaaaccaggatcaagtttaaaagtaagctgtaaaagtagtggaggaacatttagtagatatgtagtaaactgggtaagacaagcaccaggacaaggattagaatggatgggaggaataataccaatattcggaatagcgaaatatgcacaaaaatttcaagatagagtgacaatgacagcagatgaaccaaaaaatacagtatatttagattttaatagcttaagaagtgatgatacagcagtatattattgtgcaagagatagaggagatacaagactattagattatggagattatgaagatgaaagatattattatggaatggatgtatggggacaaggaacaacagtaatagtaagtagtgcaagtacaaaagga

SEQ ID NO: 50450 - RNA, 414 nt, synthetic construct
  misc_feature 1..414: note = derived and/or modified sequence opt6 from anti-HIV_Chain
  source 1..414: mol_type = other RNA
gtagtacaattagtacaaagtggagcagaagtaagaaaaccaggaagtagtttaaaagtaagttgtaaaagtagtggaggaacatttagtaggtatgtagtaaattgggtaagacaagcaccaggacaaggattagaatggatgggaggaatgataccaatatttggaatagcaaaatatgcacaaaaatttcaagatagagtaacaatgacagcagatgaaagtaaaaatacagtatatttagattttagcagtttaagaagtgatgatacagcagtatattattgtgcaagagatagaggagatacaagattattagattatggagattatgaagatgaaagatattattatggaatggatgtatggggacaaggaacaacagtaatagtaagcagtgcaagtacaaaagga

SEQ ID NO: 50451 - RNA, 414 nt, synthetic construct
  misc_feature 1..414: note = derived and/or modified sequence opt6 from anti-HIV_Chain
  source 1..414: mol_type = other RNA
ttcatatgctttagtgtagtagtaagattactagaatttggaggaagattagtacaaccaggagggagtttaagattaagctgtagtgcaagtggattcacattctcaaactcagcaatgagttgggtaagacaagcaccaggaaaaggactagaatgggtaagctcaatattaagctcaggagtaggaacattctatgcagatagcgtaaaaggaagattcacagtaagtagagacaatagcagaaacacactatatctacaaatgaaaagcctaagagcagaagatacagcactatattactgtgcaaaagtacaaatacaacaattaaactttggagtaataacagacgcaggattagacgtatggggaaaaggaacaacactaatagtatcaagcgcaagcacaaaagga

SEQ ID NO: 50452 - RNA, 414 nt, synthetic construct
  misc_feature 1..414: note = derived and/or modified sequence opt6 from anti-HIV_Chain
  source 1..414: mol_type = other RNA
caagttcaattagtacaaagtggagcagaagtaagaaaaccaggaagtagcttaaaagtaagttgtaaaagtagtggaggaacatttagtagatatgtagtaaattgggtaagacaagcaccaggacaaggattagaatggatgggaggaataataccaatatttggaatagcaaaatatgcacaaaaatttcaagatagagtaacaatgacagcagatgaaagcaaaaatacagtatatttagattttagtagtttaagatcaggagatacagcagtatattattgtgcaagagatagaggagatacaagattattagattatggagattatgaagatgaaagatattattatggaatggatgtatggggacaaggaacaacagtaacagtaagcagtgcaagcacaaaagga

SEQ ID NO: 50453 - RNA, 417 nt, synthetic construct
  misc_feature 1..417: note = derived and/or modified sequence opt6 from anti-HIV_Chain
  source 1..417: mol_type = other RNA
caagtacaattagtagaaagcggagcagaagtaaaaaaaccaggatcaagcgtaaaagtaagctgtaaagcaagcggaggaacattcaatatatttgcatttagttgggtaagacaagcaccaggacaaggactagaatggatgggaggaataataccaatattcgcaagcccaaactatgcacaaagatttcaaggaagagtaacaataacagcagacgaaagcacgagcacagtacatatggaattatcaagcttaagatcagaagatacagcaatatattactgtgcaaaagacgcacacatgcacatagaagaaccaagagactatgactatatatggggaacaagcccatactatttcgattactggggacaaggaacattagtaacagtaagctcagcatcaacaaaagga

SEQ ID NO: 50454 - RNA, 417 nt, synthetic construct
  misc_feature 1..417: note = derived and/or modified sequence opt6 from anti-HIV_Chain
  source 1..417: mol_type = other RNA
caagtacaattagtagaaagtggagcagaagtaaaaaaaccaggagcaagtgtaaaagtaagctgtaaagcaagtggatatacatttacaagtcatgatataaattgggtaagacaagcaacaggacaaggattagaatggatgggatggatgaatccaaatagcggagatacaggatatgcacataaatttcaaggaagagtaacaatgacaagaaatacaccaataagtacagcatatatggaattaagtagtttaagaagtgaagatacagcagtatattattgtgcaagaggaagagcaacaagtagaaatacaccatgggcacattattatgatagtagtggatattatggagcaggagattattggggacaaggaacattagtaacagtaagtagtgcaagtacaaaagga

SEQ ID NO: 50455 - RNA, 417 nt, synthetic construct
  misc_feature 1..417: note = derived and/or modified sequence opt6 from anti-HIV_Chain
  source 1..417: mol_type = other RNA
caagtacaaataagacaaagcggacccggattagtaaaaccactagaaacactaagcctaagctgtatagtattcggaggatcattcatagcatatcactggacatggataagacaagcaccattaaaaggactagaatggataggagatatagatcaaggaggagatataacatactcaccatcattaaaaagtagagtaacaatgtcagtcgatagatcaaaatcacaatttagcttaaaattaagctcagtaacagcagcagacgcagcagtatactattgcgtaagaggaccaccaaacagatacgcagtaacatcatttacaagcggaacacacagagaaagaagctcatactatttcgattactggggaccaggaacattagtaacagtaagctcagcatcaacaaaagga

SEQ ID NO: 50456 - RNA, 423 nt, synthetic construct
  misc_feature 1..423: note = derived and/or modified sequence opt6 from anti-HIV_Chain
  source 1..423: mol_type = other RNA
aatggaggaagtctaagattaagttgtagagtaagtggatttggatttcatttatatgaaatgaattgggtaagacaagcaccaggaaaaggattagaatggataagttcaatatcaggatcaggagaaagtacacattatagtgatagtataacaggaagatttagtatgagtagagatgaggcaaaagacagtttatatttacaaatgaataatttaagagtagaagatacagcagtatattattgtacaagaggatttagtatgggagatggaacaggatttagctttgatacatggggaagaggaacaatggtaacagtaagtagtggattagatacagtaagtttagcaagtacaaaaggaccaagcgtatttccattagcaccatgtagtagaagtacaagtgatgcaagattaagt

SEQ ID NO: 50457 - RNA, 423 nt, synthetic construct
  misc_feature 1..423: note = derived and/or modified sequence opt6 from anti-HIV_Chain
  source 1..423: mol_type = other RNA
caagtacaattagtacaatcaggagcagaagtaaaaaaaccaggaagttcagtaaaagtatcatgtaaagcatcaggaggaacatttagtacatacgcaatatcatgggtaagacaagcaccaggacaaggattagaatggatgggaggaataataccaagttttagtatgagtaattatgcacaagattttcaaggaagattaacaataacagcagatgaatcaacatcaagtgtatacatggaattaaactcattaagaagcgaagacacagcagtatactattgtgcaagagattttccaagatttcacagattagtaggaaattatgatttctggagaggaacattagacagattctcatatatggatttatggggaagaggaacagcagtaacagtatcaagtgcaagcacaaaagga

SEQ ID NO: 50458 - RNA, 423 nt, synthetic construct
  misc_feature 1..423: note = derived and/or modified sequence opt6 from anti-HIV_Chain
  source 1..423: mol_type = other RNA
ctagtacaattagtagaatcaggaggaggagtagtacaaccaggaagatcattaagattatcatgtgcagcatcaggatttacattttcaacatatgcaatgcattgggtaagacaagcaccaggaaaaggactagaatgggtagcagtaatatcatatgatggatcaaataaattctatgcagattcagtaaaaggaagatttacaatatcaagagacaatagtaaaaacacactatatttacaaatgaactcattaagagcagaagatacagcagtatattactgtgcaagaccaaaattcttaccaggagcagatatagtagtagtagtagcagcaacaccatttgactattggggacaaggaaatccaggacatagattactatcatttcatcaaggaccaataggattaccaccagga

SEQ ID NO: 50459 - RNA, 423 nt, synthetic construct
  misc_feature 1..423: note = derived and/or modified sequence opt6 from anti-HIV_HeavyChain
  source 1..423: mol_type = other RNA
atggaatggagtggagtatttatatttttattaagtgtaacagcaggagtacatagtgaagtacaattagtagaaagtggaggaggattagtaaaaccaggaggaagtttaagattaagttgtgcagcgagcggatatacattcagtaattattggataggatgggtaagacaagcaccaggaaaaggattagaatggataggagatatatatccaggaggaaattatataagaaataatgaaaaatttaaagataaaacaacattaagtgcagacacaagtaaaaatacagcatatttacaaatgaatagtttaaaaacagaagatacagcagtatattattgtggaagtagttttggaagtaattatgtatttgcatggtttacatactggggacaaggaacattagtaacagtaagtagt

SEQ ID NO: 50460 - RNA, 423 nt, synthetic construct
  misc_feature 1..423: note = derived and/or modified sequence opt6 from anti-HIV_HeavyChain
  source 1..423: mol_type = other RNA
atggaatggagcggagtatttatatttctattaagtgtaacagcaggagtacactcacaagtacaattagtacaaagcggaccagatgtaaaaaaaccaggaacaagtatgaaaatgagctgtaaaacaagcggatacacattctcaaactattggataggatgggtaagacaagcaccaggacaaggactagaatggataggagatatatatccaggaggaaattacatacgaaataacgaaaaatttaaagataaaacaacactaacagcagacacaagcacaagtacagcatatatgcaactaggaagcttaagatcagaagatacagcagtatattactgtggatcaagttttggatcaaactatgtatttgcatggttcacatactggggacaaggaacactagtaacagtaagctca

SEQ ID NO: 50461 - RNA, 429 nt, synthetic construct
  misc_feature 1..429: note = derived and/or modified sequence opt6 from anti-HIV_Chain
  source 1..429: mol_type = other RNA
caagtattcgtacaattagtacaaagcggaggaggattagtacaaccaggaggaagcgtaagattaagttgtacagcaagtggattcttattctcaacatatagtatgaactgggtaagacaagcaccaggaaaaggactagaatgggtaagctcaatatcaacaacaagcaattacatatactatgcagatagtgtaaaaggaagatttacaataagcagaagcaatggacaaggatcactatatctacaactaaatagtttaagagtagaagatacagcagtatattactgtgcaagagacacaaaagtaggagcaccaagacaagattgctatgcaatggacttatggggacaaagagaccatggacatagattactatcattccatcaaggaccaataggattaccaccaggagcactattacaa

SEQ ID NO: 50462 - RNA, 432 nt, synthetic construct
  misc_feature 1..432: note = derived and/or modified sequence opt6 from anti-HIV_Chain
  source 1..432: mol_type = other RNA
ataatattattcttagtagcaacagcaacaggagtacactcagacatacaaatgacacaatcaccatcatcactatccgcatcagtaggagacagagtaacaataacctgcagagcatcacaatcaatagaccgatacctaaactggtaccaacacaaaccaggaaaagcaccaaaactactaatatacgcagcatcaaacctacacacagacgtaccatccagattctcaggatccggagcaggaacatacttcacactaacaataacatcactacaaccagaagacttcgcaacatactactgccaacaatcacactcaccatcattcggacaagaatcctactcaatagcattcggacaaggaacaagactagaaataaaaagaacagtagcagcaccatcagtattcatattcccaccatcagacgaa

SEQ ID NO: 50463 - RNA, 432 nt, synthetic construct
  misc_feature 1..432: note = derived and/or modified sequence opt6 from anti-HIV_Chain
  source 1..432: mol_type = other RNA
ttacaacaattacaagtaccaagattaagcatgtggagagtatttaaagtagcagcagcaacaggagcacaaacattaacagtagaagaacctggaagttcagtaaaagtatcatgtaaagcatcaggaggaagttcaacagcatatggatatagttgggtaagacaagcaccaggacaaggatttgaatggatgggaagaataataccattttatggaataataacatatgcaccaaaatttcaaggaagagtaacaataacagcagatagatcaacatcaacagtatatatggaattaacatcattaacatttgcagatacagctttattcttttgtgcaagagattttggagatccaagaaatggatattattttgatagttgggatcaaggactatggttaacagtatcaagcgcaagtacaaaagga

SEQ ID NO: 50464 - RNA, 432 nt, synthetic construct
  misc_feature 1..432: note = derived and/or modified sequence opt6 from anti-HIV_Chain
  source 1..432: mol_type = other RNA
caagtaagattagaacaaagcggagtagcaatgagaaaaccaggagcaagcgtaacattaagctgtcaagcaagcggatacaatttcgtaaaatatataatacactgggtaagacaaaaaccaggattaggattcgaatgggtaggaatgatagatccatatagaggaagaccatggtcagcacataaatttcaaggaagattaagtttaagcagagacacaagcatggaaatactatatatgacattaacaagtttaaaatcagacgacacagcaacatatttctgtgcaagagcagaagcagcaagcgatatacatagcagaccaataatattaacaggaccaggagaatatggattagacttagaacatatggattggacatggagaatactatgcttactagcagtagcaccagggtgccatagtcaa

SEQ ID NO: 50465 - RNA, 435 nt, synthetic construct
  misc_feature 1..435: note = derived and/or modified sequence opt6 from anti-HIV_Chain
  source 1..435: mol_type = other RNA
atgttcttattcttagtagcaggagcaacaggagtacaaagtcaagtatatttagtaccatttggaccagaagtaaaaaaaccaggaagctcagtaaaagtatcatgtaaagcaagtggagatagttttacatcaagtgtaataacatgggtaagacaagcaccaggacaaggaccagaatggatgggaagagtaataccagtattaggagtagcagcatatgcacaaaaattttatggaagagtaacaataacagcagatacatcaagtaatacagcatacatggaagtaaattcattaagatttgaagacacagcagtatattattgtgcaagagaaacaggaagaggaggaaatttagcactaagacaatatttttttgacagttggggacaaggaacattagtaacagtatcaagtccaagcacaaaagga

SEQ ID NO: 50466 - RNA, 438 nt, synthetic construct
  misc_feature 1..438: note = derived and/or modified sequence opt6 from anti-HIV_Chain
  source 1..438: mol_type = other RNA
caagtacaattacaagaatcaggaccaggattagtaaaaccatcaggaacattatcattaacatgtgcagtaagcggagcctcaatatcatcaagaaactggtggacatgggtaagacaaccaccaggaaaaggactagaatggataggagaaatatacgaatcaggagcaacaaactataacccatcattaaaatcaagagtaacaatatcagtagacaaaagcaaaaaccaattctcactaagactaacatcagtaacagcagcagatacagcagtatatttctgtgcaagactaatgacatttggaggactaataggaacactagactactggggacaaggaacattagtaacagtactacaaccaccaccaagagcacacagatatcacccaagaaacctactacaagaacacttatgcgcaagagtaatgcca

SEQ ID NO: 50467 - RNA, 444 nt, synthetic construct
  misc_feature 1..444: note = derived and/or modified sequence opt6 from anti-HIV_HeavyChain
  source 1..444: mol_type = other RNA
atggaatggagcggagtatttatatttctattaagcgtaacagcaggagtacactcagaagtacaattagtagaaagcggaggaggattagtaaaaccaggaggaagcctaagattaagttgtgcagcaagcggatacacattcagtaattattggataggatgggtaagacaagcaccaggaaaaggactagaatggataggagatatatatccaggaggaaattacataagaaataacgaaaaatttaaagataaaacaacattaagcgcagacacaagcaaaaacacagcatatttacaaatgaatagcttaaaaacagaagatacagcagtatattactgtggatcgagttttggatcaaactatgtatttgcatggttcacatactggggacaaggaacattagtaacagtaagctcaggagaaagcctaaaaccatta

SEQ ID NO: 50468 - RNA, 444 nt, synthetic construct
  misc_feature 1..444: note = derived and/or modified sequence opt6 from anti-HIV_HeavyChain
  source 1..444: mol_type = other RNA
atggaatggagcggagtatttatatttctattaagcgtaacagcaggagtacactcacaagtacaattagtacaaagcggaccagatgtaaaaaaaccaggaacaagcatgaaaatgagctgtaaaacaagcggatacacattctcaaactattggataggatgggtaaggcaagcaccaggacaaggactagaatggataggagatatatatccaggaggaaattacataagaaataacgaaaaatttaaagataaaacaacattaacagcagacacaagcacaagcacagcatatatgcaactaggaagtttaagatcagaagatacagcagtatattactgtggatcaagctttggatcaaactatgtatttgcatggttcacatactggggacaaggaacactagtaacagtaagttcaggagaaagcttaaaaccacta

SEQ ID NO: 50469 - RNA, 447 nt, synthetic construct
  misc_feature 1..447: note = derived and/or modified sequence opt6 from anti-HIV_Chain
  source 1..447: mol_type = other RNA
caagcaagactagatcaatggggaacaggattactaaaaccatcagaaacactatcattaaaatgcgcagtatttggagtactatttacagattacaattggacatgggtaagacaatcaccaggaaaaggactagaatggataggacacttagaccatagaggaggaggaaactataacccatcactagaatcaagagtaacaatatcattagactattcaaaagcacaattctcactacatctaaaatcagtaacagtagcagatacagcactatattactgtgcaggagcagtaaaaggattctggttcgatgaagtatacaattggtttggaccaggagtaagagaaccatggctaccatcaccacaaccaccaccaagagcacacagatcatcaccatggcacccaccaccaagagcaccattagtaacagcaacagtacca

SEQ ID NO: 50470 - RNA, 447 nt, synthetic construct
  misc_feature 1..447: note = derived and/or modified sequence opt6 from anti-HIV_Chain
  source 1..447: mol_type = other RNA
caagcacgactagaccaatggggaacaggattattaaaaccatcagaaacactatcactaaaatgcgcagtatttggagtactattcacagattacaattggacatgggtaagacaatcaccaggaaaaggattagaatggataggacacttagaccatagaggaggaggaaactataacccatcattagaatcaagagtaacaatatcattagactactcaaaagcacaattttcactacacttaaaatcagtaacagtagcagatacagcattatattactgtgcaggagcagtaaaaggactatggttcgatgaaacatacacatggtttggaccatggtcacaaggaacaagagtaacagtagcatcagcatcaacaaaaggaccatcagtatttccattagcaccatcaagtaaatcaacatcaggaacaagagacctatca

SEQ ID NO: 50471 - RNA, 447 nt, synthetic construct
  misc_feature 1..447: note = derived and/or modified sequence opt6 from anti-HIV_Chain
  source 1..447: mol_type = other RNA
gcagcaagattagaccaatggggaacaggactagtaaaaccaagcgaaacattaagcttaaaatgtgcagtattcggagtagatttcccagactatacatggacatgggcaagacaagcaccaggaaaaggactagaatggataggacatagagatcacagaggaggaagttcatataatccatcactatcaggaagagcaacaatatcattagatacatcaaaagcacaatttagtttacacataaaatcagtaacagtagcagacacagcaacatactattgtgcaggagcagtagcaggattatggtttgaagatgcatataactggttcggaccatggagtcaaggaacattagtaacagtagcagcagcatcaacaaaaggaccaagcgtattcccattagcaccatcaagtaaaagcacaagcggacatgcaagcgtacta

SEQ ID NO: 50472 - RNA, 450 nt, synthetic construct
  misc_feature 1..450: note = derived and/or modified sequence opt6 from anti-HIV_Chain
  source 1..450: mol_type = other RNA
ttagcacaactagaacaaagcggaggaggagtagtaaaaccaggcggaagcttaagattaccatgtgcagcaagcggattcacattcatagactattacatggcatggataagactagcaccaggaaaaggactagaatggctaagctatatatcaaaaaatggagattacacaaaatatagcgaaagcttaaaaggaagatttacaataagcagagacaatgcaaaaaacctagtaatattacaactaaatagattaagagcagacgatacagcaatatatttctgtgcaagagcagatggattaacatatttcggagaattattacaatacatattcgatctatggggacaaggagcaagagtaatagtaagttcagcatcaacaaaaggaccaagcgtattcccactagcaccatcaagcaaaagcacaagcggacacgcaagtgta

SEQ ID NO: 50473 - RNA, 459 nt, synthetic construct
  misc_feature 1..459: note = derived and/or modified sequence opt6 from anti-HIV_Chain
  source 1..459: mol_type = other RNA
caagtacaattagtacaaagcggagcagaagtaaaaaaaccaggagcaagcgtaaaagtaagctgtaaagtaagcggatacacattaacagaattaagcatacactgggtaagacaagcaccaggaaaaggactagaatggatgggaggattcgatagtgaagacggagaagcaatatataaacaaaactttcaaggaagagtaacaatgacagaagacacatcaacagacacagcatatatggaactatcaagactaagatcagaagatacagcagtatattactgtgcaacagcagatagatttaaagtagcacaagacgaaggattattcgtaatatttgactattggggacaaggaaacccaggacatagattactatcactacatcaagggccaataggattaccaccaggaacattaccaccaaaagcaacaagcggacacgcagcaagaaga

SEQ ID NO: 50474 - RNA, 462 nt, synthetic construct
  misc_feature 1..462: note = derived and/or modified sequence opt6 from anti-HIV_Chain
  source 1..462: mol_type = other RNA
ctagtacaattagtacaaagcggagcagaagtaaaaaaaccaggagcaagcgtaaaagtaagctgtaaagtaagcggatactcactaacagaactatcaatacactgggtaagacaagcaccaggaaaaggactagaatggatgggaggattcgatagcgaagacggagaagcaatatataaacaaaactttcaaggaagagtaacaatgacagaagacacaagtacagacacagcatatatggaactatcacgattacgatcagaagatacagcagtatattactgtgcaacagcagatccatttaaagttgcacaagacgaaggattattcgtaatatttgactattggggacaaggaacaacaggacatagattactatcattacatcaaggaccacatagattatactcactaggaacattattatcaagagcaccaatagtacaaacacatatggca

SEQ ID NO: 50475 - RNA, 471 nt, synthetic construct
  misc_feature 1..471: note = derived and/or modified sequence opt6 from anti-HIV_Chain
  source 1..471: mol_type = other RNA
caaatacacctagtacaatcaggaaccgacgtaaaaaaaccaggatcatcagtaacagtatcatgcaaagcctacggagtaaacacattcggactatacgcagtaaactgggtaagacaagcaccaggccaatcattagaatacataggacaaatatggagatggaaatcatcagcatcacaccacttcagaggaagagtactaatatcagccgtagacctaacaggatcatcaccaccaatatcatcactagaaataaaaaacctaacatcagacgacacagcagtatacttctgcacaacaacatccacatacgaccaatggtcaggactacaccacgacggagtaatggcattctcatcaagaggacaaggcacattaatatcagtatcagcagcatcaacaaaaggaccatcagtatttccactagcaccatcctcaaaatcaacatacggactagcacacgtacta

SEQ ID NO: 50476 - RNA, 477 nt, synthetic construct
  misc_feature 1..477: note = derived and/or modified sequence opt6 from anti-HIV_Chain
  source 1..477: mol_type = other RNA
caacatcaattagtaccatgtgtagcagaagtaagaaaaccaggagcaagtgtaaaagtaagttgtaaagtaagtggatatacattaacagaaataagtatgcattgggtaagacaagcaccaggaaaaggattagaatggatgggaggatttgatagagaagatggagaaacaatatatgcacaaaaatttcaaggaagagtaacaatgacagaagatacaagtacagatacagcatatatggaattaagtagtttaagaagtgaagatacagcagtatattattgtgcaacaacatatttagcagtagtaccagatggatttgatggatattcaagtagttggtattggtttgatccatggggacaaggaacattagtaacagtaagtagtgcaagtatgcaaggaccaatgttattaagcccaacaggaacattattaccaagagcacctctagtacaaacaagaccaggacca

SEQ ID NO: 50477 - RNA, 642 nt, synthetic construct
  misc_feature 1..642: note = derived and/or modified sequence opt6 from anti-HIV_LightChain
  source 1..642: mol_type = other RNA
gacatagtaataacacaatcaacaaaattcatgagcacatcagtaggcgacagagtaagcataacctgcaaagcatcacaagacgtatcaacagcagtagcatggtatcaacaaaaaccaggacaatcaccaaaattactaatatactgggcaagcacaagacacacaggagtaccagacagattcacaggatcaggctcaggaacagactacacactaacaatatcaagagtacaagcagaagacctagcattatattactgccaacaacactacacaaccccatggacattcggcggcggaacaaaactcgaaataaaacgaacagtagcagcaccatcattcgtaatattcccaccaagcgacgaacaattaaaatcaggaacagcatcagtagtatgcctactaaataacttctacccaagagaagcaaaagtacaatggaaagtagacaacgcactacaaagcggaaactcacaagaaagcgtaaccgaacaagatagtaaagactcaacatactcattatcatccacactaacactatcaaaagcagactacgaaaaacacaaagtatacgcatgcgaagtaacacaccaaggactatcatcaccagtaacaaaatcattcaacagaggagaatgc

SEQ ID NO: 50478 - RNA, 651 nt, synthetic construct
  misc_feature 1..651: note = derived and/or modified sequence opt6 from anti-HIV_Chain
  source 1..651: mol_type = other RNA
caatcagtactaacccaaccaccatcagtatcagcagcaccaggacaaaaagtaacaatatcatgctcaggatcttcatcaaacataggaaacaactacgtactatggtaccaacaattcccaggaacagcaccaaaactattaatatacggaaacaacaaacgaccatcaggaattccagacagattctcaggctcaaaatccggaacatcagcaacactaggaataacaggactacaaaccggagacgaagcagactacttctgcgcaacatgggactccggcctatccgcagactgggtattcggcggaggaacaaaattaacagtactatcacaaccaaaagcagccccatcagttactttattccccccatcctcagaagaactacaagcaaacaaagcaacactcgtatgcctaatatcagacttctacccaggagcagtaacagtagcatggaaagcagattcctcaccagtaaaagccggagtagaaacaacaacaccatcaaaacaatccaacaacaaatacgcagcatcatcctacctctcactaacaccagaacaatggaaatcacacagatcatactcctgccaagtaacacacgaaggctcaacagtagaaaaaacagtagcaccaacagaatgctcc

SEQ ID NO: 50479 - RNA, 657 nt, synthetic construct
  misc_feature 1..657: note = derived and/or modified sequence opt6 from anti-HIV_Chain
  source 1..657: mol_type = other RNA
gacatagtaatgacacaaagcccagactcactcgcagtatccctaggagaaagagtcacaatgaactgcaaatcatcacaatcactactatactcaacaaaccaaaaaaactacctagcatggtatcaacaaaaaccaggccaatcaccaaaactactaatatactgggcaaactcaacagaatcaggagtaccagacagattttcaggatcaggatccggaacagatttcacactaacaatctcaagcgtacaagcagaagacgtagcagtatactactgccaacaatactactcatacagaacattcggcggaggaacaaaattagaaataaaaagaacagtagcagcaccatcagtattcatattcccaccatcagacgaacaattaaaatcaggaacagcatcagtagtctgtttactaaacaacttttacccaagagaagcaaaagtacaatggaaagtagacaacgcactacaatcaggaaattcacaagaatccgtaacagaacaagactcaaaagactcaacatactcactatcatcaacactaacattatcaaaagccgattacgaaaaacataaagtatacgcctgcgaagtaacacaccaaggactatcatcaccagtaacaaaatcattcaaccgaggagaatgc

SEQ ID NO: 50480 - RNA, 753 nt, synthetic construct
  misc_feature 1..753: note = derived and/or modified sequence opt6 from anti-HIV_SingleChain
  source 1..753: mol_type = other RNA
atgcaagtacaattagaacaaagcggagcagaagtaaaaaaaccaggagcaagcgtaaaagtaagttgtcaagcaagtggatatagattttcaaattttacagtacactgggttagacaagcaccaggacaaaggtttgaatggatgggatggataaatccatataatggaaataaagaatttagtgcaaaatttcaagatagagtaacatttacagcagatacaagtgcaaatacagcatatatggaattgagatcattaaggtcagcagatacagcagtatattattgcgcaagagtaggagaatggggatgggacgatagtccacaagataattattatatggatgtatggggaaaaggaacaacagtaatagtaagttctggaggaggaggatcgggaggaggaggaagtggaggagggggaagtgatatagaattaacacaaagtccgggaacattatcattaagcccaggagaaagggcaacattttcatgtagaagtagtcattcaataagaagtaggagagtagcatggtatcaacataaaccaggacaagcaccaagattagtaatccatggagtaagtaatagagcaagtgggataagtgatagatttagtggcagtggaagtggaacagactttacattaacaataacaagagtagaaccagaagattttgcattatattattgtcaagtatatggagcaagtagttatacatttggacaaggaacaaaactagaacgaaaa

SEQ ID NO: 50481 - RNA, 1338 nt, synthetic construct
  misc_feature 1..1338: note = derived and/or modified sequence opt6 from anti-HIV_LightChain
  source 1..1338: mol_type = other RNA
gaagtaaaactagaagaatccggaggcggcctagtacaaccaggaggttcaagaaaattatcgtgcgcagcatctggattcaccttttcatccttcggcatgcattgggtacgtcaagctcccgaaaaaggactagaatgggtagcatacatttcttcaggctcctcaacactacattacgcagacacagttaaaggacgctttacaatatcacgagataacccaaaaaatacactattcttacaaatgaaattaccatcattatgttacggactactaggctccagaaatctatcacacagactactatcacaaaatgacacacccatatgcctaacagtttcatccgcctcaacaaaaggcccatcagtattcccactagcaccctcctccaaaagtacatcaggaggcacggctgcactaggatgcttagtcaaagactactttccagaaccagtaacagtatcatggaactctggagcccttacctcaggagtacatacatttccagccgttttacaatcatcaggattatactcattatcctcagtagtaacagtaccatcatcatcactcggcacacaaacatacatttgtaacgtaaaccataaaccttcaaatacaaaagtagacaaaaaagtagaaccaaaatcttgcgacaaaacacatacctgcccaccatgcccagcaccagaattacttggaggaccatcagtattcctattcccacctaaaccaaaagacacacttatgataagtcgaacaccagaagtcacctgcgtagtagtagacgtaagccatgaagatccagaagtaaaatttaactggtatgttgacggagtagaagtacacaacgcaaaaacaaaacccagagaagaacaatacaactcaacatatcgagtagtatctgtattaacagtactacaccaagactggctaaacggcaaagaatataaatgcaaagtttcaaacaaagcacttccagcaccaatagaaaaaacaatatcaaaagcaaaagggcaacccagagaaccacaagtatatacactccctccatctagagaagaaatgaccaaaaaccaagtctctctaacctgcctagttaaaggcttttatcccagtgacatagccgtagaatgggaatcaaacggacaaccagaaaataattacaaaacaacacccccagtactagactctgatggaagcttcttcctatactctaaactaacagtcgataaatctagatggcaacaaggaaacgtattctcatgctcagtaatgcacgaagcattacacaatcactacacacaaaaatcactatccctttcaccaggaaaa

SEQ ID NO: 50482 - RNA, 1380 nt, synthetic construct
  misc_feature 1..1380: note = derived and/or modified sequence opt6 from anti-HIV_Chain
  source 1..1380: mol_type = other RNA
gaagtacaactagtagaaagtggaggaggactagtcaaaccaggaggatccctacgactaacatgtgtagcatcaggattcacattctcagacgtatggctaaactgggtacgacaagctccaggaaaaggattagaatgggtcggcagaattaaaagccgtaccgacggtggaacaacagactacgcagcatcagttaaaggacgattcaccatatcacgagatgactcaaaaaacacattatatttacaaatgaatagtctaaaaacagaagatactgctgtatactcatgcacaacagacggcttcataatgatcagaggagtatcagaagattactattactactacatggacgtatggggaaaaggtacaacagtaacagtatcaagcgcttcaacaaaaggcccatcagtttttccactagcaccatcttccaaatcaacatcaggaggaaccgcagcactaggatgtctagtaaaagactacttccccgaaccagtcacagtatcctggaattcaggagcccttacatccggagttcacacattcccagcagtattacaatcaagtggactatattctctctcctcagtcgtaacagtaccatcctcttcattaggaacacaaacatacatatgcaatgtaaaccacaaaccatcaaacactaaagtagataaaaaagtagaacctaaatcgtgtgacaaaacccacacatgtccaccatgcccagcaccagaattactaggaggcccatccgttttcctattcccaccaaaacccaaagacacattaatgataagcagaacacccgaagtcacatgcgtagtagtagatgtatcacacgaagacccagaagttaaattcaattggtacgtagatggagtagaagtacacaacgctaaaacgaaaccccgtgaggaacaatataacagtacatatagagtcgtatcagtattaactgttctccatcaagactggttaaatggtaaagaatacaaatgcaaagtttccaacaaagccttaccagcaccaattgaaaaaacaatatcaaaagcaaaaggtcaaccaagagaaccacaagtctacacattaccaccatcaagagacgaactaacaaaaaaccaagtatcattaacatgtttagtaaaaggtttttacccatcagatattgctgtagaatgggaatccaatggacaacctgaaaacaattataaaacaacaccaccagtactggactcagacggatcatttttcctatactcaaaattaactgtcgacaaatcaagatggcaacaaggcaacgtattctcatgctcagttatgcacgaagcattacacaatcactacactcaaaaatcactatcactatccccagga

SEQ ID NO: 50483 - RNA, 1413 nt, synthetic construct
  misc_feature 1..1413: note = derived and/or modified sequence opt6 from anti-HIV_Chain
  source 1..1413: mol_type = other RNA
atggaatggtctggagtatttatgtttctcctatcagtcacagcaggagtacactcacaagtacaactacaacaatcaggaccagaagtcgtcaaacccggagcatcagtaaaaatgtcatgtaaagcttcaggatacacattcacatcatacgttattcactgggtaagacaaaaacctggacaaggcttagactggattggatatataaatccatacaacgacggaacagattacgatgaaaaatttaaaggcaaagcaacattaacatcagatacatcaacctcaacagcatacatggaactctcatcactaagatcagaagatacagcagtatactactgcgcaagagaaaaagacaactatgctacaggtgcctggttcgcatattggggtcaaggaacattagtaaccgtaagctccgcctcaacaaaaggaccatcagtctttcccctagcaccatcttcaaaatcaacatctggcggcacagctgcacttgggtgcctagtaaaagactattttccagaaccagtaacagtttcatggaattctggagcattaacatcaggggtacacacatttccagccgtcttacaatcttcaggcttatattcattatcttctgtagtaacagtaccatccagttccctaggaacacaaacctacatatgcaacgtaaaccataaaccatcaaacacaaaagtagacaaaaaagtagaaccaaaatcctgcgacaaaacacacacatgtcccccatgccctgcaccagaattcgaaggaggtccatctgtcttcttattccccccaaaaccaaaagacacattaatgatatcaagaactccagaagtaacatgcgtagtagtagatgtctcccatgaagatccagaagtaaaattcaactggtatgtagacggagtagaagtacacaacgccaaaacaaaacccagagaagaacaatacaactccacatacagagtagtaagtgtactaactgtattacatcaagactggctgaatggaaaagaatacaaatgcaaagtatcaaataaagctttaccagcctcaattgaaaaaacaatatccaaagctaaaggacaaccaagagaacctcaagtatacactctccccccgtcaagagatgaattaacaaaaaaccaagtatcactaacctgtctagtaaaaggattttatccatcagacatagcagtagaatgggaatctaacggacaaccagaaaataactataaaacaacaccacccgtactagactcagacggttcattcttcctatactccaaactaactgtagataaatctagatggcaacaaggaaacgtattcagttgttccgtaatgcacgaagcactacacaaccactacacacaaaaatcactatctctttcaccaggaaaa

SEQ ID NO: 50484 - RNA, 645 nt, synthetic construct
  misc_feature 1..645: note = derived and/or modified sequence opt6 from anti-influenza_Fab
  source 1..645: mol_type = other RNA
atagtattaacacaatcaccagccacattaagcgtatcaccaggagaaagagcaacactatcatgccgagcatcacaagtaataagccacaacctagcatggtaccaacaaaaaccaggacaagcaccaagactactcatctacggagcatcaacacgagcatcaggaataccagcaagattctcaggctcaggatctggtacagactacacattaacaataacatcactacaacctgaagacttcgccgtatactactgccaacactacagcaactggccacccagactaacattcggaggaggaacaaaagtagaaataaaaagaacagtagcagcaccaagcgtatttatattcccaccctccgacgaacaattaaaatcaggaacagcatcagtagtatgcctactaaacaacttctaccccagagaagcaaaagtacaatggaaagtagacaacgcattacaatcaggaaactcacaagaaagcgtaacagaacaagactcaaaagactcaacatactcactatcatcaacattaacactatcaaaagcagactacgaaaaacacaaagtatacgcatgcgaagtaacacaccaaggactatcatcaccagtaacaaaatccttcaacagaggagaatgc

SEQ ID NO: 50485 - RNA, 681 nt, synthetic construct
  misc_feature 1..681: note = derived and/or modified sequence opt6 from anti-influenza_Fab
  source 1..681: mol_type = other RNA
gtacaattagtagaatcaggaggaggagtagtacaaccaggcaaatcaccaagactatcatgtgcagcaagcggacccacattctcttcatatgcagtacactgggtaagacaagcaccaggaaaaggactagaatgggtaaccttaataagttacgacggagcaaaccaatactatgcagactcagtaaaaggaagatttacaatatcaagagacaactcaaaaaacacagtctatctacaaatgaattcattaagaccagaagatacagcagtatattactgtgcagtacccggaccagtatttggaatattcccaccttggtcatactttgacaattggggtcaaggtatattagtaacagtatcatcagcatccacaaaaggaccatcagtctttccactagcaccatcatcaaaatcaacatcaggaggaaccgcagcattaggctgtttagtaaaagattactttccagaaccagttacagtatcatggaactcaggcgcattaacatcaggagtacatacatttccagcagtattacaatcatcaggactatattcattatcatcagtagtaacagtaccatcctcatcactaggaacacaaacatatatatgtaacgtaaaccataaaccatcaaatacaaaagtagataaaaaagtagaaccaaaatcatgt

SEQ ID NO: 50486 - RNA, 1515 nt, synthetic construct
  misc_feature 1..1515: note = derived and/or modified sequence opt6 from anti-influenza_Fab
  source 1..1515: mol_type = other RNA
gcaggatcaacggctacattatgtctaggacatcacgcagttccaaatggaacaatagtcaaaacaataacaaatgaccaaatagaagtaacaaatgcaacagaattggtacaatcatccagtacaggcgaaatatgcgactcaccccaccaaatactcgacggaaaaaattgcaccctaattgacgcattattaggtgacccccaatgcgatgggttccaaaacaaaaaatgggatcttttcgtagaaagatccaaagcctacagcaattgctacccctacgacgtaccagactatgcatccctgagaagcctagtagcctcctcaggaacactcgaatttaataatgaatcattcaattggacaggagtaacacaaaatggaacaagcagcgcatgcataagaagaagtaaaaactcattcttctcacgactaaactggttaactcacctcaacttcaaataccctgcacttaatgttacaatgccaaacaacgaacaattcgacaaactatatatatggggagttcatcacccaggaacagacaaagaccaaatattcctatacgcacaagcatcaggcagaataaccgtatcaacaaaaagatcacaacaaacagtaagtccaaacataggatcaaggcccagagtccgaaatataccttcaagaatcagcatatactggacaatagttaaaccaggagatatattactaataaacagtacaggaaacctaattgcccccagaggatatttcaaaataagatccggaaaatcatcaataatgcgatccgacgcaccaataggaaaatgcaactcagaatgcataacaccaaatggatcaatcccaaacgacaaaccattccaaaatgttaaccgaataacatacggagcatgtccaagatatgtaaaacaaaatacactcaaactagcaacaggtatgcgcaacgtaccagaaaaacaaacacgaggaatattcggcgccatagcaggattcatagaaaacggatgggaaggaatggtagacggatggtatggattcagacaccaaaacagcgaaggacgaggacaagcagcagacttaaaaagtacacaagcagcaatagaccaaataaatggaaaactaaatcgattaataggtaaaaccaatgaaaaattccaccaaatagaaaaagaattttcagaagtagaaggacgaatacaagacctagaaaaatacgtagaagacaccaaaatagatttatggagctataacgcagaattactagtagcattagaaaaccaacatacaatagatctcacagattccgaaatgaacaaactattcgaaaaaacaaaaaaacaattacgagaaaatgcagaagacatgggcaatggatgcttcaaaatataccataaatgcgacaatgcatgcataggatcaataagaaatggaacgtacgaccacgatgtatatagagacgaagcactaaacaacagattccaaataaaaggatcaggaagactagtaccacga

SEQ ID NO: 50487 - RNA, 657 nt, synthetic construct
  misc_feature 1..657: note = derived and/or modified sequence opt6 from anti-influenza_Fab
  source 1..657: mol_type = other RNA
caagtacaattagtacaatcaggaggaggagttgtacaaccaggtagatctctaagactatcatgcgcagcatcagaatttacatttagaatgtacgcaacacattgggtaagacaagcaccaggaaaaggattagaatgggtagcactaatatcatatgacggttccaataaatattacgcagactcagtaaaaggaagatttacaatatcaagagataactctatgaatacagtttacttacaaatgaacacactaagaccagaagacacagcagtatactattgcgctagagatttaggaggatatttcataagaggaataatggacgtatggggacaaggaacattagtaacagtatcaagcgcatcaacaaaaggaccatcagtatttccattagcaccatcaagcggaggaacagcagcattaggctgtctcgtaaaagattactttccagaacccgtaacagtatcatggaactcaggagcactaacaagtggagtacatacctttccagctgtcttacaatcatcaggattatatagtttatcatcagtagtaacagtaccatcatcatcactaggaacacaaacatatatatgtaacgtaaaccataaaccatcaaatacaaaagtagataaaagagtagaaccaaaa

SEQ ID NO: 50488 - RNA, 642 nt, synthetic construct
  misc_feature 1..642: note = derived and/or modified sequence opt6 from anti-influenza_Fab
  source 1..642: mol_type = other RNA
gaactacaaatgacccaaagcccatcaagcgtatcagcatcagtaggcgaccgagtaacaataacatgcagagcaagccaaggaatatcatcttggctagcatggtaccaacaaaaaccaggaaaagcaccaaaattactaatatacgcagcatcatcactacaaagcggagtaccttcaagattctcaggatcaggatcaggaacagacttcacactaacaatatcctcactacaaccagaagacttcgcaacatactactgccaacaagcaaactcattcccactcacattcggaggcggaacaaaagtagaaataaaaagaacagtagcagcaccatcagtattcatattcccaccatcagacgaacaactaaaatcaggaacagcatcagtagtatgcctactaaacaacttctacccaagagaagcaaaagtccaatggaaagtagacaacgcattacaaagcggaaactcacaagaaagcgtaacagaacaagactccaaagactcaacatattcactatcctccacactaacactatcaaaagccgactacgaaaaacataaagtatacgcatgcgaagtaacacaccaaggattatcatcaccagtaaccaaatcattcaacagaggagaatgc

SEQ ID NO: 50489 - RNA, 993 nt, synthetic construct
  misc_feature 1..993: note = derived and/or modified sequence opt6 from anti-influenza_Fab
  source 1..993: mol_type = other RNA
gcagacccaggtgacacaatatgcataggataccacgcaaataactcaacagacacagtagacacagttttagaaaaaaatgtaacagtaacacattccgtaaacttactagaagactcacacaacggaaaactatgtaaacttaaaggaatagcaccattacaactaggaaaatgcaatatagcaggatggctactaggaaacccagaatgcgacctattactaacagcaagcagttggtcatacatagtagaaacatcaaactcagaaaacggcacttgctacccaggagacttcatagactacgaagaattaagagaacaattatcatctgtatcatcattcgaaaaattcgaaatattcccaaaaacaagctcatggcctaaccacgaaacaacaaaaggagtaacagcagcatgctcatatgcaggcgcatcatcattctaccgaaacttactatggctaacaaaaaaaggatcatcatatccaaaattatcaaaaagctacgtaaacaacaaaggaaaagaagtcctagtcttatggggcgtacaccacccaccaacaggaacagaccaacaatccctataccaaaatgcagacgcatacgtatcagtcggtagctcaaaatacaatagaagattcacaccagaaatagcagcaagaccaaaagtaagagaccaagcaggaagaatgaactactactggacactattagaacccggagacacaataacattcgaagcaaccggaaatttaatcgcaccatggtatgcattcgcactcaacagaggatcaggatcaggaatcataacctcagacgcaccagtacacgactgtaacacaaaatgccaaacaccacacggagcaataaactcctcattaccattccaaaacatacacccagtaacaataggagaatgtcccaaatacgtaagatcaacaaaattacgaatggcaacaggattaagaaatataccctccatacaatcacgc

SEQ ID NO: 50490 - RNA, 537 nt, synthetic construct
  misc_feature 1..537: note = derived and/or modified sequence opt6 from anti-influenza_Fab
  source 1..537: mol_type = other RNA
ggactattcggagcaatagcaggattcatagaaggaggatggacaggaatgatagacggatggtacggataccaccaccaaaacgaacaaggaagcggatacgcagcagaccaaaaaagcacacaaaatgcaatagacggaataacaaacaaagtaaacagcgtaatagaaaaaatgaacacacaattcacagcagtaggaaaagaattcaacaacttagaaagaagaatagaaaacctaaacaaaaaagtagacgatggattcttagacatatggacatacaatgcagaattactagtactactagaaaacgaacgaacactagatttccacgactcaaacgtaagaaacctatacgaaaaagtaaaaagccaattaaaaaacaacgcaaaagaaataggaaacggatgcttcgaattctaccacaaatgcgacgacgcatgcatggaatcagtaagaaacggaacatacgactacccaaaatactcagaagaaagcaaactaaacagagaagaaatagacggagtatcaggaaga

SEQ ID NO: 50491 - RNA, 642 nt, synthetic construct
  misc_feature 1..642: note = derived and/or modified sequence opt6 from anti-influenza_Apo
  source 1..642: mol_type = other RNA
caatcagtactaactcaaccaccatcagtatcagtagcaccaggacaaacagcaagaataacatgcggaggaaacgacataggaagaaaatcagtacactggaaccaacaaaaaccaggacaagcaccagtactagtagtatgctacgactcagacagaccatcaggaataccagaaagattcagtggatcaaactcaggtaacacagcaacactcacaatatcacgagtagaagcaggagacgaagcagactactactgccaagtatgggactcttcatcagaccacgtaatattcggaggaggaacaaaactaacagtactaggacaaccaaaagccgcaccaagtgtaacactattcccaccatcatcagaagaactacaagcaaacaaagcaacactagtatgcttaatatcagacttctacccaggagcagtaacagtagcatggaaagcagactcatcaccagtaaaagcaggagtagaaacaacaacaccatctaaacaatcaaacaacaaatacgcagcatcatcatacttatcactaacaccagaacaatggaaatcacacagatcatacagctgccaagtaacacacgaaggctcaacagtagaaaaaacagtagcacctacagaatgctca

SEQ ID NO: 50492 - RNA, 687 nt, synthetic construct
  misc_feature 1..687: note = derived and/or modified sequence opt6 from anti-influenza_Apo
  source 1..687: mol_type = other RNA
gaagtacaattagtacaaagcggagcagaagtaaaaaaaccaggagcatcagtaaaagtatcatgcaaagcatcaggatatacatttacagattaccacataaattgggtaagacaagcaccaggacaaggactagaatggatgggatggatacacccaaacagcggagacacaaattacgcacaaaaattccaaggatgggtaacaatgacaagagatacagcaatatcaaccgcatacatggaagtaaatggactaaaatcagatgacacagcagtatactattgcgccagaggaggattagaaccaagaagtgtagattactattactatggtatggacgtatggggacaaggaacaactgtaactgtatcatcagcatcaacaaaaggaccctcagtctttcccttagcaccatcatcaaaatcaacatcaggaggaacagcagcactaggatgtctagtaaaagattactttccagaaccagtaacagtatcatggaacagcggagcattaacatcaggagtacatacattcccagcagtattacaatcatcaggactatattcactatcatcagtagtaacagtaccatcatcaagtctaggaacacaaacatatatatgtaacgtaaaccataaaccatcaaatacaaaagtagataaaagagtagaaccaaaatcatgt

SEQ ID NO: 50493 - RNA, 333 nt, synthetic construct
  misc_feature 1..333: note = derived and/or modified sequence opt6 from anti-influenza-A_kappa_LightChain_V-Region
  source 1..333: mol_type = other RNA
gacatagtaatgacacaatcaccagactcactagcagtatcactaggagcaagagcaacaataaactgcaaatcatcacaatcagtaacattcaactacaaaaactacctagcatggtaccaacaaaaaccaggacaaccaccaaaagtactaatatactgggcatcagcaagagaatcaggagtaccagacagattctcaggatcaggatcaggaacagacttcacactaacaataagctcactacaagcagaagacgtagcagtatactactgccaacaacactacagaacaccaccaacattcggacaaggaacaaaagtagaaataaaa

SEQ ID NO: 50494 - RNA, 333 nt, synthetic construct
  misc_feature 1..333: note = derived and/or modified sequence opt6 from anti-influenza-A_kappa_LightChain_V-Region
  source 1..333: mol_type = other RNA
gacatagtaatgacacaatcaccagactcactagcagtatcactaggagaaagagcaacaataaactgcaaatcatcacaatcagtatcatcaaacaacaaaaactacttagcatggtaccaacaaaaaccaggacaaccaccaaaagtactaatatactgggcatcagcaagagaatcaggagtaccagacagattctcaggatcaggatcaggaacagacttcacactaacaatatcatcactacaagcagaagacgtagcagtatactactgccaacaacactacagaacaccaccaacattcggacaaggaacaaaagtagaaataaaa

SEQ ID NO: 50495 - RNA, 333 nt, synthetic construct
  misc_feature 1..333: note = derived and/or modified sequence opt6 from anti-influenza-A_kappa_LightChain_V-Region
  source 1..333: mol_type = other RNA
gacatagtaatgacacaatcaccagacagcctagcagtatcactaggagaaagagcaacaataaactgcagatcatcacaatcagtatcatcaaacaacaaaaacttcctagcatggtaccaagaaaaaccaggacaaccaccaaaagtactaatatactgggcatcagcaagagaatcaggagtaccagacagattctcaggatcaggatcaggaacagacttcacactaacaatatcaggactacaagcagaagacgtagcagtatactactgccaacaacactacagaacaccaccaacattcggacaaggaacaaaagtagaaataaaa

SEQ ID NO: 50496 - RNA, 333 nt, synthetic construct
  misc_feature 1..333: note = derived and/or modified sequence opt6 from anti-influenza-A_kappa_LightChain_V-Region
  source 1..333: mol_type = other RNA
gacatagtaatgacacaatcaccagactcactagcagtatcactaggagaaagagcaacaataaactgcaaatcatcacaatcagtaacattcaactacaaaaactacctagcatggtaccaacaaaaaccaggacaaccaccaaaactactaatatactgggcatcaacaagagaatcaggagtaccagacagattctcaggatcaggatcaggaacagacttcacactaacaatatcatcactacaagcagaagacgtagcagtatactactgccaacaacactacagaacaccaccaacattcggacaaggaacaaaagtagaaataaaa

SEQ ID NO: 50497 - RNA, 339 nt, synthetic construct
  misc_feature 1..339: note = derived and/or modified sequence opt6 from anti-influenza-A_kappa_LightChain_V-Region
  source 1..339: mol_type = other RNA
gacatagtaatgacacaatcaccagattcactagcagtatccctaggagaaagagcaacaataaactgcaaatcatcacaatcagtactatactcatcaaacaacaaaaactacctagcatggtaccaacaaaaaccaggacaaccaccaaaactactaatatactgggcatcaacaagagaatcaggagtaccagacagattctcaggatcaggatccggaacagacttcacactaacaatatcatcactacaagcagaagacgtagcagtatactactgccaacaatactactcaacaccaccaacattcggacaaggaacaaaagtagaaataaaa

SEQ ID NO: 50498 - RNA, 333 nt, synthetic construct
  misc_feature 1..333: note = derived and/or modified sequence opt6 from anti-influenza-A_kappa_LightChain_V-Region
  source 1..333: mol_type = other RNA
gacatacaaatgacacaatcaccagactcactagcagtatcactaggagcaagagcaacaataaactgcaaatcatcacaatcagtaacattcaactacaaaaactacctagcatggtaccaacaaaaaccaggacaaccaccaaaagtactaatatactgggcatcagcaagagaatcaggagtaccagacagattctcaggatcaggatcaggaacagacttcacactaacaatatcatcactacaagcagaagacgtagcagtatactactgccaacaacactacagaacaccaccaacattcggacaaggaacaaaagtagaaataaaa

SEQ ID NO: 50499 - RNA, 387 nt, synthetic construct
  misc_feature 1..387: note = derived and/or modified sequence opt6 from anti-influenza-A_HeavyChain_V-Region
  source 1..387: mol_type = other RNA
caagtacaattagtagaatcaggaggaggagtagtacaaccaggaagatcactaagactatcatgcgcagcatcaggatttacatttagctcatacggaatgcattgggtaagacaagcaccaggaaaaggactagaatgggtagcagtaataagctatgacggaagtaataaatattacgcagactcagtaaaaggaagattcacaatatcaagagataatagcaaaaatacattatacttacaaatgaactcactaagagcagaagacacagcagtatactattgcgcaaaagattcacaactaagaagtctactatatttcgattggttaagccaaggatatttcgattactggggacaaggaacattagtaacagtaagttca

SEQ ID NO: 50500 - RNA, 387 nt, synthetic construct
  misc_feature 1..387: note = derived and/or modified sequence opt6 from anti-influenza-A_HeavyChain_V-Region
  source 1..387: mol_type = other RNA
caagtacaattagtacaatcaggaggaggagtagtacaaccaggaagatcactaagactatcatgcgtagcatcaggatttacattctcaacatacgcaatgcactgggtaagacaagcaccaggaagaggactagaatgggtagcagtaatatcatacgacggaaactataaatattacgcagactcagtaaaaggaagattctcaatatcaagagataactcaaataatacactacacctagaaatgaacacactaagaacagaagacacagcattatactactgcgcaaaagactcacaactaagatcattactatatttcgaatggctatcacaaggatattttgacccatggggacaaggaacattagtaacagtatcatca

SEQ ID NO: 50501 - RNA, 387 nt, synthetic construct
  misc_feature 1..387: note = derived and/or modified sequence opt6 from anti-influenza-A_HeavyChain_V-Region
  source 1..387: mol_type = other RNA
caagtacaattagtacaatcaggaggaggagtagtacaaccaggaagatcactaagactatcatgcgcagcatcaggatttacattctcaacatacggaatgcactgggtaagacaagcaccaggaaaaggactagaatgggtagcagtaatatcatatgacggaaactataaatattacgcagactcagtaaaaggaagattcacaataagtagagataacagtaaaaatacattatacttagaaatgaactcactaagaacagaagacacagcattatactactgcgcaaaagactcacaactaagatcattactatatttcgactggttatcacaaggatatttcgatcactggggacaaggaacattagtaacagtatcatca

SEQ ID NO: 50502 - RNA, 387 nt, synthetic construct
  misc_feature 1..387: note = derived and/or modified sequence opt6 from anti-influenza-A_HeavyChain_V-Region
  source 1..387: mol_type = other RNA
caagtacaattagtacaaagtggaggaggagtagtaccaccaggaagatcactaagattatcatgtgcagcatcaggatttacatttagcacatacggaatgcattgggtaagacaagcaccaggaaaaggattagaatgggtagcagtaataagttatgacggaaattataaatattacgcagacagtgtaagaggaagatttacaatatcaagagataatagtaaaaatacattaaatttagatatgaactcactaagaacagaagacacagcattatattattgtgcaaaagattcacaattaagaagtttattatattttgattggttaagtcaaggatattttgatcactggggacaaggaacattagtaacagtaagttca

SEQ ID NO: 50503 - RNA, 387 nt, synthetic construct
  misc_feature 1..387: note = derived and/or modified sequence opt6 from anti-influenza-A_HeavyChain_V-Region
  source 1..387: mol_type = other RNA
caagtacaattagtagaatcaggaggaggagtagtacaaccaggaagatcactaagactatcatgcgcagcatcaggatttacatttagcacatacgcaatgcattgggtaagacaagcaccaggaaaaggactagaatgggtagcagtaataagctatgacgcaaactataaatattacgcagactcagtaaaaggaagattcacaatatcaagagataacagcaaaaatacactatacttacaaatgaactcactaagagcagaagacacagcagtatactattgcgcaaaagatagccaactaagatcattactatatttcgaatggttaagccaaggatatttcgattactggggacaaggaacattagtaacagtaagctca

SEQ ID NO: 50504 - RNA, 387 nt, synthetic construct
  misc_feature 1..387: note = derived and/or modified sequence opt6 from anti-influenza-A_HeavyChain_V-Region
  source 1..387: mol_type = other RNA
caagtacaattagtagaaagtggaggaggagtagtacaaccaggaagaagcctaagattaagttgtgcagcaagtggatttacattttcaacatatgcaatgcactgggtaagacaagcaccaggaaaaggactagaatgggtagcagtaatatcatatgatggaaattataaatattatgcagatagtgtaaaaggaagatttacaataagtagagataatagtaaaaatacattatatttacaaatgaatagtttaagagcagaagatacagcagtatattattgtgcaaaagattcacaattaagatcattattatattttgaatggttaagtcaaggatattttgatccatggggacaaggaacattagtaacagtatcaagc

SEQ ID NO: 50505 - RNA, 387 nt, synthetic construct
  misc_feature 1..387: note = derived and/or modified sequence opt6 from anti-influenza-A_HeavyChain_V-Region
  source 1..387: mol_type = other RNA
caagtacaattagtacaatcaggaggaggagtagtacaaccaggaagatcactaagactatcatgcgtagcatcaggattcacattctcaacatacgcaatgcactgggtaagacaagcaccaggaagaggactagaatgggtagcagtaatatcatatgacggaaactataaatattacgcagactcagtaaaaggaagattctcaatatcaagagacaactcaaacaatacactacacttagaaatgaacacactaagaacagaagacacagcattatactactgcgcaaaagactcacaactaagatcactattatatttcgaatggctatcacaaggatatttcgacccatggggacaaggaacattagtaacagtaacatca

SEQ ID NO: 50506 - RNA, 330 nt, synthetic construct
  misc_feature 1..330: note = derived and/or modified sequence opt6 from anti-influenza-A_LightChain_V-Region
  source 1..330: mol_type = other RNA
aactttatgctaacacaaccaccatcagcatcaggaacaccaggacaaagagtaacaatatcatgctcaggatcatcatcaaatataggaggaaacacagtacactggttccaacaactaccaggaacagcaccaaaactactaatatatacaaattcactaagaccatcaggagtaccagacagattctcaggatcaaaatcaggaacatcagcatcactagcaatatcaggactacaatcagaagacgaagcagactactactgcgcagcatgggacgactcactaaacggacaagtattcggaggaggaacaaaactaacagtacta

SEQ ID NO: 50507 - RNA, 390 nt, synthetic construct
  misc_feature 1..390: note = derived and/or modified sequence opt6 from anti-influenza-A_HeavyChain_V-Region
  source 1..390: mol_type = other RNA
caagtacaattactagaaagtggaggaggagtagtacaaccaggaagaagcctaagattaagctgtgcagcaagcggattcacattctcaaactatggaatgcactgggtaagacaagcaccaggaaaaggactagaatgggtagcaataatatcattcgatggatcaaaaaaatactatgcaaatagcgtaaaaggaagatcaacaataagcagagacaatagcaaaaacacactatcactacaaatgaatagcttaggaccagaagatacagcactatattactgtgcaaaactaccatcaccatactatttcgatagcagattcgtatgggtagcagcaagcgcattccatttctggggacaaggaatactagtaacagtaagctca

SEQ ID NO: 50508 - RNA, 132 nt, synthetic construct
  misc_feature 1..132: note = derived and/or modified sequence opt6 from anti-influenza_Chain
  source 1..132: mol_type = other RNA
aacgtaccagaatggtcatacatagtagaaaaagcaaacccagcaaacgacctatgctacccaggaaacttcaacgactacgaagaactaaaacacctactatcaagaataaaccacttcgaaaaaatacaa

SEQ ID NO: 50509 - RNA, 162 nt, synthetic construct
  misc_feature 1..162: note = derived and/or modified sequence opt6 from anti-influenza_Chain
  source 1..162: mol_type = other RNA
tcaggaagattagtaccaagaggatcaccaggaagcggatacataccagaagcaccaagagatggacaagcatatgtaagaaaagatggagaatgggtactactaagcacatttttaggaaaaccaataccaaatccattactaggactagatagcacagga

SEQ ID NO: 50510 - RNA, 291 nt, synthetic construct
  misc_feature 1..291: note = derived and/or modified sequence opt6 from anti-influenza_Chain
  source 1..291: mol_type = other RNA
atgtcactattaacagaagtagaaacaccaataagaaacgaatggggatgcagatgcaatggatcaagcgatccattagcaatagcagcaaacataataggaatattacacttaatattatggatactagatagattattctttaaatgtatatatagaagattcaaatacggactaaaaggaggaccatcaacagaaggagtaccaaaaagcatgagagaagaatatagaaaagaacaacaatcagcagtagacgcagacgatggacatttcgtaagcatagaattagaa

SEQ ID NO: 50511 - RNA, 300 nt, synthetic construct
  misc_feature 1..300: note = derived and/or modified sequence opt6 from anti-influenza_Chain
  source 1..300: mol_type = other RNA
atgaacaacgcaacattcaactgcacaaacataaacccaataacacacataagaggatcaataataataacaatatgcgtatcactaatagtaatactaatagtattcggatgcatagcaaaaatattcataaacaaaaacaactgcacaaacaacgtaataagagtacacaaaagaataaaatgcccagactgcgaaccattctgcaacaaaagagacgacatatcaacaccaagagcaggagtagacataccatcattcatactaccaggactaaacctatcagaaggaacaccaaac

SEQ ID NO: 50512 - RNA, 300 nt, synthetic construct
  misc_feature 1..300: note = derived and/or modified sequence opt6 from anti-influenza_Chain
  source 1..300: mol_type = other RNA
gaactaacacaatcaccatcatcactatcagcatcagtaggagactcagtaacaataacatgcagaacatcagaaagaatatcaacatacctaaactggtaccaacaaaaaccaggaaaagcaccaagactattagtatcaggagcatcaacactacaaggaggagtaccatcaagattctcaggatcaggatcaggaacagcattcacactaacaataaactcactacaaccagaagacttcgcaacatactactgccaacaatcatactcaacaccactaacattcggaggaggaaca

SEQ ID NO: 50513 - RNA, 300 nt, synthetic construct
  misc_feature 1..300: note = derived and/or modified sequence opt6 from anti-influenza_Chain
  source 1..300: mol_type = other RNA
atgacacaatcaccatcatcaatgtcagtatcactaggagacacagtatcaataacatgccacgcatcacaagacatatcaggacacataggatggctacaacaaaaaccaggaaaatcattcaaaggactaatataccacggaacaaacctagaagacggagtaccatcaagattctcaggatcaggatcaggagcagacttctcactaacaatatcatcactagaatcagaagacttcgcagactactactgcgtacaatacgtacaattcccatggacattcggaggaggaacaaaa

SEQ ID NO: 50514 - RNA, 306 nt, synthetic construct
  misc_feature 1..306: note = derived and/or modified sequence opt6 from anti-influenza_Chain
  source 1..306: mol_type = other RNA
gatatacaagtaacacaatcaccaagctcattaagcgcaagcgtaggagatagagtaacaataagctgtagagcacaatcactatcaagctatctacattggtatcaacaaaaaccaggacaaccaccaaaattactaatatacgcagcaacaacattacaatcaggagtaccatcaagatttagcggaagcggaagtggaacagatttcacactaacaatatcaacatttcaagcagaagatgtagcaacatattactgtcaacaaagcagaacatttggacaaggaacaaaagtagaaataaaa

SEQ ID NO: 50515 - RNA, 306 nt, synthetic construct
  misc_feature 1..306: note = derived and/or modified sequence opt6 from anti-influenza_Chain
  source 1..306: mol_type = other RNA
gacatacaaatgacacaatcaccatcatcactatcagcatcagtaggagacagagtaacaatatcatgcagagcacaatcactatcatcatacctacactggtaccaacaaaaaccaggacaaccaccaaaactactaatatacgcagcaacaacactacaatcaggagtaccatcaagattctcaggatcaggatcaggaacagacttcacactaacaatatcaacattccaagcagaagacgtagcaacatactactgccaacaatcaagaacattcggacaaggaacaaaagtagaaataaaa

SEQ ID NO: 50516 - RNA, 309 nt, synthetic construct
  misc_feature 1..309: note = derived and/or modified sequence opt6 from anti-influenza_Chain
  source 1..309: mol_type = other RNA
gacatacaaataacacaatcaccatcatcactatcagcatcagtaggagacagagtaacaataacatgcagaacatcacaatcactatcatcatacctacactggtaccaacaaaaaccaggaaaagcaccaaaactactaatatacgcagcatcatcactccaatcaggagtaccatcaagattctcaggatcaggatcaggaacagacttcacactaacaatatcatcactacaaccagaagacttcgcaacatactactgccaacaatcaagaacattcggacaaggaacaaaagtagaaataaaa

SEQ ID NO: 50517 - RNA, 309 nt, synthetic construct
  misc_feature 1..309: note = derived and/or modified sequence opt6 from anti-influenza_Chain
  source 1..309: mol_type = other RNA
gacatacaaatgacacaatcaccatcatcactatcagcatcagtaggagacagagtaacaataacatgcagaacatcacaatcactatcatcatacctacactggtaccaacaaaaaccaggaaaagcaccaaaactactaatatacgcagcatcatcactacaatcaggagtaccatcaagattctcaggatcaggatcaggaacagacttcacactaacaatatcatcactacaaccagaagacttcgcaacatactactgccaacaatcaagaacattcggacaaggaacaaaagtagaaataaaa

SEQ ID NO: 50518 - RNA, 309 nt, synthetic construct
  misc_feature 1..309: note = derived and/or modified sequence opt6 from anti-influenza_Chain
  source 1..309: mol_type = other RNA
gacatacaagtaacacaatcaccatcatcactatcagcatcagtaggagacagagtaacaatatcatgcagagcatcacaaagactaaactcatacctacactggtaccaacaaacaccaggacaagcaccaaaactactaatatacgcaacatcaacactacaatcaggagtatcaccacgattctcaggatcaggatcaggaacagacttcacactaacaatatcatcactacaaccagaagacgtagccacatactactgccaactatcaagaacattcggacacggaacaaaagtagaaataaaa

SEQ ID NO: 50519 - RNA, 309 nt, synthetic construct
  misc_feature 1..309: note = derived and/or modified sequence opt6 from anti-influenza_Chain
  source 1..309: mol_type = other RNA
gacatacaaatgacacaatcaccatcatcactatcagcatcagtaggagacagagtaacaatatcatgcagagcatcacaaagactaaactcatacctacactggtaccaacaaacaccaggacaagcaccaaaactactaatatacgcaacatcaacactacaatcaggagtatcaccaagattctcaggatcaggatcaggaacagacttcacactaacaatatcatcactacaaccagaagacgtagcaacatactactgccaactatcaagaacattcggacacggaacaaaagtagaaataaaa

SEQ ID NO: 50520 - RNA, 309 nt, synthetic construct
  misc_feature 1..309: note = derived and/or modified sequence opt6 from anti-influenza_Chain
  source 1..309: mol_type = other RNA
gacatacaagtaacacaatcaccatcatcactatcagcatcagtaggagacagaataacaatatcatgcagaacatcacaatcactaagatcatacctacactggtaccaacaaaaaccaggaaaagcaccaaaactactaatatacgcatcatcaacactacaatcaggagtaccatcaagattctcaggatcaggatcaggaacagacttcacactaacaatatcaaacctacaaccagaagacttcgcaacatactactgccaactatcaagaacattcggacaaggaacaaaagtagaaataaaa

SEQ ID NO: 50521 - RNA, 309 nt, synthetic construct
  misc_feature 1..309: note = derived and/or modified sequence opt6 from anti-influenza_Chain
  source 1..309: mol_type = other RNA
gacatacaaatgacacaatcaccatcatcactatcagcatcagtaggagacagaataacaatatcatgcagaacatcacaatcactaagatcatacctacactggtaccaacaaaaaccaggaaaagcaccaaaactactaatatacgcatcatcaacactacaatcaggagtaccatcaagattctcaggatcaggatcaggaacagacttcacactaacaatatcaaacctacaaccagaagacttcgcaacatactactgccaactatcaagaacattcggacaaggaacaaaagtagaaataaaa

SEQ ID NO: 50522 - RNA, 309 nt, synthetic construct
  misc_feature 1..309: note = derived and/or modified sequence opt6 from anti-influenza_Chain
  source 1..309: mol_type = other RNA
gacatacaaatgacacaatcaccatcatcactatcagcatcagtaggagacagagtaacaataacatgcagaacatcacaatcactatcatcatacacacactggtaccaacaaaaaccaggaaaagcaccaaaactactaatatacgcagcatcatcaagactatcaggagtaccatcaagattctcaggatcaggatcaggaacagacttcacactaacaatatcatcactacaaccagaagacttcgcaacatactactgccaacaatcaagaacattcggacaaggaacaaaagtagaaataaaa

SEQ ID NO: 50523 - RNA, 309 nt, synthetic construct
  misc_feature 1..309: note = derived and/or modified sequence opt6 from anti-influenza_Chain
  source 1..309: mol_type = other RNA
gacatacaaatgacacaatcaccatcatcactatcagcatcagtaggagacagagtaacaataacatgcagaacatcacaatcactatcatcatacacacactggtaccaacaaaaaccaggaaaagcaccaaaactactaatatacgcagcatcatcaagaggatcaggagtaccatcaagattctcaggatcaggatcaggaacagacttcacactaacaatatcatcactacaaccagaagacttcgcaacatactactgccaacaatcaagaacattcggacaaggaacaaaagtagaaataaaa

SEQ ID NO: 50524 - RNA, 309 nt, synthetic construct
  misc_feature 1..309: note = derived and/or modified sequence opt6 from anti-influenza_Chain
  source 1..309: mol_type = other RNA
gacatacaaatgacacaatcaccatcatcactatcagcatccgtaggagacagagtaacaataacatgcagaacatcacaatcactatcatcatacgaccactggtaccaacaaaaaccaggaaaagcaccaaaactattaatatacgcagcatcatcaagactatcaggagtaccatcaagattctcaggatcaggatcaggaacagacttcacactaacaatatcctcactacaaccagaagacttcgcaacatactactgccaacaatcaagaacattcggacaaggaacaaaagtagaaataaaa

SEQ ID NO: 50525 - RNA, 318 nt, synthetic construct
  misc_feature 1..318: note = derived and/or modified sequence opt6 from anti-influenza_Chain
  source 1..318: mol_type = other RNA
gaaatagtaatgacacaatcaccagacacactatcagtatcaccaggagaaagagcaacattatcatgcagagcatcacaatcagtaaacagaagactagcatggtaccaacaaaaaccaggacaagcaccaagactactaatacacgacgcatcaacaagagcaacaggaataccagcaagattctcaggatcaggatcaggaacagaattcacactaacaatatcatcactacaatcagaagacttcgcagtatactactgccaacaatacgacaactggctatcattcggacaaggaacaagactagaaataaaa

SEQ ID NO: 50526 - RNA, 318 nt, synthetic construct
  misc_feature 1..318: note = derived and/or modified sequence opt6 from anti-influenza_Chain
  source 1..318: mol_type = other RNA
gacatacaactaacacaatcaccatcatcactatcagcatcagtaggagacagagtaacaataacatgcagagcatcacaaggaatactaaactgcctagcatggtaccaacaaaaaccaggaaaagtaccaaacctattaatgtacgcagcatcaacactacaatcaggagtaccatcaagattctcaggatcaggattcggaacagacttcacactaacaatatcatcactacaaccagaagacgtagcaacatactactgccaaacatacggaggagtatcaacattcggaggaggaacaaaagtagaaataaga

SEQ ID NO: 50527 - RNA, 318 nt, synthetic construct
  misc_feature 1..318: note = derived and/or modified sequence opt6 from anti-influenza_Chain
  source 1..318: mol_type = other RNA
agttatgtattaacacaaccaccaagtgtaagtgtagcaccaggacaaacagcaagaataagttgtggaggaagtaatataggaggaaaaagtgtacattggtatcaacaaaaaccaggacaagcaccagtattagtagtatatgatgatagcggaaggccaagtggaataccagaaagatttagtggaagtaatagtggagatacagcaacattaacaataagtagagtagaagcaggagatgaagcagattatttttgtcaagtatgggataattttggaggagtatttggaacaggaacaaaagtaacagtacta

SEQ ID NO: 50528 - RNA, 318 nt, synthetic construct
  misc_feature 1..318: note = derived and/or modified sequence opt6 from anti-influenza_Chain
  source 1..318: mol_type = other RNA
gacatacaaatgacacaatcaccatcatcattatcagcatcagtaggagacagagtaacaataacatgcagaacatcacaatcaatatcatcatacctaaactggtaccaacaaaaaccaggaaaagcaccaaaactactaatatacgcagcatcatccctacaatcaggagtaccatcaagattctcaggatcaggatcaggaacagacttcacactaacaatatcaggactacaaccagaagacttcgcaacatactactgccaacaatcatactcaatgccagcattcggacaaggaacaaaactagaaataaaa

SEQ ID NO: 50529 - RNA, 318 nt, synthetic construct
  misc_feature 1..318: note = derived and/or modified sequence opt6 from anti-influenza_Chain
  source 1..318: mol_type = other RNA
gacatacaaatgacacaatcaccactatcagtatcagtatcagtaggagacagagtaacaatagcatgcagagcatcacaatcaatagacaaattcctaaactggtaccaacaaaaaccaggaaaagcaccaaaactattaatatacggagcatcaaacctacactcaggagcaccatcaagattctcagcatcaggatcaggaacagacttcacattaacaataacaaacatacaaacagaagacttcgcaacatacctatgccaacaatcattctcagtaccagcattcggaggaggaacaaaagtagaaataaaa

SEQ ID NO: 50530 - RNA, 318 nt, synthetic construct
  misc_feature 1..318: note = derived and/or modified sequence opt6 from anti-influenza_Chain
  source 1..318: mol_type = other RNA
gacatacaaatgacacaatcaccatcatccctatcagcatcagtaggagacagagtaacaataacctgcagagcatcacaatcaatatcaacatacctaaactggtaccaaaaaagaccaggaaaagcaccaaaattactagtatacggagcatcaacactacaatcaggagtaccatcaagattctcaggatcaggatcaggaacagacttcacactaacaatagcatcactacaaccagaagactcagcaacatactactgccaacaaacatactcaataccactattcggacaaggaacaagactagaaataaaa

SEQ ID NO: 50531 - RNA, 318 nt, synthetic construct
  misc_feature 1..318: note = derived and/or modified sequence opt6 from anti-influenza_Chain
  source 1..318: mol_type = other RNA
gacatacaaatgacacaatcaccatcatcactatcagcatcagtaggagacagagtaacaataacatgcagagcatcacaatccatatcaacatacctaaactggtaccaaaaaagaccaggaaaagcaccaaaactactagtatacggagcatcatcactacaatcaggagtaccatcaagattctcaggatcaggatcaggaacagacttcacactaacaatagcatcattacaaccagaagactcagcagtatactactgccaacaaacatactcaataccactattcggacaaggaacaagactagaaataaaa

SEQ ID NO: 50532 - RNA, 318 nt, synthetic construct
  misc_feature 1..318: note = derived and/or modified sequence opt6 from anti-influenza_Chain
  source 1..318: mol_type = other RNA
gacatacaaatgacacaatcaccatcatcactatcagcatcagtaggagacagagtaacaataacatgcagagcatcacaatcaatatcaagatacttaaactggtaccaacaaaaaccaggaaaagcaccaaaactactaatatacggagcatcaacactacaaaacggagcaccatcaagattctcaggatcaggatcaggaacagacttcacactaacaatatcatcactacaaccagaagactcagcaacatacctatgccaacaatcatactcagtaccagcattcggaggaggaacaaaagtagaagtaaaa

SEQ ID NO: 50533 - RNA, 318 nt, synthetic construct
  misc_feature 1..318: note = derived and/or modified sequence opt6 from anti-influenza_Chain
  source 1..318: mol_type = other RNA
ggaatacaaatgacacaatcaccatcatcactatcagcatcagtaggagacagagtaacaataacatgcagagcatcacaatcaatatcaagatacctaaactggtacctacaaaaaccaggaaaagcaccaaaactactaatatcaggagcatcatcactacaatcaggagtaccatcaagattctcaggaacaggatcaggaacagaattcacactaacaatatcatcactacaaccagaagacttcgcaacatactactgccaacaaacattctcaataccactattcggacaaggaacaaaagtagaaataaaa

SEQ ID NO: 50534 - RNA, 321 nt, synthetic construct
  misc_feature 1..321: note = derived and/or modified sequence opt6 from anti-influenza_Chain
  source 1..321: mol_type = other RNA
gacatacaaatgacacaatcaccatcatcactatcagcatcagtaggagacagagtatcaataacatgccaagcatcacaagacatatcaagatacctaaactggtaccaacaaaaaccaggagaagcaccaaaactactaatatacgacgcatcaaacttagaaacaggagtaccatcaagattctcaggatcaggatcaggaacagacttcacattcacaatatcatcactacaaccagaagacatagcaacatacttctgccaacaatacggatacctaccactaacattcggaccaggaacaaaagtagactcaaaa

SEQ ID NO: 50535 - RNA, 321 nt, synthetic construct
  misc_feature 1..321: note = derived and/or modified sequence opt6 from anti-influenza_Chain
  source 1..321: mol_type = other RNA
gacatacaaatgacacaatcaccatcatcattctcagtatcactaggagacagagtaacaataacatgcaaagcatcagaagacatatacaacagactagcatggtaccaacaaaaaccaggaaacgcaccaagactactaatatcagacacaacaaacctatggataggagtaccatcaagattctcaggatcaggatcaggaaaagactacacactatcaataacatcactacaatcagaagacgtagcaacatactactgccaacaatactggtcatcaagaacattcggaggaggaacaaaactagaaataaaaaga

SEQ ID NO: 50536 - RNA, 321 nt, synthetic construct
  misc_feature 1..321: note = derived and/or modified sequence opt6 from anti-influenza_Chain
  source 1..321: mol_type = other RNA
gacatacaaatgacacaaagcccaagcagcttctcagtatcactaggagacagagtaacaataacatgcaaagcatcagaagacatatataacagagtagcatggtatcaacaaaaaccaggaaatgcaccaagattactaatgagcgatgcaacatcattaggagcaggagtaccaagcagatttagcggaagcggaagcggaaaagatcacacattatcaataacatcattacaaacagaagatgtagcaacatattactgtcaacaatactggaacacaagaacattcggaggaggaacaaaactagaaataaaaaga

SEQ ID NO: 50537 - RNA, 321 nt, synthetic construct
  misc_feature 1..321: note = derived and/or modified sequence opt6 from anti-influenza_Chain
  source 1..321: mol_type = other RNA
gacatacaaatgacacaatcaccatcatcactatcagcatcagtaggagacagagtaacaataacatgccgagcatcacaatcaatatcaacatacctaaactggtaccaacaaaaaccaggaataccaccaaaactactaataaacgtagcatcatcactacaatcaggagtaccatcaagattctcaggatcaggatcaggaacagacttcacactaacaatatcctcactacaaccagaagacttcgcatcatactactgccaacaaacatactcatcaccaccaacattcggacaaggaacaaaagtagaaataaaa

SEQ ID NO: 50538 - RNA, 321 nt, synthetic construct
  misc_feature 1..321: note = derived and/or modified sequence opt6 from anti-influenza_Chain
  source 1..321: mol_type = other RNA
gatatacaaatgacacaatcaccatcaacattaagcggaagcgtaggagatagagtaacaataacatgtagagcaagccaaaacataggaccatggttagcatggtaccaacaagaaagcggaaaagcaccaaaactattaatatcaagagcaagcatactagaaagtggagtaccaagcagattctcaggaacaggaacaggaacagaatttacattaacaataagctcactacaaccagatgactttgcaacatactattgccaacactataacgcatactggggaacattcggacaaggaacaaaagtagaaataaat

SEQ ID NO: 50539 - RNA, 321 nt, synthetic construct
  misc_feature 1..321: note = derived and/or modified sequence opt6 from anti-influenza_Chain
  source 1..321: mol_type = other RNA
gtaatatggatgacacaatcaccatcactactatcagcatcaacaggagacagagtaacaatatcatgcagaatgtcacaaggaatatcatcatacctagcatggtaccaacaaaaaccaggaaaagcaccagaactactaatacacacagcatacacactaaaatcaggagtcccatcaagattctcaggatcaggatcaggaaaagacttcacactaacaatatcaggactacaatcagaagacttcgcaacatactactgccaacaatactactcattcccatacacattcggacaaggaacaaaagtagaaataaaa

SEQ ID NO: 50540 - RNA, 321 nt, synthetic construct
  misc_feature 1..321: note = derived and/or modified sequence opt6 from anti-influenza_Chain
  source 1..321: mol_type = other RNA
gacatacaaatgacacaatcaccatcatcagtctcagcatcagtaggagacagagtaacaataacatgcagagcatcacaagacgtatcaacatggctagcatggtaccaactaaaaccaggaaaagcaccaaaactactaatatacgcagcatcatcactacaatcaggagtaccatcaagattctcaggatcaggatcaggaacagacttcacactaacagtatcatcactacaaccagaagacttcgcaacatactactgccaacaagcaaactcattcccattcacattcggaccaggaacaaaagtagacataaaa

SEQ ID NO: 50541 - RNA, 321 nt, synthetic construct
  misc_feature 1..321: note = derived and/or modified sequence opt6 from anti-influenza_Chain
  source 1..321: mol_type = other RNA
gacatacaattaacacaatcaccatcattcctatcagcatcagtaggagacggagtaacaataacatgcagagcatcacaagacatatacatatacctagcatggtaccaacaaaaaccaggaaaagcaccaaaactactaatatacgcagcatcaacactacaaggaggagtaccaagcagattctcaggatcaggatcaggaacagaattcacactaacaataaacaacctacaaccagaagacttcgcaacatacttctgccaacaactaaacggatacccactaacattcggaggaggaacaaaagtagaaataaaa

SEQ ID NO: 50542 - RNA, 321 nt, synthetic construct
  misc_feature 1..321: note = derived and/or modified sequence opt6 from anti-influenza_Chain
  source 1..321: mol_type = other RNA
gatatacaactaacacaatcaccatcaagcctaagcgcaagcgtaggagatagagtaacattaacatgtcaagcaagccaagacataagaaaattcttaaactggtaccaacaaaaaccaggaaaaggaccaaaactattaatatatgacgcaagcaatctacaaagaggagtaccaagcagattctcaggaggaggatcaggaacagactttacattaataataagctcactacaaccagaagacgtaggaacatactattgccaacaatatgacgggctaccattcacattcggaggaggaacaaaactagaaataaaa

SEQ ID NO: 50543 - RNA, 321 nt, synthetic construct
  misc_feature 1..321: note = derived and/or modified sequence opt6 from anti-influenza_Chain
  source 1..321: mol_type = other RNA
gacatacaactaacacaatcaccatcatcactatcagcatcaataggagacagagtaacaataacatgccaagcatcacaagacataagaaactcactaaactggtacgaacacaaaccaggaaaagcaccaaaactactaatacacgacgcatcaaacctagaaacaggagtaccaagcagattctcaggaggaggatcaggaacagacttcacactaacaatatcatcactacaaccagaagacttcgcaacatactactgccaacaagcaaactcattcccactaacattcggaggaggaacaaaagtagaaataaaa

SEQ ID NO: 50544 - RNA, 321 nt, synthetic construct
  misc_feature 1..321: note = derived and/or modified sequence opt6 from anti-influenza_Chain
  source 1..321: mol_type = other RNA
gacatacaactaacacaatcaccatcaagcttatcagcatcagtaggagacagagtaacaataacatgcagagcatcacaaggaataagaaacgacctaggatggtaccaacaaaaaccaggaaacgcaccaaaaagattaatattcggagcatcatcactacaatcaggagtaccaagcagattctcaggatcaggatcaggaacagaattcacactaacaatatcatcactacaaccagaagacttcgcaacatactactgcctacaacacaactcatacccatacacattcggacaaggaacaaaactagaaataaaa

SEQ ID NO: 50545 - RNA, 321 nt, synthetic construct
  misc_feature 1..321: note = derived and/or modified sequence opt6 from anti-influenza_Chain
  source 1..321: mol_type = other RNA
gacatacaactaacacaatcaccatcatcactatcagcatcagtaggagacagagtaacaataacatgcagagcatcacaatcaatatcaagatacctaaactggtaccaacaaaaaccaggaaaagcaccaaaactactactattcgcagcatcaacactactagacggagtaccatcaagattctcaggatcaggatcaggaacagacttcacactaacaatatcatcactacaaccagaagacttcgcaacatactactgccaaagaaaccactcaccatcatggacattcggacaaggaacaagagtagaaataaaa

SEQ ID NO: 50546 - RNA, 321 nt, synthetic construct
  misc_feature 1..321: note = derived and/or modified sequence opt6 from anti-influenza_Chain
  source 1..321: mol_type = other RNA
gacatacaaatgacacaatcaccatcatcactatcagcatcagtaggagacagagtaacaatgacatgcagagcaagccaaaacataagatcatacctaaactggtaccaacaaagaccaggaacagcaccaaaactactaatatacgcagcatcaacactccactcaggagtaccatcaagattctcaggaggaggatcaggaacagacttcacactaacaataaacaacctacaaccagaagacttcgcatcatactactgccaacaatcatacgacaacccacaaacattcggacaaggaacaaaagtagaaataaaa

SEQ ID NO: 50547 - RNA, 321 nt, synthetic construct
  misc_feature 1..321: note = derived and/or modified sequence opt6 from anti-influenza_Chain
  source 1..321: mol_type = other RNA
gacatacaaatgacacaatcaccatcatcactatcagcatcagtaggagacagagtaacaataacatgcagagcaaaccaagacataggaatatacctaaactggtaccaacaaaacccaggaaaagtaccaaaactactactacacggagcatcatcactacaaggaggagtaccatcaagattctcagcatcaggatcaggaacagacttcacactaacaatacattcactacaaccagaagacctagcaacatactactgccaacaatcacgaagactaccatacacattcggacaaggaacaagagtagaactaaaa

SEQ ID NO: 50548 - RNA, 321 nt, synthetic construct
  misc_feature 1..321: note = derived and/or modified sequence opt6 from anti-influenza_Chain
  source 1..321: mol_type = other RNA
gacatacaaatgacacaatcaccatcaacactatcagcatcaataggagacagagtaacaataacatgcagagcatcacaatcaatagcatcatggctagcatggtaccaacaaaaaccaggaaaagcaccaaaactactaatatacgaagcagtaaacctagaatcaggagtaccatcaagattctcaggatcaggatcaggaacagacttcacactaacaatatcatcactacaaccagacgacttcgcaacatacttctgccaacactacggaacaatatcacaaacattcggaggaggaacaaaagtcgaaataaaa

SEQ ID NO: 50549 - RNA, 321 nt, synthetic construct
  misc_feature 1..321: note = derived and/or modified sequence opt6 from anti-influenza_Chain
  source 1..321: mol_type = other RNA
gacatacaaatgacacaatcaccatcatcactatcagcatcagtaggagacagagtaacaataacatgcagagcatcacaatcaatatcatcatacctaaactggtaccaacacaaaccaggaaaagcaccaaaagtactaatgtacgcagtatcaatactacaatccggagtaccatcaagattctcaggatcaggatcaggagcagacttcacactaacaatatcatcactacaaccagaagacttcgcaacatactactgccaacaatcatactcatcaccactaacattcggaggaggaacaaaagtagaaataaaa

SEQ ID NO: 50550 - RNA, 321 nt, synthetic construct
  misc_feature 1..321: note = derived and/or modified sequence opt6 from anti-influenza_Chain
  source 1..321: mol_type = other RNA
gacatacaaatgacacaatcaccatcatcactatcagcatcagtaggagacagagtaacaataacatgcagagcatcacaaaacataaaaagatacttcaactggtaccaacaaaaaccaggaaaagcaccaaaactactaatatacgcagcatcaaacctagaaaacggagtaccatcaagattctcaggatcaggatcaggaacagacttcaccctaacaatatcatcactacaaccagaagacttcgcaacatactactgccaacaatcattctcaaaatcatggacattcggacaaggaacaaacgtagacataaaa

SEQ ID NO: 50551 - RNA, 321 nt, synthetic construct
  misc_feature 1..321: note = derived and/or modified sequence opt6 from anti-influenza_Chain
  source 1..321: mol_type = other RNA
gacatacaaatgacacaatcaccatcatcactatcagcatcagtaggagacagagtaacaataacatgcagagcatcacaaaacatatacaaatacctaaactggtaccaacaaagaccaggaaaagcaccaaaaggactaatatcagcagcatcaggactacaatcaggagtaccatcaagattctcaggatcaggatcaggaacagacttcacactaacaataacatcactacaaccagaagacttcgcaacatactactgccaacaatcatactcaccaccactaacattcggaggaggaacaagagtagaaataaaa

SEQ ID NO: 50552 - RNA, 321 nt, synthetic construct
  misc_feature 1..321: note = derived and/or modified sequence opt6 from anti-influenza_Chain
  source 1..321: mol_type = other RNA
gacatacaaatgacacaatcaccatcatcactatcatcatcagtaggagacagagtaacaataacatgcagagcatcacaatcaataggagcatacgtaaactggtaccaacaaaaagcaggaaaagcaccacaagtactaatattcggagcatcaaacctacaatcaggagtaccatcaagattctcaggatcaggatcaggaacagacttcacattaacaatatcatcactacaaccagaagacttcgcaacatacttctgccaacaaacatactcaacaccaataacattcggacaaggaacaagactagaaataaaa

SEQ ID NO: 50553 - RNA, 321 nt, synthetic construct
  misc_feature 1..321: note = derived and/or modified sequence opt6 from anti-influenza_Chain
  source 1..321: mol_type = other RNA
gacatacaaatgacacaatcaccatcatcactatcagcatcagtaggagacagagtaacaatatcatgcagagcatcacaatcaatatcaacatacctaaactggtaccaacaacaaccaggaaaagcaccaaaagtactaatattcggagcaacaaacctacaatcaggagtaccatcaagattctcaggatcaggatcaggaacagacttcacactaacaatatcatcactacaaccagaagacttcgcaacatactactgccaacaatcatacaacacaccactaatattcggacaaggaacaaaactagaaataaaa

SEQ ID NO: 50554 - RNA, 321 nt, synthetic construct
  misc_feature 1..321: note = derived and/or modified sequence opt6 from anti-influenza_Chain
  source 1..321: mol_type = other RNA
gacatacaaatgacacaatcaccatcatcactatcagcatcagtaggagaccgagtaacaatatcatgcagagcatcacaatcaatatcaacatacctaaactggtaccaacaacaaccaggaaaagcaccaaaagtactaatatcaggagcaacaaacctacaatcaggagtaccatcaagattctcaggatcaggatcaggaacagacttcacattaacaatatcatcactacaaccagaagacttcgcaacatactactgccaacaatcatacaacacaccactaatattcggacaaggaacaaaactagaaataaaa

SEQ ID NO: 50555 - RNA, 321 nt, synthetic construct
  misc_feature 1..321: note = derived and/or modified sequence opt6 from anti-influenza_Chain
  source 1..321: mol_type = other RNA
gacatacaaatgacacaatcaccatcatcactatcagcatcagtaggagacagactaacaataacatgccgagcatcacaatcaatatcaacatacctacactggtaccaacaaaaaccaggaaaagcaccaaaactactaatatacgcagcatcatcactacaatcaggagtaccatcaagattctcaggatcacgatcaggaacagacttcacactaacaatatcatcactacaaccagacgacttcgcaacatactactgccaacaatcatactcaccaccactaacattcggaccaggaacaaaagtagacatgaaa

SEQ ID NO: 50556 - RNA, 321 nt, synthetic construct
  misc_feature 1..321: note = derived and/or modified sequence opt6 from anti-influenza_Chain
  source 1..321: mol_type = other RNA
gacatacaaatgacacaatcaccatcatcactatcagcatcagtaggagacagagtaacaataacatgcagagcatcacaatcaatatcaaactacctaaactggtaccaacacaaaccaggagaagcaccaaaactactaaactacgcagcatcatcactacaatcaggagtaccatcaagattctcagcatcaggatcaggaacagacttcacactaacaatatcatcactacaaccagaagacttcgcaacatactactgccaacaatcatacaacacaccaataacattcggacaaggaacaagactagaaataaaa

SEQ ID NO: 50557 - RNA, 321 nt, synthetic construct
  misc_feature 1..321: note = derived and/or modified sequence opt6 from anti-influenza_Chain
  source 1..321: mol_type = other RNA
gacatacaaatgacacaatcaccatcatcactatcagcatcagtaggagacagagtaacaataacatgcagagcatcacaatcaatatcaaactacctaaactggtaccaacacaaaccaggagaagcaccaaaactactaaactacgcagcatcctcactacaatcaggagtaccatcaagattttcagcatcaggatcaggaacagacttcacactatcaatatcaggactacaaccagaagacttcgcaacatactactgccaacaatcatacaacacaccaataacattcggaccaggaacaagactagaaataaaa

SEQ ID NO: 50558 - RNA, 321 nt, synthetic construct
  misc_feature 1..321: note = derived and/or modified sequence opt6 from anti-influenza_Chain
  source 1..321: mol_type = other RNA
gacatacaaatgacacaatcaccatcatcactatcagcatcagtaggagacagagtaacaataacatgcagagcatcacaatcaatatcaacatacctaaactggtaccaacaaaaaccaggaaaagcaccaaaactactaatatacgcagcatcatcactacactcaggagtaccatcacgattctcaggatcaggatcaggaacagacttcgcactaacaatatcatcactacaaccagaagacttcgcaacctactactgccaacaatcatactcaccaccaataacattcggacaaggaacaagactagaaataaaa

SEQ ID NO: 50559 - RNA, 321 nt, synthetic construct
  misc_feature 1..321: note = derived and/or modified sequence opt6 from anti-influenza_Chain
  source 1..321: mol_type = other RNA
gacatacaaatgacacaatcaccatcatcactatcagcatcagtaggagacagagtaacaataacatgcagagcatcacaaacaatatcaacatacctaaactggtaccaacaaaaatcaggaaaagcaccaaaactactaatatacgcagcatcaggactacaatcaggagtaccatcaagattctcaggatcaggatcaggcacagacttcacactaacaatatcatcactacaaccagaagacttcgcaacatacttctgccaacaatcatacaacacaccactaacattcggacaaggaacaaaagtagaaataaaa

SEQ ID NO: 50560 - RNA, 321 nt, synthetic construct
  misc_feature 1..321: note = derived and/or modified sequence opt6 from anti-influenza_Chain
  source 1..321: mol_type = other RNA
gacatacaaatgacacaatcaccatcatcactatcagcatcagtaggagacagagtaacaatatcatgcagagcatcacaatcaatatcaacatacctaaactggtaccaacaacaaccaggaaaagcaccaaaagtactaatatcaggagcaacagacctacaatcaggagtaccatcaagattctcaggatcaggatcaggaacagacttcacactaacaatatcatcactccaaccagaagacttcgcaacatactactgccaacaatcatacaacacaccactaatattcggacaaggaacaaaactagaaataaaa

SEQ ID NO: 50561 - RNA, 321 nt, synthetic construct
  misc_feature 1..321: note = derived and/or modified sequence opt6 from anti-influenza_Chain
  source 1..321: mol_type = other RNA
gacatacaagtaacacaatcaccatcatcactatcagcatcagtaggagacagagtaacaataacatgcagagcatcacaaaacatatacaaatacttaaactggtaccaacaaagaccaggaaaagcaccaaaaggactaatatcagcagcatcaggactacaatcaggagtaccatcaagattctcaggatcaggatcaggaacagacttcacactaacaataacatcactacaaccagaagacttcgcaacatactactgccaacaatcatactcaccaccattaacattcggaggaggaacaagagtagacataaaa

SEQ ID NO: 50562 - RNA, 321 nt, synthetic construct
  misc_feature 1..321: note = derived and/or modified sequence opt6 from anti-influenza_Chain
  source 1..321: mol_type = other RNA
caatcagtactaacacaaccaccatcagaatcagtatcaccaggacaaacagcatcagtaacatgctcaggacacaaactaggagacaaatacgtatcatggtaccaacaaaaaccaggacaatcaccagtattactaatataccaagacaacagaagaccatcaggaataccagaaagattcataggatcaaactcaggaaacacagcaacactaacaatatcaggaacacaagcactagacgaagcagactactactgccaagcatgggactcatcaacagcagtattcggaggaggaacaaaactaacagtactagga

SEQ ID NO: 50563 - RNA, 321 nt, synthetic construct
  misc_feature 1..321: note = derived and/or modified sequence opt6 from anti-influenza_Chain
  source 1..321: mol_type = other RNA
gacatacaactaacacaatcaccatcatcactatcagcatcagtaggagacagagtaacaataacatgcagagcatcacaaggaatatcaacatacctagcatggtaccaacaaaaaccaggaaaagtaccaaaactactaatatacgcagcatcaacactacaatcaggagtaccatcaagattctcaggatcaggatcaggaacagacttcacactaacaatatcatcactacaaccagaagacgtagcaacatactactgccaaaaatacaactcagcaccatcattcggaccaggaacaaaagtagacataaaaaga

SEQ ID NO: 50564 - RNA, 321 nt, synthetic construct
  misc_feature 1..321: note = derived and/or modified sequence opt6 from anti-influenza_Chain
  source 1..321: mol_type = other RNA
tcagtactaacacaaccaccatcagcatcaggatcaagaggacaatcaataacaatatcatgcacaggatcaacatcagacataggatcatacaactacgtatcatggtaccaacaacacccaggaacagcaccaaaagtaatactatacgaagtatcacaaagaccatcaggagtaccagacagattctcaggatcaaaatcaggaaacacagcattcctaacagtatcaggactacaagcagaagacgaagcagactactactgcgcatcatacgcaggaaacaacatatacgtattcggatcaggaacaaaagtaaca

SEQ ID NO: 50565 - RNA, 321 nt, synthetic construct
  misc_feature 1..321: note = derived and/or modified sequence opt6 from anti-influenza_Chain
  source 1..321: mol_type = other RNA
tcagcactaacacaaccaccatcagcatcaggatcaagaggacaatcaataacaatatcatgcacaggatcaacatcagacataggatcatacaactacgtatcatggtaccaacaacacccaggaacagcaccaaaagtaatactatacgaagtatcacaaagaccatcaggagtaccagacagattctcaggatcaaaatcaggaaacacagcattcctaacagtatcaggactacaagcagaagacgaagcagactactactgcgcatcatacgcaggaaacaacatatacgtattcggatcaggaacaaaagtaaca

SEQ ID NO: 50566 - RNA, 321 nt, synthetic construct
  misc_feature 1..321: note = derived and/or modified sequence opt6 from anti-influenza_Chain
  source 1..321: mol_type = other RNA
gaaatagtactaacacaatcaccagcaacactatcactaagcccaggagaaagagcaacactatcatgcagagcatcacaatcagtatcaacattcctagcatggtaccaacaaaaaccaggacaagcaccaagactactaatgtacgacgcatcaaacagagcaacaggaataccagcaagattctcaggatcaggatcaggaacagacttcacactaacaatatcatcactagaaccagaagacttcgcaatatactactgccaacaaagatcacactggccaccaatattcggacaaggaacaagactagaaataaaa

SEQ ID NO: 50567 - RNA, 321 nt, synthetic construct
  misc_feature 1..321: note = derived and/or modified sequence opt6 from anti-influenza_Chain
  source 1..321: mol_type = other RNA
gacatacaaatgacacaatcaccagcatcactatcagtatcagtaggagaaacagtaacaataacatgcagagcatcagaaaaaatatactcaaacctagcatggtaccaacaaaaagaaggaaaatcaccacaactactagtatacgcagcaataagactagcagacggagtaccatcaagattctcaggatcaggatcaggaacacaattctcactaaaaataaactcactacaatcagaagacttcggaacatactactgccaacacttctggggaacaccactaacattcggagcaggaacaaaactagaactaaaa

SEQ ID NO: 50568 - RNA, 321 nt, synthetic construct
  misc_feature 1..321: note = derived and/or modified sequence opt6 from anti-influenza_Chain
  source 1..321: mol_type = other RNA
gacatacaaatgacacaatcaccatcatcagtatcagcatcagtaggagacagagtaacaataacatgcagagcatcacaagacatatcaacatggctagcatggtaccaacaaaaaccaggaaaagcaccaaaattactaatctacgcagcatcatcactacaatcaggagtaccaagcagattctcaggatcaggatcaggaacagacttcacactaacaatatcatcactacaaccagaagacttcgcaacatacttctgccaacaagcaaactcattcccaccaacattcggacaaggaacaaaactagaaataaaa

SEQ ID NO: 50569 - RNA, 321 nt, synthetic construct
  misc_feature 1..321: note = derived and/or modified sequence opt6 from anti-influenza_Chain
  source 1..321: mol_type = other RNA
gacatacaaatgacacaatcaccatcatcagtatcagcatcagtaggcgacagagtaacaataacatgcagagcatcacaagacatatcaacatggctagcatggtaccaacaaaaaccaggaaaagcaccaaaactactaatatacgcagcatcctcactacaatcaggagtaccatcaagattctcaggatcaggatcaggaacagacttcacactaacaatatcatcactacaaccagaagacttcgcaacatacttctgccaacaagcaaactcattcccaccaacattcggatgcggaacaaaactagaaataaaa

SEQ ID NO: 50570 - RNA, 321 nt, synthetic construct
  misc_feature 1..321: note = derived and/or modified sequence opt6 from anti-influenza_Chain
  source 1..321: mol_type = other RNA
gacatacaaatgacacaatcaccatcatcagtatcagcatcagtaggagacagagtaacaataacatgcagagcatcacaagacatatcaacatggctagcatggtaccaacaaaaaccaggaaaatgcccaaaactactaatatacgcagcatcatcactacaatcaggagtaccatcaagattctcaggatcaggatcaggaacagacttcacactaacaatatcatcactacaaccagaagacttcgcaacatacttctgccaacaagcaaactcattcccaccaacattcggacaaggaacaaaactagaaataaaa

SEQ ID NO: 50571 - RNA, 321 nt, synthetic construct
  misc_feature 1..321: note = derived and/or modified sequence opt6 from anti-influenza_Chain
  source 1..321: mol_type = other RNA
gacatacaaatgacacaatcaccatcatcagtatcagcatccgtaggagacagagtaacaataacatgcagagcatcacaagacatatcaacatggctagcatggtaccaacaaaaaccaggaaaagcaccaaaattactaatatacgcagcatcatcactacaatccggagtaccatcaagattctcaggatcaggatcaggaacagacttcacactaacaatatcatcactacaaccagaagacttcgcaacatactactgccaacaagcaaactcattcccaccaacattcggacaaggaacaaaactagaaataaaa

SEQ ID NO: 50572 - RNA, 321 nt, synthetic construct
  misc_feature 1..321: note = derived and/or modified sequence opt6 from anti-influenza_Chain
  source 1..321: mol_type = other RNA
gacatacaaatgacacaatcaccatcatcagtatcagcatcagtaggagacagagtaacaataacatgcagagcatcacaagacatatcaacatggctagcatggtaccaacaaaaaccaggaaaagcaccaaaactactaatatacgcagcatcatcactacaatcaggagtaccatcaagattctcaggatcaggatcaggaacagacttcacactaacaatatcatcactacaaccagaagacttcgcaacatactactgccaacaagcaaactcattcccaccaacattcggatgcggaacaaaactagaaataaaa

SEQ ID NO: 50573 - RNA, 321 nt, synthetic construct
  misc_feature 1..321: note = derived and/or modified sequence opt6 from anti-influenza_Chain
  source 1..321: mol_type = other RNA
gacatacaaatgacacaatcaccatcatcagtatcagcatcagtaggagacagagtaacaataacatgcagagcatcacaagacatatcaacatggctagcatggtaccaacaaaaaccaggaaaatgcccaaaactactaatatacgcagcatcatcattacaatcaggagtaccatcaagattctcaggatcaggatcaggaacagacttcacactaacaatatcatcactacaaccagaagacttcgcaacatactactgccaacaagcaaactcattcccaccaacattcggacaaggaacaaaactagaaataaaa

SEQ ID NO: 50574 - RNA, 321 nt, synthetic construct
  misc_feature 1..321: note = derived and/or modified sequence opt6 from anti-influenza_Chain
  source 1..321: mol_type = other RNA
gaaatagtactaacacaatcaccagcaacactatcactatcaccaggagaaagagcaacactatcatgcagagcatcaagatcaataacaacattcctagcatggtaccaacaaaaaccaggacaagcaccaagactactaatatacgacgcatcaaacagagcaacaggagtaccagcaagattctcaggatcaggatcaggaacagacttcacactaacaataaactcactagaaccagacgacttcgcaatatactactgccaacaaagagaccactggccaccaatattcggacaaggaacaagactagaaataaaa

SEQ ID NO: 50575 - RNA, 321 nt, synthetic construct
  misc_feature 1..321: note = derived and/or modified sequence opt6 from anti-influenza_Chain
  source 1..321: mol_type = other RNA
gaaatagtactaacacaatcaccagcaacactatcactatcaccaggagaaagagcaacactatcatgcagagcatcaagatcaataacaacattcctagcatggtaccaacaaaaaccaggacaagcaccaagactactaatatacgacgcatcaaacagagcaacaggagtaccagcaagattctcaggatcaggatcaggaacagacttcacactaacaataaactcactagaaccagacgacttcgcaatatactactgccaacaaagagaccactggccaccaatattcggatgcggaacaagactagaaataaaa

SEQ ID NO: 50576 - RNA, 324 nt, synthetic construct
  misc_feature 1..324: note = derived and/or modified sequence opt6 from anti-influenza_Chain
  source 1..324: mol_type = other RNA
gaaatagtactaacacaatcaccaggaacattaagcctaagcccaggagaaagagcaacattaagctgtagagcaagccaaacagtaagttcaagctatctagcatggtatcaacaaaaaccaggacaagcaccaagattactaatatacggagcatcaagcagagcaacaggaataccagatagatttagcggaagcggaagcggaacagatttcacactaacaatatcaagattagaaccagaagatttcgcagtatattactgtcaacaatacggaaactcaccatatacatttggacaaggaacaaaattagaaataaaa

SEQ ID NO: 50577 - RNA, 324 nt, synthetic construct
  misc_feature 1..324: note = derived and/or modified sequence opt6 from anti-influenza_Chain
  source 1..324: mol_type = other RNA
gaaatagtactaacacaatcaccaggaacattatcagtatcaccaggagaaagagcaacattatcatgcagagcatcacaatcaatatcatcaggatacctagcatggtaccaacaaaaaccaggacaagcaccaagactactaatatacggagcatcatcaagagcaacaggaataccagacagattctcaggatcaggatcaggaacagacttcacattaacaatatcaagattagaaccagaagacttcgcagtatactactgccaacaatacggaacatcaccacaaacattcggacaaggaacaaaagtagaaataaaa

SEQ ID NO: 50578 - RNA, 324 nt, synthetic construct
  misc_feature 1..324: note = derived and/or modified sequence opt6 from anti-influenza_Chain
  source 1..324: mol_type = other RNA
gaagtagtactaacacaatcaccaggaacattatcattaagcccaggacaaagagcaacattaagctgtagagcaagccaaagcgtaagttcaagctatctagcatggtatcaacaaaaaccaggacaagcaccaagattactaatatacgatgcatcaaacagagcaacaggaataccagatagatttagcggaagcggaagcggaacagatttcacactaacaatatcaagactagaaccagaagatttcgcagtatattactgtcaacaatacggaagctcaccatatacatttggacaaggaacaaaattagaaataaaa

SEQ ID NO: 50579 - RNA, 324 nt, synthetic construct
  misc_feature 1..324: note = derived and/or modified sequence opt6 from anti-influenza_Chain
  source 1..324: mol_type = other RNA
gacatacaactcacacaatcaccatcatcactatcagcatcagtaggagacagagtaacaataacatgcagagcatcacaaggaataataacatacctaaactggtaccaacaaaaaccaggaaaagcaccaaaactactaatatacgcaacatactcactacaaaacggagtaccatcaagattctcaggatcaggatcaggaacagacttcacactaacaatatcatcactacaaccagaagacttcgcaacatactactgccaacaatcatactcatcactaatgttcacattcggacaaggaacaaaactagacataaaa

SEQ ID NO: 50580 - RNA, 324 nt, synthetic construct
  misc_feature 1..324: note = derived and/or modified sequence opt6 from anti-influenza_Chain
  source 1..324: mol_type = other RNA
gaaacagtactaacacaatcaccaggaacattaagcctaacaccaggagaaagagcaacactaagctgtagagtaggacaaagcgtaagcggaagccatctagcatggtatcaacaaaaaccaggacaagcaccaagattactaatatacggagcatcaagcagagccacaggaataccagatagatttggaggaagcgtaagcggaacagatttcacactaacaatatcaagattagaaccagaagatagtgcagtatattactgtcaacaatacggagactcaagatatacatttggacaaggaacaaaattagaaataaaa

SEQ ID NO: 50581 - RNA, 324 nt, synthetic construct
  misc_feature 1..324: note = derived and/or modified sequence opt6 from anti-influenza_Chain
  source 1..324: mol_type = other RNA
gaaatagtactaacacaatcaccaggaacactatcactatcaccaggagaaagagcaacactatcatgcagagcatcacaatcagtatcatcatcacaactagcatggtaccaacaaaaaccaggacaagcaccaagattaataatatacggagcatcaacaagagcaacaggaataccagacagattctcaggatcaggatcaggaacagacttcacactaacaataggaagactagaaccagaagacttcgcagtattcttctgccaacaatactcaacatcaccaccaacattcggacaaggaacaaaagtagacttcaaa

SEQ ID NO: 50582 - RNA, 324 nt, synthetic construct
  misc_feature 1..324: note = derived and/or modified sequence opt6 from anti-influenza_Chain
  source 1..324: mol_type = other RNA
gatatagtactaacacaatcaccaggaacattaagcctaagtccaggagaaagagcaacattaagctgtagagcaagccaaagcgtaagctcaagctatttagcatggtatcaacaaaaaccaggacaagcaccaagattagtaatgtacggagcagcaacaagagcaacaggaataccagatagatttagcggaagcggaagcggaccagacttcacactaacaatatcaagattagaaccagaagatttcgcaatgtattactgtcaacaatacggaaactcaccaataacatttggacaaggaacaagattagaaataaaa

SEQ ID NO: 50583 - RNA, 324 nt, synthetic construct
  misc_feature 1..324: note = derived and/or modified sequence opt6 from anti-influenza_Chain
  source 1..324: mol_type = other RNA
gaaatagtactaacacaatcaccagcaacactatcattatcaccaggagaaagagcaacactatcatgcagagcatcacaatcagtatcatcatacctagcatggtaccaacaaaaaccaggacaagcaccaagactactaatatacgacgcatcaaacagagcaacaggaataccagcaagattctccggatcaggatcaggaacagacttcacactaacaatatcatcactagaaccagaagacttcgcagtatactactgccaacaaagatcacactggccaccaataacattcggacaaggaacaagactagaaataaaa

SEQ ID NO: 50584 - RNA, 324 nt, synthetic construct
  misc_feature 1..324: note = derived and/or modified sequence opt6 from anti-influenza_Chain
  source 1..324: mol_type = other RNA
agctatgaattaacacaaccaccaagcgtaagtgtaagcccaggacaaacagcaagaataacatgtagtggagacgcactaccaaaacaaaacgcatactggtaccaacaaaaaccaggacaagcaccagtactattaatatataaagatagcgaaagaccaagcggaataccagaaagattctcaggatcaagctcaggaacaacagtaacattaacaataagtggagtacaagcagaagacgaagcagattactattgccaaagcgcagactcaagcggaacatcatgggtattcggaggaggaacaaaactaacagtatta

SEQ ID NO: 50585 - RNA, 324 nt, synthetic construct
  misc_feature 1..324: note = derived and/or modified sequence opt6 from anti-influenza_Chain
  source 1..324: mol_type = other RNA
tcatatgtattaacacaagcaccatcagtatcagtagcaccaggacaaacagcaagaataacatgcggaggaaatgcaataggatcaaaaaaagtacattggtatcaacataaagcaggacaagcaccagtattagtagtatatgatgatacagacagaccatcaggaataccagaaagatttagtggaagtaatagctggagtacagcaacattaacaataaatagagtagaagcaggagatgaagcagactattattgtcaagtatgggatttcacaatagatcatgtagtatttggaggaggaacaaaattaacagtatta

SEQ ID NO: 50586 - RNA, 324 nt, synthetic construct
  misc_feature 1..324: note = derived and/or modified sequence opt6 from anti-influenza_Chain
  source 1..324: mol_type = other RNA
gaaatagtactaacacaatcaccaggaacattaagcttatcaccaggagaaagagcaacattaagctgtagagcaagtcaaagcgtaagctcaagctatctagcatggtatcaaaaaaaaccaggacaagcaccaagattactaatatacggagcatcaacaagagcaacaggaataccagatagatttacaggaagcggaagcggaacagatttcacactatcaatatcaagattagaaccagaagatttcgcagtatattactgtcaacatttcggaacatcagtatttacatttggaggaggaacaaaagtagaaataaaa

SEQ ID NO: 50587 - RNA, 324 nt, synthetic construct
  misc_feature 1..324: note = derived and/or modified sequence opt6 from anti-influenza_Chain
  source 1..324: mol_type = other RNA
gaaatagtaatgacacaatcaccagcaacactatcagtatcaccaggagaaagagcaacattatcatgcagagcatcacaaagcgtaggaaattcactagcatggtaccaacaaagaccaggacaagcaccaagactattaatatacggagcatcaacaagagcaacaggaataccaccaagattctcaggatcaggatcaggaacagaattcacattaacaatatcatcactacaaacagaagacttcgcagtatactactgccaacaatacataaattggagaccactatcattcggaggaggaacaaaagtagaaataaaa

SEQ ID NO: 50588 - RNA, 324 nt, synthetic construct
  misc_feature 1..324: note = derived and/or modified sequence opt6 from anti-influenza_Chain
  source 1..324: mol_type = other RNA
caagaaagcggagcagaattagtaagaccaggagcaagcgtaaaattaagctgtaaagatagcggatacacattcacaacatattggatgaactgggtaaaacaaagaccagaacaaggactagaatggataggaagaatagatccatatgactcagaaacacactataaccaaaaatttaaagataaagcaatattaacagtagacaaaagctcaaacacagcatatatgcaactatcaagcctaacatcagaagatagcgcagtatattactgtgtaagaggaggaagcacagtagcgtactttggagtatggggacaagga

SEQ ID NO: 50589 - RNA, 324 nt, synthetic construct
  misc_feature 1..324: note = derived and/or modified sequence opt6 from anti-influenza_Chain
  source 1..324: mol_type = other RNA
gaaatagtattaacacaatcaccaggaacattaagtttaagcccaggagaaagagcaacattaagctgtcgagcaagccaaagagtaagctcatacttagcatggtaccaacaaaaaccaggacaagcaccaagactattaatatatggagcaagtacaagagcagcaggaataccagacagattctcaggatcaggatcaggaacagactttacattaacaataagcagactagaaccagaagactcagcagtatactattgccaacaatatggaagaacaccactaacattcggaggaggaacaaaagtagaaataaaaaga

SEQ ID NO: 50590 - RNA, 324 nt, synthetic construct
  misc_feature 1..324: note = derived and/or modified sequence opt6 from anti-influenza_Chain
  source 1..324: mol_type = other RNA
gaaatagtaatgacacaatcaccaggaacattatcattatcaccaggagaacgagcaacattatcatgtagagcatcacaatcagtatcatcatcatatctagcatggtatcaacaaaaaccaggacaagcaccaagactactaatattcggagcatcatcaagagcaacaggaataccagacagattttcaggatcaggatcaggaacagacttcacactaacaatatcaagactagaaccagaagacttcgcagtatattactgtcaacaatacggatcatcactaacattcggaggaggaacaaaactagaaataaaaaga

SEQ ID NO: 50591 - RNA, 324 nt, synthetic construct
  misc_feature 1..324: note = derived and/or modified sequence opt6 from anti-influenza_Chain
  source 1..324: mol_type = other RNA
gaaatagtactatatcaatcaccaggaacattaagtttaagcccaggagaaagagcaacactaagctgtagagcaagccaaagagtaagctcatacttagcatggtaccaacaaaaaccaggacaagcaccaagactattaatatatggagcaagcacaagagcagcaggaataccagacagattctcaggatcaggatcaggaacagactttacattaacaataagcagactagaaccagaagactcagcagtatactattgccaacaatatggaagaacaccactaacattcggaggaggaacaaaagtagaaataaaaaga

SEQ ID NO: 50592 - RNA, 324 nt, synthetic construct
  misc_feature 1..324: note = derived and/or modified sequence opt6 from anti-influenza_Chain
  source 1..324: mol_type = other RNA
gacatagtactaacacaagcaccatcagtatcagtatcaccaggacaaacagcatcaataacatgctcaggagacagactaggagaaaaattcgcatcatggtaccaacaaaaaccaggacaatcaccagtactagtaatatacgaagactcaaaaagaccatcaggaataccagacagattctcaggatcaaactcaggaaacacagcaacactaacaatatcaggaacacaaataatggacgaaggagacttcttctgccaagcatgggactcatcaacagtagtattcggaggaggaacaaaactaacagtactaggacaa

SEQ ID NO: 50593 - RNA, 324 nt, synthetic construct
  misc_feature 1..324: note = derived and/or modified sequence opt6 from anti-influenza_Chain
  source 1..324: mol_type = other RNA
gatatagaactaacacaatcaccatcagtatcagtatcgccaggacaaacagcatcaataacatgctcaggagataaattaggagataaatttgtatgttggtatcaacaaaaagcaggacaaagcccaatagtagtaatataccaagacgataaaagaccatcaggaataccagaaagatttagcggaagcaatagcggaaacacagcaacactaacaatatcaggaacacaagcaatggatgaagcagactatttctgtcaagcatgggatagcacaacagtagtatttggaggaggaacaaaattaacagtactaggacaa

SEQ ID NO: 50594 - RNA, 324 nt, synthetic construct
  misc_feature 1..324: note = derived and/or modified sequence opt6 from anti-influenza_Chain
  source 1..324: mol_type = other RNA
caatcagtactaacacaaccaccatcagcatcaggatcaagaggacaatcaataacaatatcatgcacaggatcaacatcagacataggatcatacaactacgtatcatggtaccaacaacacccaggaacagcaccaaaagtaatactatacgaagtatcacaaagaccatcaggagtaccagacagattctcaggatcaaaatcaggaaacacagcattcctaacagtaagcggactacaaacagacgacgaagcagactactactgcgcatcatacgcaggaaacaacatatacgtattcggatcaggaacaaaagtaaca

SEQ ID NO: 50595 - RNA, 327 nt, synthetic construct
  misc_feature 1..327: note = derived and/or modified sequence opt6 from anti-influenza_Chain
  source 1..327: mol_type = other RNA
aactttatgttaacacaaccacatagcgtaagcgaaagcccaggaaaaacagtaacaataagctgtacaggaagcggaggaaatatagcaagaaattacgtacaatggtaccaacaaagaccaggaagcgcaccagtaacagtaatattagaagatgacaaaagaccaagcggaataccagacagattcagcggatcaatagatagatcaagcaatagcgcatcattaacaataagcggactaagaacagaagacgaagcattatactattgccaaagctatgacgatagcgatctagtagtatttggaggaggaacaaaattaaca

SEQ ID NO: 50596 - RNA, 327 nt, synthetic construct
  misc_feature 1..327: note = derived and/or modified sequence opt6 from anti-influenza_Chain
  source 1..327: mol_type = other RNA
atgctagaaccactacaaatactaagcatatgctcattcatactatcagcattacacttcatggcatggacaataggacacctaaaccaaataaaaagaggagtaaacctaaaaatacaaataagaaacccaaacaaagaagcaataaacagagaagtatcaatactaagacacaactaccaaaaagaaatacaagcaaaagaaacaatgaaaaaaatactaagcgacaacatggaagtactaggagaccacatagtagtagaaggactaagcacagacgaaataataaaaatgggagaaacagtactagaagtagaagaactacaa

SEQ ID NO: 50597 - RNA, 327 nt, synthetic construct
  misc_feature 1..327: note = derived and/or modified sequence opt6 from anti-influenza_Chain
  source 1..327: mol_type = other RNA
gacataagactaacacaatcaccagcaacactaagcgtatcaccaggagaaagagcaacactatcatgcagagcatcacactcagtatcaagaaacctagcatggtaccaacaaaaaccaggaagagcaccaagactactagtatacgacacatcatcaagagcaacaggaataccagcaagattctcaggatcaggatcaggaacagaattcacactaacaatatcatcactacaatcagaagacttcgcagtatactactgccaacaatacaacaactggccaagaacattcggacaaggaacaaaagtagacataaaaagaaca

SEQ ID NO: 50598 - RNA, 327 nt, synthetic construct
  misc_feature 1..327: note = derived and/or modified sequence opt6 from anti-influenza_Chain
  source 1..327: mol_type = other RNA
gaaatagtaatgacacaatcaccaggaacattatcattaagcccaggagaaagagcaacattaagctgtagagcaagccaaagcgtaagcagcagctatctagcatggtatcaacaaaaaccaggacaagcaccaagattactaatatacggagcatcaacaagagcaacaggagtaccagatagatttcacggaggaggaagcggaacagatttcacactaacaatatcaagattagaaccagaagatttcgcagtatattactgtcaacaatacgatacatcaagcgggctaacattcggaggaggaacaaaagtagaaataaaa

SEQ ID NO: 50599 - RNA, 327 nt, synthetic construct
  misc_feature 1..327: note = derived and/or modified sequence opt6 from anti-influenza_Chain
  source 1..327: mol_type = other RNA
gaaatagtaatgacacaattcccagcaacactatcagtatcaccaggagaaagagtaacactatcatgcagagcatcacaatcagtatccaacaacctagcatggtaccaacaaaaaccaggacaaccaccaagactactaatatacgacgcatcaacaagagcaacaggagtaccagcaaaattctcaggaacaggatcaggaacagaattcacactatcaatatcatcactacaatcagaagacttcgcagtatactactgccaacaataccacaactggccaccatcatactcattcggactaggaacaaaactagaaataaaa

SEQ ID NO: 50600 - RNA, 327 nt, synthetic construct
  misc_feature 1..327: note = derived and/or modified sequence opt6 from anti-influenza_Chain
  source 1..327: mol_type = other RNA
gaaataatactagcacaatcaccaggaacattatcattaagcccaggagaaagagcaacattaagctgtagagcaagccaattcgtaagcacaagaagcctagcatggtatcaacaaagaccaggacaagcaccaagattactaatatacggagcatcaagcagagcaacaggaataccagatagatttagcggaagcggaagcggaacagatttcacactaacaatatcaagattagaaccagaagatttcgcagtatattactgtcaacattacggatactcaccaagatacgcattcggacaaggaagtaaagtagaaataaaa

SEQ ID NO: 50601 - RNA, 327 nt, synthetic construct
  misc_feature 1..327: note = derived and/or modified sequence opt6 from anti-influenza_Chain
  source 1..327: mol_type = other RNA
gaaatagtactaacacaatcaccaggaacattatcattaagcccaggagaaagagcaacattaagctgtagagcaagccatttcgtaaactatagaagcctagcatggtatcaacaaacaccaggacaagtaccaagattactaatatacggagcatcaacaagagccacaggcataccagatagatttagcggaagcggaagcggaacagatttcacactaacaatatcaagattagaaccagaagatttcgcagtatatttctgtcaacaatacggaggatcaccaagatacacattcggacaaggaacaagactagaaataaaa

SEQ ID NO: 50602 - RNA, 327 nt, synthetic construct
  misc_feature 1..327: note = derived and/or modified sequence opt6 from anti-influenza_Chain
  source 1..327: mol_type = other RNA
gaaatagtactaacacaatcaccaggaacattaagcttaagcccaggagaaagagcaacattaagttgtagagcaagccatttcgtaataggaagagcagtagcatggtatcaacaaaaaccaggacaagcaccaagattactaatatacggagcatcaagcagagcaacaggaataccagatagatttagcggaagcggatcaggaacagatttcacattaacaatatcaagattagaaacagaagatttcgcagtattttactgtcaacattacggaagctcaccaagatacgcattcggacaaggaacaaaactagaaataaaa

SEQ ID NO: 50603 - RNA, 327 nt, synthetic construct
  misc_feature 1..327: note = derived and/or modified sequence opt6 from anti-influenza_Chain
  source 1..327: mol_type = other RNA
gaaatagtattaacacaatcaccagcaacactatcactatcaccaggagaaagagcaacactatcatgcagagcatcacaatcagtaggaaactacctagcatggtaccaacaaaaaccaggacaagcaccaagactactaatatacgactcatcaaacagagcaccaggaataccagcaagattctcaggatcaggatcaggaacagacttcacactaacaatatcatcactagcaccagaagacttcgcagtatactactgccaacaaagatcaaaatggccaccaatgtactcattcggacacggaacaaaactagaaataaaa

SEQ ID NO: 50604 - RNA, 327 nt, synthetic construct
  misc_feature 1..327: note = derived and/or modified sequence opt6 from anti-influenza_Chain
  source 1..327: mol_type = other RNA
caagcagtagtaacacaagaaccatcattaacagtatcaccaggaggaacagtaacattaacatgcggatcatcaacaggaccagtaacatcaggacactatccatattggtttcaacaaaaaccaggacaagcaccaagaacactaatatcagcaacatcaaacacacactcatggacaccagcaagattttcaggatcattactaggaggaagagcagcactaacactatcaggagcacaaccagaagatgaagcagactattactgtttcttaagctattcaggagcatgggtattcggaggaggaacaacattaacagtacta

SEQ ID NO: 50605 - RNA, 327 nt, synthetic construct
  misc_feature 1..327: note = derived and/or modified sequence opt6 from anti-influenza_Chain
  source 1..327: mol_type = other RNA
gcaatacaaatgacacaatcaccatcaagcctatcagcatcagtaggagacagagtaacaataacatgcagagcatcacaaaacataagatcatacctaaactggtaccaacaaaaaccaggaaaagcaccaaacctactaatatacggaacaacatcactagaatcaggagtaccatcaagattctcaggctcaggatcaggaacagacttcacattaacaatatcatcactacaaccagaagacttcgcaacatactactgccaacaatcataccacacaccacaaacattcggacaaggaacaaaagtagaaataaaaagaaca

SEQ ID NO: 50606 - RNA, 327 nt, synthetic construct
  misc_feature 1..327: note = derived and/or modified sequence opt6 from anti-influenza_Chain
  source 1..327: mol_type = other RNA
gacatacaaatgacacaatcaccatcatcactatcagcatcagtaggagacagaataacaataacatgcagagcaagccaaggaatagacaactacctagcatggttccaacaaaaaccaggaaaagtaccagaactattaatatacgcagcatcaacactacaatcaggagtaccatcaagattctcaggatcaggatcaggaacaggattcacactaacaatatcatcactacaaccagaagacgtagcaacatactactgccaaaaatacgactcagcaccactaacattcggaggaggaacaaaagtagacataaaaagaaca

SEQ ID NO: 50607 - RNA, 327 nt, synthetic construct
  misc_feature 1..327: note = derived and/or modified sequence opt6 from anti-influenza_Chain
  source 1..327: mol_type = other RNA
gacatacaactaacacaatcaccatcatcactatcagcatcagtaggagaccgagtaacaataacatgcagagcatcacaaggaataacagactacctagcatggtaccaacaaaaaccaggaacaataccaaaactactaatatacgcagcatcaacactacaatcaggagtaccatcaagattctcaggaggaggatacggaacagacttcacactaacaatatcatcattacaaccagaagacgtagcaacatactactgccaaaaatacaactcagcaccactaacattcggaggaggaacaaaagtagaaataaaaagaaca

SEQ ID NO: 50608 - RNA, 327 nt, synthetic construct
  misc_feature 1..327: note = derived and/or modified sequence opt6 from anti-influenza_Chain
  source 1..327: mol_type = other RNA
gatatagtaatgacacaatcaccatttagcttatcattaagcccaggagaaagagcaacattaagctgtagagcaagccaaagcataagcaattacttagcatggtaccaacaaaaaccaggacaagcaccaagattattaatatatgacagcagcaatagagcaacaggagtaccagcaagattctcaggatcaggatcaggaacagactttacattaacaataagctcactagaaccagaagactttgcagtatactattgccaacaaagaagcaattggatgtacacattcggacaaggaacaaaagtagaaataaaaagaaca

SEQ ID NO: 50609 - RNA, 327 nt, synthetic construct
  misc_feature 1..327: note = derived and/or modified sequence opt6 from anti-influenza_Chain
  source 1..327: mol_type = other RNA
gacatacaaatgacacaatcaccatcatcattatcagcatcagtaggagacagagtaacaataacatgcagagcatcacaaggaatatcatcatacctagcatggtaccaacaaaaaccaggaaaagtaccaacactactaatatacgacgcatcaacactaagatcaggagtaccatcaagattctcaggatcaggatcagcaacagacttcacactaacaatatcatcactacaaccagaagacgtagcaacatactactgccaaagatacaactcagcaccaccaataacattcggacaaggaacaagactagaaataaaaaga

SEQ ID NO: 50610 - RNA, 327 nt, synthetic construct
  misc_feature 1..327: note = derived and/or modified sequence opt6 from anti-influenza_Chain
  source 1..327: mol_type = other RNA
gaaatagtaatgacacaatcaccaggaacactatcactatcaccaggagaaagagcaacactatcatgcagagcatcacaatcagtatcatcatcatacttagcatggtaccaacaaaaaccaggacaagcaccaagactattaatatacgacgcatcatcaagagcaacagacataccagacagattctcaggatcaggatcaggaacagacttcacactaacaatatcaagactagaaccagaagacttcgcagtatactactgccaacaatacggatcatcactatggacattcggacaaggaacaaaagtagaaataaaaaga

SEQ ID NO: 50611 - RNA, 327 nt, synthetic construct
  misc_feature 1..327: note = derived and/or modified sequence opt6 from anti-influenza_Chain
  source 1..327: mol_type = other RNA
tcatatgtattaacacaaccaccatcagtatcagtagcaccaggacaaacagcaagaataacatgtggaggaaataatataggatcaaaatcggtacattggtatcaacaaaaaccaggacaagcaccagtattagtagtatatgatgattcagacagaccatcaggaataccagaaagatttagtggaagtaatagtgggaatacagcaacattaacaatatcaagagtagaagcaggagatgaagcagattattattgtcaagtatgggatagttcaagtgatcatgcagtatttggagggggaacacaattaacagtattagga

SEQ ID NO: 50612 - RNA, 327 nt, synthetic construct
  misc_feature 1..327: note = derived and/or modified sequence opt6 from anti-influenza_Chain
  source 1..327: mol_type = other RNA
gaaatagtactaacacaatcaccaggaacattatcattaagcccaggagaaagagcaacattaagctgtagagcaagccaaagcgtaagcagcagctatctagcatggtatcaacaaaaaccaggacaagcaccaagattactaatatacggagcatcaagcagagcaacaggaataccagatagatttagcggaagcggaagcggaacagatttcacactaacaatatcaagattagaaccagaagatttcgcagtatattactgtcaacaatacggaagctcaccaagaacatttggaggaggaacaaaagtagaaataaaaaga

SEQ ID NO: 50613 - RNA, 327 nt, synthetic construct
  misc_feature 1..327: note = derived and/or modified sequence opt6 from anti-influenza_Chain
  source 1..327: mol_type = other RNA
tcatatgtattaacacaaccaccatcagtatcagtagcaccaggacaaacagcaagaataacatgtggaggaaataatataggatcaaaaggagtacattggtatcaacaaaaaccaggacaagcaccagtattagtagtatatgatgattcagatagaccatcaggaataccagaaagatttagtggaagtaatagtggaaatacagcaacattaacaatatcaagagtagaagcaggagatgaagcagattattattgtcaagtatgggatagttcaagtgatcatgtagtatttggaggaggaacaaaattaacagtattagga

SEQ ID NO: 50614 - RNA, 327 nt, synthetic construct
  misc_feature 1..327: note = derived and/or modified sequence opt6 from anti-influenza_Chain
  source 1..327: mol_type = other RNA
gaaatagtactaacacaatcaccaggaacattatcattaagcccaggagaaagagcaacattaagctgtagagcaagccaaagcgtaagcagcaactatctaggatggacacaacaaaaaccaggacaagcaccaagattactaatatacggagcatcaagcagagcatcaggaataccagatagatttagtggaggaggaagcggaacagatttcacactaacaatatcaagattagaaccagaagatttcgcagtatattactgtcaacaatacggaagctcaccactaacatttggaggaggaacaaaagtagaaataaaaaga

SEQ ID NO: 50615 - RNA, 327 nt, synthetic construct
  misc_feature 1..327: note = derived and/or modified sequence opt6 from anti-influenza_Chain
  source 1..327: mol_type = other RNA
caaagtgtagtaacacaaccaccatcagtatcagtagcaccaggacaaacagcaagaataacatgcggaggaaataatataggatcaaaatcagtacattggtatcaacaaaaaccaggacaagcaccagtattagtagtatacgatgactcagacagaccatcaggaataccagaaagatttagtggaagtaatagtggaaatacagcaacattaacaatatcaagagtagaagcaggagatgaagcagactattactgtcaagtatgggatagttcaagtgatcattatgtatttggaacaggaacaaaagtaacagtattagga

SEQ ID NO: 50616 - RNA, 327 nt, synthetic construct
  misc_feature 1..327: note = derived and/or modified sequence opt6 from anti-influenza_Chain
  source 1..327: mol_type = other RNA
tcatacgtattaacacaaccaccatcagaatcagtagcaccaggacaaacagcaagaataacatgtggaggaaacaatataggaagaaattcagtacactggtaccaacaaaaaccaggacaagcaccagtattagtagtatatgacgactcagacagaccatcaggaataccagaaagattctcaggatcaaaatcaggaaatacagcaacactaataatatcaagagtagaagtaggagacgaagcagattactattgccaagtatggcactcatcatcagaccattacgtattcggaacaggaacaaaagtaacagtattagga

SEQ ID NO: 50617 - RNA, 327 nt, synthetic construct
  misc_feature 1..327: note = derived and/or modified sequence opt6 from anti-influenza_Chain
  source 1..327: mol_type = other RNA
gaaatagtaatgacacaatcaccaggaacactatcactatcaccaggacaaagagcaacactatcatgcagagcatcacaatcagtatcatcatcatacctagcatggtaccaacaaaaaccaggacaagcaccaagactactaatgtacggagcatcatcaagagcaacaggaataccagacagattctcaggatcaggatcaggaacagacttcacattaacaatatcaagactagaaccagaagacttcgcagtatactactgccaacaatacggatcatcatcactaacattcggaggaggaacaaaactagaaataaaaaga

SEQ ID NO: 50618 - RNA, 327 nt, synthetic construct
  misc_feature 1..327: note = derived and/or modified sequence opt6 from anti-influenza_Chain
  source 1..327: mol_type = other RNA
caagcaggattaacacaaccaccatcagtatcagtagcaccaggacaaacagcaagaataacatgtggaggaaacaatataggatcaaaatcagtacactggtaccaacaaaaaccaggacaagcaccagtattagtagtatatgacgattcagatagaccatcaggaataccagaaagattctcaggatcaaactcaggaaatacagcaacactaacaatatcaagagtagaagcaggagacgaagcagattactattgccaagtatgggactcatcatcagaccatgtagtattcggaggaggaacaaaactaacagtattagga

SEQ ID NO: 50619 - RNA, 327 nt, synthetic construct
  misc_feature 1..327: note = derived and/or modified sequence opt6 from anti-influenza_Chain
  source 1..327: mol_type = other RNA
caaagtgtagtaacacaaccaccatcagaatcagtagcaccaggacaaacagcaagaataacatgcggaggacataatataggatcaaattcagtacattggtatcaacaaaaaccaggacaagcaccagtattagtagtatatgataattcagacagaccatcaggaataccagaaagatttagcggaagtaatagtggaaatacagcaacattaacaatatcaagagtagaagcaggagatgaagcagactattattgtcaagtatggggaagttcaagtgatcattatgtatttggaacaggaacaaaagtaacagtattagga

SEQ ID NO: 50620 - RNA, 327 nt, synthetic construct
  misc_feature 1..327: note = derived and/or modified sequence opt6 from anti-influenza_Chain
  source 1..327: mol_type = other RNA
gaaatagtactaacacaatcaccaggaacattaagtttaagcccaggagaaagagcaacattaagctgtagagcaagccaaagcgtaagctcaaactatctaggatggtatcaacaaaaaccaggacaagcaccaagattactaatatacggagcatcaagcagagcatcaggaataccagatagatttagtggaggaggaagcggaacagatttcacactaacaatatcaagattagaaccagaagatttcgcagtatattactgtcaacaatacggaagctcaccattaacatttggaggaggaacaaaagtagaaataaaaaga

SEQ ID NO: 50621 - RNA, 327 nt, synthetic construct
  misc_feature 1..327: note = derived and/or modified sequence opt6 from anti-influenza_Chain
  source 1..327: mol_type = other RNA
gaaatagtactaacacaatcaccagcaacactatcagtaagcccaggagaaagagcaacactatcatgcagagcatcacaatcagtagactcaaacttagcatggtaccaacaaaaaccaggacaagcaccaagactactagtatactcagcatcaacaagagcaacaggaataccagcaagattctcaggatcaggatcaggaacagaattcacactagcaatatcatcactacaatcagaagacttcgcagtatactactgccaacactacacaaactggccaccaagactaacattcggaggaggatcaaaagtagaaataaaa

SEQ ID NO: 50622 - RNA, 327 nt, synthetic construct
  misc_feature 1..327: note = derived and/or modified sequence opt6 from anti-influenza_Chain
  source 1..327: mol_type = other RNA
gaaatagtactaacacaatcaccagcaacactatcagtatcaccaggagaaagagcaacactatcatgcagagcatcacaatcagtatcacacaacctagcatggtaccaacaaaaaccaggacaagcaccaagactactagtatactcagcatcaacaagagcaacaggaataccagcaagattctcaggatcaggatcaggaacagaattcacactagcaatatcatcactacaatcagaagacttcgcagtatactactgccaacactacacaaactacccaccaagactaacattcggaggaggatcaaaagtagaaataaaa

SEQ ID NO: 50623 - RNA, 327 nt, synthetic construct
  misc_feature 1..327: note = derived and/or modified sequence opt6 from anti-influenza_Chain
  source 1..327: mol_type = other RNA
gaaatagtaatgacacaatcaccagcaacactatcagtatcaccaggagaaagagcaacactatcatgcagagcatcacaatcagtagactcaaacctagcatggtaccaacaaaaaccaggacaagcaccaagattactagtatactcagcatcaacaagagcaacaggaataccagcaagattctcaggatcaggatcaggaacagaattcacattagcaatatcatcactacaatcagaagacttcgcagtatactactgccaacactacacaaactggccaccaagactaacattcggaggaggatcaaaagtagaaataaaa

SEQ ID NO: 50624 - RNA, 327 nt, synthetic construct
  misc_feature 1..327: note = derived and/or modified sequence opt6 from anti-influenza_Chain
  source 1..327: mol_type = other RNA
gaaatagtactaacacaatcaccagcaacactatcagtatcaccaggagaaagagcaacactatcatgcagagcatcacaatcagtatcatcaaacctagcatggtaccaacaaaaaccaggacaagcaccaagactactagtatactcagcatcaacaagagcaacaggaataccagcaagattctcaggatcaggatcaggaacagaattcacactagcaatatcatcactacaatcagaagacttcgcagtatactactgccaacactacacaaactggccaccaagattaacattcggaggaggatcaaaagtagaaataaaa

SEQ ID NO: 50625 - RNA, 327 nt, synthetic construct
  misc_feature 1..327: note = derived and/or modified sequence opt6 from anti-influenza_Chain
  source 1..327: mol_type = other RNA
gaaatagtactaacacaatcaccagcaacactatcagtatcaccaggagaaagagcaacactatcatgcagagcatcacaatcagtagaccacaacctagcatggtaccaacaaaaaccaggacaagcaccaagactactagtatactcagcatcaacaagagcaacaggaataccagcaagattctcaggatcaggatcaggaacagaattcacactagcaatatcatcactacaatcagaagacttcgcagtatactactgccaacactacacaaactggccaccaagactaacattcggaggaggatcaaaagtagaaataaaa

SEQ ID NO: 50626 - RNA, 327 nt, synthetic construct
  misc_feature 1..327: note = derived and/or modified sequence opt6 from anti-influenza_Chain
  source 1..327: mol_type = other RNA
gaaatagtactaacacaatcaccagcaacactatcagtatcaccaggagaaagagcaacactatcatgcagagcatcacaatcagtatcacacaacctagcatggtatcaacaaaaaccaggacaagcaccaagactactagtatactcagcatcaacaagagcaacaggaataccagcaagattctcaggatcaggatcaggaacagaattcacactagcaatatcatcactacaatcagaagacttcgcagtatactactgccaacactacacaaactggccaccaagactaacattcggaggaggatcaaaagtagaaataaaa

SEQ ID NO: 50627 - RNA, 327 nt, synthetic construct
  misc_feature 1..327: note = derived and/or modified sequence opt6 from anti-influenza_Chain
  source 1..327: mol_type = other RNA
gaaatagtactaacacaatcaccagcaacactatcagtatcaccaggagaaagagcaacactatcatgcagagcatcacaatcagtatcacacaacctagcatggtaccaacaaaaaccaggacaagcaccaagattactagtatactcagcatcaacaagagcaacaggaataccagcaagattctcaggatcaggatcaggaacagaattcacattagcaatatcatcactacaatcagaagacttcgccgtatactactgccaacactacacaaacttcccaccaagactaacattcggaggaggatcaaaagtagaaataaaa

SEQ ID NO: 50628 - RNA, 327 nt, synthetic construct
  misc_feature 1..327: note = derived and/or modified sequence opt6 from anti-influenza_Chain
  source 1..327: mol_type = other RNA
gaaatagtactaacacaatcaccagcaacattatcagtatcaccaggagaaagagcaacactatcatgcagagcatcacaatcagtagactcaaacctagcatggtaccaacaaaaaccaggacaagcaccaagactactagtatactcagcatcaacaagagcaacaggaataccagcaagattctcaggatcaggatcaggaacagaattcacactagcaatatcatcactacaatcagaagacttcgcagtatactactgccaacactacacaaacttcccaccaagactaacattcggaggaggatcaaaagtagaaataaaa

SEQ ID NO: 50629 - RNA, 327 nt, synthetic construct
  misc_feature 1..327: note = derived and/or modified sequence opt6 from anti-influenza_Chain
  source 1..327: mol_type = other RNA
gaaatagtactaacacaatcaccagcaacattaagcgtaagcccaggagaaagagcaacattaagctgtagagcaagccaaagcgtagactcaaacttagcatggtaccaacaaaaaccaggacaagcaccaagattattagtatatagcgcaagcacaagagcaacaggaataccagcaagattctcaggatcaggatcaggaacagaatttacattagcaataagctcattacaaagcgaagactttgcagtatactattgccaacactatacaaattacccaccaagactaacattcggaggaggaagcaaagtagaaataaaa

SEQ ID NO: 50630 - RNA, 327 nt, synthetic construct
  misc_feature 1..327: note = derived and/or modified sequence opt6 from anti-influenza_Chain
  source 1..327: mol_type = other RNA
gaaacaacactaacacaatcaccagcaacactatcagtaagcccaggagaaagagcaacactatcatgcagagcatcacaagtaatatcacacaacctagcatggtaccaacaaaaaccaggacaagcaccaagactactaatatacggagcatcaacaagagcatcaggaataccagcaagattctcaggatcaggatcaggaacagactacacactaacaataacatcactacaatcagaagacttcgcagtatactactgccaacactactcaaattggccaccaagactaacattcggaggaggaacaaaagtagaaataaaa

SEQ ID NO: 50631 - RNA, 327 nt, synthetic construct
  misc_feature 1..327: note = derived and/or modified sequence opt6 from anti-influenza_Chain
  source 1..327: mol_type = other RNA
gaaatagtactaacacaatcaccagcaacactatcagtatcaccaggagaaagagcaacattatcatgcagagcatcacaagtaatatcacacaacctagcatggtaccaacaaaaaccaggacaagcaccaagactattaatatacggagcatcaacaagagcatcaggaataccagcaagattctcaggatcaggatcaggaacagactacacactaacaataacatcattacaaagcgaagacttcgcagtatactactgccaacactacagcaactggccaccaagactaacattcggaggaggaacaaaagtagaaataaaa

SEQ ID NO: 50632 - RNA, 327 nt, synthetic construct
  misc_feature 1..327: note = derived and/or modified sequence opt6 from anti-influenza_Chain
  source 1..327: mol_type = other RNA
gaaatagtattaacacaatcaccagcaacactatcagtatcaccaggagaaagagcaacactatcatgcagagcaagccaagtaataagccacaacctagcatggtaccaacaaaaaccaggacaagcaccaagactactaatatacggagcatcaacaagagcatcaggaataccagcaagattctcaggatcaggatcaggaacagactacacactaacaataacatcactacaaccagaagacttcgcagtatactactgccaacactactcaaactggccaccaagactaacattcggaggaggaacaaaagtagaaataaaa

SEQ ID NO: 50633 - RNA, 327 nt, synthetic construct
  misc_feature 1..327: note = derived and/or modified sequence opt6 from anti-influenza_Chain
  source 1..327: mol_type = other RNA
gaaatagtaatgacacaatcaccagcaacactatcagtatcaccaggagaaagagcaacactatcatgcagagcatcacaagtaatatcacacaacttagcatggtaccaacaaaaaccaggacaagcaccaagactactaatatacggagcatcaacaagagcatcaggaataccagcaagattctcaggatcaggatcaggaacagactacacactaacaataacatcactacaatcagaagacttcgcagtatactactgccaacactactcaaactggccaccaagactaacattcggaggaggaacaaaagtagaaataaaa

SEQ ID NO: 50634 - RNA, 327 nt, synthetic construct
  misc_feature 1..327: note = derived and/or modified sequence opt6 from anti-influenza_Chain
  source 1..327: mol_type = other RNA
gaaatagtactaacacaatcaccagcaacactatcagtatcaccaggagaaagagcaacattatcatgcagagcatcacaagtaatatcacacaacctagcatggtaccaacaaaaaccaggacaagcaccaagactactaatatacggagcatcaacaagagcatcaggaataccagcaagattctcaggatcaggatcaggaacagactacacactaacaataacatcactacaatcagaagacttcgcagtatactactgccaacactactcaaacttcccaccaagactaacattcggaggaggaacaaaagtagaaataaaa

SEQ ID NO: 50635 - RNA, 327 nt, synthetic construct
  misc_feature 1..327: note = derived and/or modified sequence opt6 from anti-influenza_Chain
  source 1..327: mol_type = other RNA
gaaatagtactaacacaatcaccagcaaccctatcagtatcaccaggagaaagagcaacactatcatgcagagcatcacaagtaatatcacacaacctagcatggtaccaacaaaaaccaggacaagcaccaagactactaatatacggagcatcaacaagagcatcaggaataccagcaagattctcaggatcaggatcaggaacagactacacactaacaataacatcactacaatcagaagacttcgcagtatactactgccaacactactcaaactacccaccaagactaacattcggaggaggaacaaaagtagaaataaaa

SEQ ID NO: 50636 - RNA, 327 nt, synthetic construct
  misc_feature 1..327: note = derived and/or modified sequence opt6 from anti-influenza_Chain
  source 1..327: mol_type = other RNA
gaaatagtactaacacaatcaccagcaacactatcagtatcaccaggagaaagagtaacactatcatgcagagcatcacaatcagtagcaaacaacctagcatggtaccaacaaaaaccaggacaatcaccaagactactaatatacggagcatcaacacgagacacaggaataccagcaagattctcaggatcaggatcaggaacagaattcacactaacaatatcatcactacaatccgaagacttcgcagtatactactgccaacaatacaacaactggccaccaatgtacacattcggacaaggaacaaaactagaaataaaa

SEQ ID NO: 50637 - RNA, 327 nt, synthetic construct
  misc_feature 1..327: note = derived and/or modified sequence opt6 from anti-influenza_Chain
  source 1..327: mol_type = other RNA
gacatagtaatgacacaatcaccatcaacactatcagcatcagtaggagacagagtaacaataacatgcagagcatcacaatcaataggaaactggttagcatggtaccaacaaaaaccaggaaaagcaccaaaattactaatatacaaagtatcaacactagaatcaggagtaccatcaagattctcaggatcaggatcaggaacagaattcacactaacaataaactcactacaaccagacgacttcgcaacatactactgccaaagatacacatcaaactcacaaggattcacattcggacaaggaacaaaactagaaataaaa

SEQ ID NO: 50638 - RNA, 327 nt, synthetic construct
  misc_feature 1..327: note = derived and/or modified sequence opt6 from anti-influenza_Chain
  source 1..327: mol_type = other RNA
gacatagtaatgacacaatcaccagcaacactatcagtatcaccaggagaaagagcaacattatcatgcagagcatcacaagtagtaggaacaaacctagcatggtaccaacaaaaaccaggacaagcaccaagactactaatatacgcagcatcaacaagagcaacaggaataccagcaagattctcaggatcaggatttggaacagacttcacattaacaatatcatcactacaatcagaagacttcgcagtatactactgccaacaatataacaactggccactatcattcggaggaggaacaaaagtagaaataagaagaaca

SEQ ID NO: 50639 - RNA, 327 nt, synthetic construct
  misc_feature 1..327: note = derived and/or modified sequence opt6 from anti-influenza_Chain
  source 1..327: mol_type = other RNA
gacatacaaatgacacaatcaccatcatcactatcagcatcagtaggagacagagtaacaatagtatgcagagcatcacaaggaataaacacccacctacactggtaccaacaaaaaccaggaaaagcaccaaaactattaatatactcagcatcaacactacacacaggagtaccatcaagactatcaggatcaggatcaggaacagacttcacactatcaatatcatcactacaaccagaagacttcgcaacatactactgccaacaatcatacaactacccaagaacattcggacaaggaacaaacgtcgacataaaaagaaca

SEQ ID NO: 50640 - RNA, 327 nt, synthetic construct
  misc_feature 1..327: note = derived and/or modified sequence opt6 from anti-influenza_Chain
  source 1..327: mol_type = other RNA
gacatactaatgacacaatcaccatcatcactatcagcatcagtaggagacagagtaacaataacatgcagagcatcacaagacataagaaacagattagcatggtaccaacaaaaaccaggaaaagcaccaaaaagactaatatacgcagcatcatcactacaatcaggagtaccatcaagattctcaggatcaggatcaggaacagaattcacactaacaataaactcactacaaccagaagacttcgcaacatactactgcttacaacacaactcatacccatggacattcggaccaggaacaaaagtagaaataaaaagaaca

SEQ ID NO: 50641 - RNA, 327 nt, synthetic construct
  misc_feature 1..327: note = derived and/or modified sequence opt6 from anti-influenza_Chain
  source 1..327: mol_type = other RNA
gacatagtaatgacacaatcaccagcaacactatcagtatcaccaggagaaggagcaacactatcatgcagagcatcacaaggaataggatcaaacctagcatggtaccaacacaaaccaggacaagcaccaagactactaatatacgcagcatcaacaagagcaacaggagtaccagcaagattctcaggatcaggatcaggaacagaattcacactaacaatatcatcattacaatcagaagacctagcagtatacttctgccaacaatacaacacatggccactaacattcggaggaggaacaaaagtagaaataataagaaca

SEQ ID NO: 50642 - RNA, 327 nt, synthetic construct
  misc_feature 1..327: note = derived and/or modified sequence opt6 from anti-influenza_Chain
  source 1..327: mol_type = other RNA
gacatagtaatgacacaatcaccatcaacactatcagcatcagtaggagacagagtaacaataacatgcagagcatcacaaacaatatacagatggctagcatggtaccaacaaaaaccaggaaaagcaccaaaagtactaatatacaaagcatcaacactagaatcaggagtaccatcaagattctcaggatcaggatcaggaacagaattcacactagcaatatcatcactacaaccagacgacttcgcaacatactactgccaacaatacaactcattcccatacagattcggacaaggaacaaaagtagaaataaaaagaaca

SEQ ID NO: 50643 - RNA, 327 nt, synthetic construct
  misc_feature 1..327: note = derived and/or modified sequence opt6 from anti-influenza_Chain
  source 1..327: mol_type = other RNA
gacatagtaatgacacaatcaccatcatcactatcagcatcagtaggagacagagtatcaataacatgcagagcatcacaaacaataacaagattcctaaactggtaccaacaaaaaccaggaaaaggaccaaaactactaatatacgcagcatccacagtacacagaggagtaccatcaagattctcaggatcaggatcaggaacagacttcacactaacaatatcatcattacaaccagaagacttcgcaacatactactgccaacaatcatactcagcaccattcacattcggaccaggaacaacagtagacataagaagaaca

SEQ ID NO: 50644 - RNA, 327 nt, synthetic construct
  misc_feature 1..327: note = derived and/or modified sequence opt6 from anti-influenza_Chain
  source 1..327: mol_type = other RNA
gacatagtaatgacacaaccaccagcaacactatcagtatcaccaggagaaagagcaacattatcatgcggagcatcacaaggactaggatcaaacctagcatggtaccaacaaaaaccaggacaagcaccaagactactaatatacgcagcatcaacaagagcaacaggaataacagcaagattctcaggatcaggatcaggaacagaattcacactaacaataaactcactacaatcagaagacttcgcactatactactgccaacaatacacatactggccactaacattcggaggaggaacaaaagtagaaataaaaagaaca

SEQ ID NO: 50645 - RNA, 327 nt, synthetic construct
  misc_feature 1..327: note = derived and/or modified sequence opt6 from anti-influenza_Chain
  source 1..327: mol_type = other RNA
gatatagtactaacacaatcaccagcaacactaagcgtaagcccaggagaaagagcaacattaagctgtagagcaagccaaagtgtaaacagaaacttagcatggttccaacaaataccaggacaagcaccaagactattaatatttgacgcaagcacaagagcagcagatataccagcaagattctcaggaggaggatcaggagcagaatttacattaacagtaagctcactacaaccagaagactttgcagtatactattgccaacaatatgacaaatggccaccaggattcggacaaggaacaaaagtagaaataaaaagaaca

SEQ ID NO: 50646 - RNA, 330 nt, synthetic construct
  misc_feature 1..330: note = derived and/or modified sequence opt6 from anti-influenza_Chain
  source 1..330: mol_type = other RNA
caatcagtattaacacaaccaccatcagcatcaggagcaccaggacaaagagtaacactatcatgctcaggatcaggaagcaatataggatcaaacacagtatcatggtaccaacaattaccaggaacagcaccaaaactattagtatttacaaataaccaaagaccatcaggagtaccagacagattctcaggatcaaaatcaggaacatcagcatcactagcaatatcaggactacaatcagaagacgaagcagactactactgcgcagcatgggacgactcactaaacggacaactattcggaggaggaacaaaactaacagtatta

SEQ ID NO: 50647 - RNA, 330 nt, synthetic construct
  misc_feature 1..330: note = derived and/or modified sequence opt6 from anti-influenza_Chain
  source 1..330: mol_type = other RNA
caatcagtattaacacaaccaccatcagtatcagcagcaccaggacaaagagtaacaatatcatgctcaggaacatcatcaaacataggaaaaaactacgtatcatggtaccaacaactaccaggagcagcaccaaaactactaatatacgacaatgacaaaagaccatcaggaataccagacagattctcaggatcaaaatcaggaacatcagcaacactaggaataacaggactacaaacaggagacgaagcagactactactgcggaacatgggactcatcattatcagtaggaatgttcggaggaggaacaagactaacagtacta

SEQ ID NO: 50648 - RNA, 330 nt, synthetic construct
  misc_feature 1..330: note = derived and/or modified sequence opt6 from anti-influenza_Chain
  source 1..330: mol_type = other RNA
gaaacaacactaacacaatcaccagcaacattaagcgtaagcccaggagaaagagcaacactaagctgcagagcaagccaaagcgtaagcagaaacttagcatggtaccaacaaaaaccaggacaagcaccaagactattaatatatggagcaagctcaagagcaacaggaataccagacagattctcaggatcaggatcaggaacagactttacattaacaataagcagactagaaccagaagactttgcagtatactattgccaacaatatggatcaagctcaataacattcggacaaggaacaagactagaaataaaaagaacagta

SEQ ID NO: 50649 - RNA, 330 nt, synthetic construct
  misc_feature 1..330: note = derived and/or modified sequence opt6 from anti-influenza_Chain
  source 1..330: mol_type = other RNA
caatcagtattaacacaaccaccatcagcatcaggaacaccaggacaaagagtaacaatatcatgctcaggatcatcatcaaacataggatcaaacaccgtaaactggtacaaacaactaccaggaacagcaccaagactactaatatactcaaacgaccaaagaccatcaggagtaccagacagattctcaggaagcaaatcaggaacatcagcatcactagcaatatcaggattacaatcagaagacgaagcaaactactactgcgcagcatgggacgactcactatcaggatgggtattcggaggaggaacaaaactaacagtacta

SEQ ID NO: 50650 - RNA, 330 nt, synthetic construct
  misc_feature 1..330: note = derived and/or modified sequence opt6 from anti-influenza_Chain
  source 1..330: mol_type = other RNA
caaagcgcattaacacaaccaagatcagtatcaggatcaccaggacaatcagtaacaatatcatgcacaggatcaagctcagacgtaggagcaagcaatagcgtaagctggtaccaacaacatccaggaaaagcaccaaaattagtaatatatgacgtaacagaaagaccaagcggagtaccacacagattctcaggatcaaaatcaggaaatacagcaagcctaacagtaagcggactacaaccagaagacgaagcagattacttttgctgtgcatatggaggaaaatatctagtagtatttggaggaggaacaaaagtaacagtacta

SEQ ID NO: 50651 - RNA, 330 nt, synthetic construct
  misc_feature 1..330: note = derived and/or modified sequence opt6 from anti-influenza_Chain
  source 1..330: mol_type = other RNA
caatcagcactaacacaaccagcatcagtatcaggatcaccaggacaatcaataacaatatcatgcacaggaacatcatcagacgtaggaggatacaactacgtatcatggtaccaacaacacccaggaaaagcaccaaaactactaatatacgaagtaacaaactggccatcaggagtatcaaacagattctcaggatcaaaatcaggaaacacagcatcactaacaatatcaggactacaagcagaagacgaagcagactactactgctcatcatacgcaggatcatcaacatgggtattcggaggaggaacaagagtaacagtacta

SEQ ID NO: 50652 - RNA, 330 nt, synthetic construct
  misc_feature 1..330: note = derived and/or modified sequence opt6 from anti-influenza_Chain
  source 1..330: mol_type = other RNA
caaacagtagtaacacaagaaccctcactaacagtatcaccaggaggaactgtaacactaacatgcgcatcatcaacaggagcagtaacatcatcatatttcccaaactggttccaacaaaaaccaggacaagcaccaagaccattaatatactcaacaacaataagacactcatggacaccagcaagattctccggatcactactaggaggaaaagcagcattaacattatcaggagtacaaccagaagacgaagcagactactactgcctactatattcaggaggagacccagtagcattcggaggaggaacaaaattaacagtacta

SEQ ID NO: 50653 - RNA, 330 nt, synthetic construct
  misc_feature 1..330: note = derived and/or modified sequence opt6 from anti-influenza_Chain
  source 1..330: mol_type = other RNA
caatcagtattaacacaatcaccatcagtatcagcagcaccaggacaaaaagtaacaatatcatgctcaggatcagactcaaatataggagactacttcgtatgctggtaccaacacttaccaggaaaaccaccacaactattaatatatgaaaataacaaaagaccatcaggaataccagacagattctcaggatcaaaatcaggaacatcagcaacattaggaataacaggaatacaaacaggagacgaagcagactactactgcgcaacatgggacggatcactaagcgcatgggtattcggaggaggaacaaaactaacagtacta

SEQ ID NO: 50654 - RNA, 330 nt, synthetic construct
  misc_feature 1..330: note = derived and/or modified sequence opt6 from anti-influenza_Chain
  source 1..330: mol_type = other RNA
caaagcgcactaacacaaccaagatcagtatcaggatcaccaggacaatcaataacaatatcatgcacaggaggaagctcagacataggagcaagcaatagcgtaagctggtaccaacaacatccaggaaaagcaccaaaattagtaatatttgacgtaacagaaagaccaagcggagtaccacacagattctcgggatcaaaatcaggaaatacagcaagcctaacagtaagcggactacaaccagatgacgaagcagattacttttgctgtgcatatggaggaaaatatctagtagtatttggaggaggaacaaaagtaacagtacta

SEQ ID NO: 50655 - RNA, 330 nt, synthetic construct
  misc_feature 1..330: note = derived and/or modified sequence opt6 from anti-influenza_Chain
  source 1..330: mol_type = other RNA
caagcagtagtaacacaagaaccatcattagcagtaagcccaggaggaacagtaacattaacatgtggaagctcaacaggagcagtaacaagaggacactatccatattggtttcaacaaaaaccaggacaagcaccaagagcactaatatacgatagcgcaggaaatagacatagttggacaccagcaagattcagtggatcactattaggaggaaaagcagcattaacattaagcggagcacaaccagaagacgaagcagaatactattgcttattatcatactcaggagtatgggtattcggaggaggaacaaaactaacagtatta

SEQ ID NO: 50656 - RNA, 330 nt, synthetic construct
  misc_feature 1..330: note = derived and/or modified sequence opt6 from anti-influenza_Chain
  source 1..330: mol_type = other RNA
gaaatagtaatgacacaatcaccagcaacactatcagtatcaccaggagaaagagtaaccctatcatgcagagcatcacaatcaataacagacggactagcatggtaccaacaaaaaagcggacaagcaccaagactactaatatacggagcatcaacaagagcaacaggaataccagcaagattctcaggatcaggatcaggaacagaattcacactaacaatatcatcactacaatcagaagacttcgcagtatactactgccaacaatacaacaactggccaccagtaacattcggacaaggaacaaaagtagaaataaaaagaaca

SEQ ID NO: 50657 - RNA, 330 nt, synthetic construct
  misc_feature 1..330: note = derived and/or modified sequence opt6 from anti-influenza_Chain
  source 1..330: mol_type = other RNA
tcatcagaattaacacaaccaccatcagcatcaggaacaccaggacaaagagtaacaatatcatgttcaggatcaacatcaaatataggatacaatccagtaagctggtaccaacaagtaccaggaacagcaccaaaactattaatatattcaaatacagaaagaccatcaggagtaccagacagattctcaggatcaaaatcaggaacatcagcatcattagccatatcaggactacaatcagaagacgaagcagactactattgcgcagcatgggacgacacactaaacggaccagtattcggaggaggaacaaaagtaacagtatta

SEQ ID NO: 50658 - RNA, 330 nt, synthetic construct
  misc_feature 1..330: note = derived and/or modified sequence opt6 from anti-influenza_Chain
  source 1..330: mol_type = other RNA
caatcagcactaacacaaccagcatcagtatcaggatcaccaggacaatcaataacaatatcatgcacaggaacatcatcagacgtaggaggatacaactacgtatcatggtaccaacaacacccaggagaagcaccaaaactaatgatatcagacgtatcaaacagaccatcaggagtatcaaacagattctcaggatcaaaatcaggaaacacagcatcactaacaatatcaggactacaagcagaagacgaagcagactactactgcacatcatacacatcatcaaacacactagtattcggaggaggaacaaaactaacagtacta

SEQ ID NO: 50659 - RNA, 330 nt, synthetic construct
  misc_feature 1..330: note = derived and/or modified sequence opt6 from anti-influenza_Chain
  source 1..330: mol_type = other RNA
caatcagtattaacacaaccaccatcagtatcagcagcaccaggacaaaaagtaacaatatcatgctcaggatcaagctcaaacataggacacaacttcgtatcatggtaccaacaactaccagcaacagcaccaaaactactaatatacgacacagacaaaagaccatcaggaataccagacagattctcaggatcaaaatcaggaacatcagcaacactaggaataacaggactacaaacaggagacgaagcagactactactgcggaacatgggactcatcactatcatcagtaatattcggaggaggaacaaaactaacagtacta

SEQ ID NO: 50660 - RNA, 330 nt, synthetic construct
  misc_feature 1..330: note = derived and/or modified sequence opt6 from anti-influenza_Chain
  source 1..330: mol_type = other RNA
gacatacaaatgacacaatcaccatcaacactatcagcatcagtaggagacagagtaacaataacatgcagagcatcacaaacaataaacaactacctagcatggtaccaacaaaaaccaggaaaagcaccaaaactactaatatacaaagcatcatcactagaatcaggagtaccatcaagattctcaggatcaggatcaggaacagaattcacactaacaatatcatcactacaaccagacgacttcgcaacatactactgccaagaatacaacaacgactcaccactaacattcggaggaggaacaaaagtagaaataaaaagaaca

SEQ ID NO: 50661 - RNA, 330 nt, synthetic construct
  misc_feature 1..330: note = derived and/or modified sequence opt6 from anti-influenza_Chain
  source 1..330: mol_type = other RNA
gatatagaattaacacaagatccatcagtatcagtagcaccaggacaaacagcaagaataccatgcgtaagatttaacatgggaccaacatcagtacattggtatcaacaaaaaccaggacaagcaccagtattagtagtatatgatgactcagacagaccatcaggaataccagaaagatttagtggaagtaatagcggagactcagcaacactaacaatatcaagagtagaagcaggagatgaagcagactattactgtcaagtatgggatatgtcaagcgatagaagagtatttggaggaggaacaacattaacagtactaggacaa

SEQ ID NO: 50662 - RNA, 330 nt, synthetic construct
  misc_feature 1..330: note = derived and/or modified sequence opt6 from anti-influenza_Chain
  source 1..330: mol_type = other RNA
gacatagtaatgacacaatcaccaggaacattatcattatcaccaggagaaagagcaacattatactgcagagcatcacaatcagtaagatcaggatatctagcatggtatcaacataaaccaggacaagcaccactattactattttacgacgcatcaggaagagcaacaggaataccagacagattttcaggatcaggatcaggaacagacttcacactaacaatatcaagattagaaccagaagacttcgcagtatattactgtctacaatacggatcatcaccaagaacattcggacaaggaacaaaagtagaaataaaaagaaca

SEQ ID NO: 50663 - RNA, 330 nt, synthetic construct
  misc_feature 1..330: note = derived and/or modified sequence opt6 from anti-influenza_Chain
  source 1..330: mol_type = other RNA
gacatagtactaacacaatcaccatcattcctatcagcatcagtaggagacagagtaacaataacatgcagagcatcacaactaatatcatcatacttcgcatggtaccaacaaaaaccaggaaaaccaccaaaactactaatatacgcagcatccacactacaatcaggagtaccatcaagattctcaggatcaggatcaggaacacaattctcactaacaatatcctcactacaaccagaagacttcgcaacatactactgccaacaactaaactcatacccaccaataacattcggacaaggaacaagactagaaataaaaagaaca

SEQ ID NO: 50664 - RNA, 330 nt, synthetic construct
  misc_feature 1..330: note = derived and/or modified sequence opt6 from anti-influenza_Chain
  source 1..330: mol_type = other RNA
gatataacactaacacaatcaccagcaacactaagcgtaagcccaggagaaagagcaacattaagctgtagagcaagccaaagcgtaagctcaaacttagcatggtaccaacaaaaaccaggacaagcaccaagactattaatatatggagcaagcaatagagcaacagatataccagcaagattctcaggatcaggatcaggaacagaatttacattaacaataagctcactacaaagcgaagactttgcagtatactattgccaacaatttaacgattggccattcttaacatttggaggaggaacaaaagtagaaataaaaagaaca

SEQ ID NO: 50665 - RNA, 330 nt, synthetic construct
  misc_feature 1..330: note = derived and/or modified sequence opt6 from anti-influenza_Chain
  source 1..330: mol_type = other RNA
gacatagtaatgacacaatcaccatcattcctatcagcatcagtaggagacagagtaacaataacatgcagaacatcacaagtaatatcatcatacctagcatggtaccaacaaagaccaggaaaagcaccaaaactactaatatacgcagcatcaacactacaatcaggagtaccatcaagattctcaggatcaggatcaggaacaagattctcactaacaatatcaaacctacaaccagaagacttcgcaacatacttctgccaacaactaacaacatacccaccaataacattcggacaaggaacaagactagaaataaaaagaaca

SEQ ID NO: 50666 - RNA, 330 nt, synthetic construct
  misc_feature 1..330: note = derived and/or modified sequence opt6 from anti-influenza_Chain
  source 1..330: mol_type = other RNA
gatatagtattaacacaaagtccaagtgtaagtgtagcaccaggacaaacagcaagaataacatgtggaggaaatgatataggaagtaaaagtgtacattggtatcaacaaaaaccaggacaagcaccagtattagtagtatttgatgatagagatagaccaagtggaataccagaaagatttagtggaagtaatagtggaaatacagcaacattaacaataagtagagtagaagcaggagatgaagcagattattattgtcaagtatgggatataacaagtgatttagtagtatttggaggaggaacaaaactaacagtagtaggacaa

SEQ ID NO: 50667 - RNA, 330 nt, synthetic construct
  misc_feature 1..330: note = derived and/or modified sequence opt6 from anti-influenza_Chain
  source 1..330: mol_type = other RNA
gacatagtaatgacacaaccaccaggaacattatcagtatcaccaggagaaagagcaacactatcatgcagagcatcacaatcagtatcaacaaacctagcatggtaccaacaaaaaccaggacaagcaccaagactactaatacacggagcatcaacaagagcaacaggaataccagcaagattctcaggatcaggctcaggagcagaattcacactaacaatatcatcactacaatcagaagacgtagcagtatactactgccaacaatacgacaactggctaccaataacattcggaccaggaacaaaagtagacatacaaagaaca

SEQ ID NO: 50668 - RNA, 330 nt, synthetic construct
  misc_feature 1..330: note = derived and/or modified sequence opt6 from anti-influenza_Chain
  source 1..330: mol_type = other RNA
gatccaatgctaacacaaacagcatcaccagtaagcgcagcagtaggaggaacagtaacaataaactgtcaagcaagccaaagcgtatacaataaaaataacttagcatggtaccaacaaaaactaggacaaccaccaaaactattaatatatgcagcaagcacactaacaagcggagtaccaagcagattcaaaggatcaggatcaggaacacaatttacattaacaataagcgatctagaatgcgatgacgcagcaacatactattgcgcaggagattactcaggaggaatatatgcatttggaggaggaacaaaagtagaaataaaa

SEQ ID NO: 50669 - RNA, 330 nt, synthetic construct
  misc_feature 1..330: note = derived and/or modified sequence opt6 from anti-influenza_Chain
  source 1..330: mol_type = other RNA
gaattagtaatgacacaaacaccagcaagcgtaagcgcagccgtaggaggaacagtaacaataagctgtcaatcaagcgaaagcgtatacaaaaacaataacctagcatggttccaacaaaaactaggacaaccaccaaaactattaatatatgacgcaagcaaactagcaagcggagtaccaagcagattctcaggatcaggatcaggaacacaatttacattaacaataagcgatctagaatgcgatgacgcagcaacatactattgcgcaggagattactcaggatcaaactatgcatttggaggaggaacaaaattagaaataaaa

SEQ ID NO: 50670 - RNA, 330 nt, synthetic construct
  misc_feature 1..330: note = derived and/or modified sequence opt6 from anti-influenza_Chain
  source 1..330: mol_type = other RNA
gaaccaatgctaacacaaacagcatcaagcgtaagcgcagcagtaggaggaagcgtaacaataagctgtcaatcaagtcaaagtgtagactcaaacaatcaattaagctggtaccaacaaaaaccaggacaaccaccaaaactattaatatatgcagcaagcacactaacatcaggagtaccaagcagattcaaaggatcaggatcaggaacacaatttacattaacaataagcgatctagaatgcgatgacgcagcaacatactattgcgcaggagattactcaggaggaatatatgcatttggagggggaacagaagtagtagtaaaa

SEQ ID NO: 50671 - RNA, 330 nt, synthetic construct
  misc_feature 1..330: note = derived and/or modified sequence opt6 from anti-influenza_Chain
  source 1..330: mol_type = other RNA
gatccaatgctaacacaaacagcagcaagcgtaagcgcagcagtaggaggaacagtaacaataagttgtcaatcaagcgaaagcgtatacaaaaacaataacttagcatggttccaacaaaaactaggacaaccaccaacactattaatatgggacgcaagtaaactagcaagcggagtaccaagtagattctcaggatcaggatcaggaacacaatttacactaacaataagcgatctagaatgcgatgacgcagcaacatactattgcgcaggagattactcaggagtaaactatgcatttggaggaggaacagaagtagtagtaaaa

SEQ ID NO: 50672 - RNA, 330 nt, synthetic construct
  misc_feature 1..330: note = derived and/or modified sequence opt6 from anti-influenza_Chain
  source 1..330: mol_type = other RNA
gaattagtaatgacacaaacaccagcaagcgtaagcgcagcagtaggaggaacagtaacaataagctgtcaatcaagcgaaagtgtatacaaaaacaataacctagcatggttccaacaaaaactaggacaaccaccaaaactattaatatatgacgcaagcaaactagcaagcggagtaccaagtagattctcaggatcaggatcaggaacacaatttacattaacaataagcgatctagaatgcgatgacgcagcaacatactattgtgcaggagattactcaggatcaaactatgcatttggaggaggaacagaagtagtagtaaaa

SEQ ID NO: 50673 - RNA, 330 nt, synthetic construct
  misc_feature 1..330: note = derived and/or modified sequence opt6 from anti-influenza_Chain
  source 1..330: mol_type = other RNA
gacccaatgctaacacaaacagcatcatcagtatcagcaacagtaggaggaacagtaacaatatcatgccaatcatcacaatcagtagacaacaacaaagacctagcatggttccaacaaaaaccaggacactcaccaaaactactaatatacttcgcatcaagactagcatcaggagtaccaagtagattcaaaggatcaggatcaggaacacacttcacactaacaatatcagacctagaatgcgacgacgcagcaacatactactgcgcaggagactactcaggagcaaactacgcattcggaggaggaacaaaactagaaataaaa

SEQ ID NO: 50674 - RNA, 330 nt, synthetic construct
  misc_feature 1..330: note = derived and/or modified sequence opt6 from anti-influenza_Chain
  source 1..330: mol_type = other RNA
gatccaatgctaacacaaacagcatcaccagtaagcgcagcagtaggaggaacagtaacaataaactgtcaatcatcacaaagtgtatacaataacaatagattaagctggttccaacaaaaaccaggacaaccaccaaaactattaatatatagcgcaagcacactagcaagcggagtatcaagcagattcaaaggatcaggatcaggaacacaatttacattaacaataagcgatctagaatgcgatgacgcagcaacatactattgcgcaggagattactcaggaggaatatatgcatttggaggaggaacagaattagaaatacta

SEQ ID NO: 50675 - RNA, 330 nt, synthetic construct
  misc_feature 1..330: note = derived and/or modified sequence opt6 from anti-influenza_Chain
  source 1..330: mol_type = other RNA
gaattagtactaacacaaacaccagcaagcgtaagcgcagcagtaggaggaacagtaagcataagctgtcaatcaagccaaagcgtatacaaaaacaataacctagcatggttccaacaaaaactaggacaaccaccaacactattaatatgggacgcaagcaaactagcaagtggagtaccaagcagattctcaggatcaggatcaggaacacaatttacattaacaataagcgatctagaatgcgatgacgcagcaacatactattgcgcaggagattactcaggagtaaactatgcatttggaggaggaacaaaattagaaataaaa

SEQ ID NO: 50676 - RNA, 330 nt, synthetic construct
  misc_feature 1..330: note = derived and/or modified sequence opt6 from anti-influenza_Chain
  source 1..330: mol_type = other RNA
gaactagatctaacacaaacaccagcaagcgtaagcgcagcagtaggaggaacagtaacaataagttgtcaatcaagcgaaagcgtatacaaaaacaataacttagcatggttccaacaaaaactaggacaaccaccaacactattaatatgggacgcaagtaaactagcaagcggagtaccaagcagattctcaggatcaggatcaggaacacaatttacattaacaataagcgatctagaatgcgatgacgcagcaacatactattgcgcaggagattactcaggagtaaactatgcatttggaggaggaacagaagtagtagtaaaa

SEQ ID NO: 50677 - RNA, 330 nt, synthetic construct
  misc_feature 1..330: note = derived and/or modified sequence opt6 from anti-influenza_Chain
  source 1..330: mol_type = other RNA
gatatacaaatgacacaatcaccaagctcattaagcgcaagcgtaggagatagagtaacaataacatgtcaatcaagcgaaagcgtatacaaaaacaataacttagcatggtaccaacaaaaaccaggaaaaccaccaaaactattaatatgggacgcaagcaaattagcaagcggagtaccaagcagattctcaggatcaggatcaggaacagactttacattaacaataagctcactacaaccagaagacgtagcaacatactattgcgcaggagattactcaggagtaaactatgcatttggaggaggaacagaagtagtagtaaaa

SEQ ID NO: 50678 - RNA, 333 nt, synthetic construct
  misc_feature 1..333: note = derived and/or modified sequence opt6 from anti-influenza_Chain
  source 1..333: mol_type = other RNA
gacatagtaatgacacaatcaccagactcactagcagtatcactaggagaaagagcaacaataaactgcaaatcatcacaatcagtaacattcaacaacaaaaactacttagcatggtaccaacaaaaaccaggacaaccaccaaaactactaatatactgggcatcaacaagagaatcaggagtaccagacagattctcaggatcaggatcaggaacagacttcacattaacaataagctcactacaagcagaagacgtagcagtatactactgccaacaacactacagaacaccaccaacattcggacaaggaacaaaagtagaaataaaa

SEQ ID NO: 50679 - RNA, 333 nt, synthetic construct
  misc_feature 1..333: note = derived and/or modified sequence opt6 from anti-influenza_Chain
  source 1..333: mol_type = other RNA
caatcagcattaacacaaccagcatcagtatcaggatcaccaggacaatcaataacaatatcatgcacaggaacaggatcagacgtaggatcaagcaacctagtaagctggtaccaacaacacccagcaaaagcaccaaaactaataatatacgaagtaacaaaaagaccatcaggagtatcaaacagattctcaggatcaaaatcaggaaacacagcatcactaacaatatcaggactacaagcagaagacgaagcagactactactgctgctcatacgcaggatcatcatcatcaagagtattcggaacaggaacaaaagtaacagtacta

SEQ ID NO: 50680 - RNA, 333 nt, synthetic construct
  misc_feature 1..333: note = derived and/or modified sequence opt6 from anti-influenza_Chain
  source 1..333: mol_type = other RNA
caatcagtattaacacaaccaccatcagcatcaggaacaccaggacaaagagtaacaatatcatgttcaggatcaacatcaaatataggatcaaatgcagtaaactggtaccaacaattaccaggaacagcaccaaaactattaatatactcaaataaccaaagaccatcaggagtaccagacagattctcaggatcaaaatcaggaacatcagcatcattagcaatatcaggactacaatcagaagacgaagcagattactattgcgcagcatgggacgattcattaagcggatcatgggtatttggaggaggaacaaaattaacagtacta

SEQ ID NO: 50681 - RNA, 333 nt, synthetic construct
  misc_feature 1..333: note = derived and/or modified sequence opt6 from anti-influenza_Chain
  source 1..333: mol_type = other RNA
gaaacaacactaacacaatcaccaggaacactatcactatcaccaggagaaagagcaacattatcatgcagagtaagccaatcagtatcatcaaactacctagcatggtaccaacaaaaaccaggacaagcaccaagactactaatatacggagcatcatcaagagcaacaggaataccagacagattctcaggatcaggatcaggaacagacttcacactaacaatatcaagactagaaccagaagacttcgcagtatactactgccaacaatacggaacatcaccaagagcattcggacacggaacaaaagtagaaataaaaagaaccgta

SEQ ID NO: 50682 - RNA, 333 nt, synthetic construct
  misc_feature 1..333: note = derived and/or modified sequence opt6 from anti-influenza_Chain
  source 1..333: mol_type = other RNA
caatcagtattaacacaaccaccaagcgtaagcggagcaccaggacaaagagtaacaataagctgtggaggaagcagaagcaatataggagcaggatacgatgtacattggtatcaacaattcccaggaacagcaccaaaagtagtaatatacggaaacaataacagaccatcaggagtaccagatagatttagcggaagcaaaagcggaacatcagcatcactagcaataacaggattacaagcagaagatgaagcaaactattactgtcaaagttacgatacaaatttaggaggatcaatatttggaggaggaacacaagtaacagtatta

SEQ ID NO: 50683 - RNA, 333 nt, synthetic construct
  misc_feature 1..333: note = derived and/or modified sequence opt6 from anti-influenza_Chain
  source 1..333: mol_type = other RNA
aactttatgttaacacaaccacatagcgtaagcgaaagcccaggaaaaacagtaacaataagctgtacaggaagcagcggatcaatagcaagcaattacgtacaatggtaccaacaaagaccaggaagcgcaccaacaacagtaatatatgaagattaccaaagaccaagcggagtaccagacagattctcaggatcaatagatagctcaagcaatagcgcatcattaacaataagcggactaaaaacagaagacgaagcagattactattgccaaagctatgacgatagcgatcacttaatatttggaggaggaacaaaattaacagtacta

SEQ ID NO: 50684 - RNA, 333 nt, synthetic construct
  misc_feature 1..333: note = derived and/or modified sequence opt6 from anti-influenza_Chain
  source 1..333: mol_type = other RNA
caatcaatgttaacacaaccaccatcagcatcaggaacaccaggacaaagagtaacaatatcatgctcaggatcatcatcaaatataggatcaaacacagtaaactggttcaaacacctaccaggaacagcaccaaaactactaatatacagaaacgacctaagaccatcaggagtaccagacagattctcaggatcaaaatcaggaacatcagcatcactagcaatatcaggactacaatcagaagacgaagcagactactactgcgcaacatgggacgactcactaaacggattctacgtattcggcacaggaacaaaagtaacagtacta

SEQ ID NO: 50685 - RNA, 333 nt, synthetic construct
  misc_feature 1..333: note = derived and/or modified sequence opt6 from anti-influenza_Chain
  source 1..333: mol_type = other RNA
gacatacaactaacacaatcaccctcatcactatcagcatcagcaggagacagagtatcaatgacatgcagagcatcacaaataatatcatcatcactaaactggtaccaacaaaaaccaggaaaagcaccaaaactactaatatacgccgcatcaaacctacaatcaggagtaccatcaagattctcaggatcaggatcaggaacagacttcacactaacaatatcatcactacaaccagaagacttcgcaacatactactgccaacaatcatactcaacaccaccagaactaacattcggaggaggaacaaaagtagacataaaaagaaca

SEQ ID NO: 50686 - RNA, 333 nt, synthetic construct
  misc_feature 1..333: note = derived and/or modified sequence opt6 from anti-influenza_Chain
  source 1..333: mol_type = other RNA
tcatacgtattaacacaaccaccatcagcatcaggaacaccaggacaaagagtaacaatatcatgttcaggatcaacattcaatataggatcaaatgcagtagactggtacagacaattaccaggaacagcaccaaaactattaatatactcaaataaccaaagaccatcaggagtaccagacagattctcaggatcaagatcaggaacatcagcatcactagcaatatcaggactacaatcagaagacgaagcagactactattgcgcagcatgggacgacatactaaacgtaccagtattcggaggaggaacaaaactaacagtattagga

SEQ ID NO: 50687 - RNA, 333 nt, synthetic construct
  misc_feature 1..333: note = derived and/or modified sequence opt6 from anti-influenza_Chain
  source 1..333: mol_type = other RNA
caaagcgcactaacacaaccagcagcagtatcaggatcaccaggacaatcaataacaatatcatgcacaggaacaagctcagacgtaggaggatacaattacgtaagctggtaccaacaacatccaggaaaagcaccaaaactaatgatatatgaagtaagcaatagaccaagcggagtatcaaacagattctcaggatcaaaatcaggaaatacagcatcattaacaataagcggactacaagcagaagacgaagcagattactattgcagcagctatacatcaagctcaacatatgtatttggaacaggaacaaaagtaacagtactagga

SEQ ID NO: 50688 - RNA, 333 nt, synthetic construct
  misc_feature 1..333: note = derived and/or modified sequence opt6 from anti-influenza_Chain
  source 1..333: mol_type = other RNA
tcatacgtactaacacaaccaccatcagtatcaggaacaccaggacaaagagtaacaatatcatgttcaggatcaagatcaaatgtaggagataactcagtatattggtatcaacatgtaccagaaatggcaccaaaactattagtatacaaaaacacacaaagaccatcaggagtaccagcaagatttagtggaagcaaaagcggaacatcagcatcactagcaataataggactacaatcaggagatgaagcagactattactgtgtagcatgggatgactcagtagatggatatgtatttggatcaggaacaaaagtaacagtactagga

SEQ ID NO: 50689 - RNA, 333 nt, synthetic construct
  misc_feature 1..333: note = derived and/or modified sequence opt6 from anti-influenza_Chain
  source 1..333: mol_type = other RNA
agcgtactaacacaaccaccatcagtatcagcagcaccaggacaaaaagtaacaatatcatgctcaggatcatcatcaaacataggaaacgactacgtatcatggtaccaacaactaccaggaacagcaccaaaactactaatatacgacaacaacaaaagaccatcaggaataccagacagattctcaggatcaaaatcaggaacatcagcaacactaggaataacaggactacaaacaggagacgaagcaaactactactgcgcaacatgggacagaagaccaacagcatacgtagtattcggaggaggaacaaaactaacagtattagga

SEQ ID NO: 50690 - RNA, 333 nt, synthetic construct
  misc_feature 1..333: note = derived and/or modified sequence opt6 from anti-influenza_Chain
  source 1..333: mol_type = other RNA
caaagcgcactaacacaaccaagatcagtatcaggatcaccaggacaatcagtaacaatatcatgcacaggaacaagctcagacgtaggaggatacaattacgtaagttggtaccaacaacatccaggaaaagcaccaaaactaatgatatatgacgtaagcaaaagaccaagcggagtaccagacagattttcaggatcaaaatcaggaaatacagcatcattaacaataagcggactacaagcagaagacgaagcagattactattgcagcagctatacatcaagctcaacacatgtatttggaacaggaacaaaagtaacagtactagga

SEQ ID NO: 50691 - RNA, 333 nt, synthetic construct
  misc_feature 1..333: note = derived and/or modified sequence opt6 from anti-influenza_Chain
  source 1..333: mol_type = other RNA
agctatgtattaacacaaccaccaagcgcaagcggaacaccaggacaaagagtaacaataagctgtagcggaagctcatcaaatataggaagcaattacgtatactggtaccaacaattaccaggaacagcaccaaaactattaatatatagagatggacaaagaccaagcggagtaccagacagattctcaggatcaaaatcaggaacaagtgcaagtttagcaataagcggactaagaagcgatgacgaagcagattactattgcgcaacatgggacgataacttaagcggaccagtattcggaggaggaacaaaactaacagtattagga

SEQ ID NO: 50692 - RNA, 333 nt, synthetic construct
  misc_feature 1..333: note = derived and/or modified sequence opt6 from anti-influenza_Chain
  source 1..333: mol_type = other RNA
caaagtgcactaacacaaccagcatctgtatcaggatcaccaggacaatcaataacaatatcatgcacaggaacaagctcagacgtaggaggatacaattacgtaagctggtaccaacaacatccaggaaaagcaccaaaactaatgatatatgaagtaagcaatagaccaagcggagtatcaaacagattctccggatcaaaatcaggaaatacagcatcattaacaataagcggactacaagcagaagacgaagcagattactattgcagcagctatacatcaagctcaacattagtatttggaacaggaacaaaagtaacagtattagga

SEQ ID NO: 50693 - RNA, 333 nt, synthetic construct
  misc_feature 1..333: note = derived and/or modified sequence opt6 from anti-influenza_Chain
  source 1..333: mol_type = other RNA
acagtactaacacaaccaccatcagtatcaggagcaccaggacaaagagtaacaatatcatgcacaggatcatcatcaaatataggagcaggatacgacgtacactggtatcaacaactaccaggaacagcaccaaaattattaatatacggaaactcaaacagaccaagcggagtaccagacagattctcaggatcaaaatcaggaacatcagcaacactaggaataacaggactacaaacaggagacgaagcagactactactgcggaacatgggactcatcactatcagcatacgtattcggaacaggaacaaaagtaacagtattagga

SEQ ID NO: 50694 - RNA, 333 nt, synthetic construct
  misc_feature 1..333: note = derived and/or modified sequence opt6 from anti-influenza_Chain
  source 1..333: mol_type = other RNA
ggaagcgcactaacacaaccaagatcagtatcaggatcaccaggacaatcagtaacaatatcatgcacaggaacaagctcagacgtaggaggatacaattacgtaagctggtaccaacaacatccaggaaaagcaccaaaattaatgatatatgacgtaagcaaaagaccaagcggagtaccagacagattctcaggatcaaaatcaggaaatacagcatcattaacaataagcggactacaagcagaagacgaagcagattactattgcagcagctatacatcgagctcaacacatgtatttggaacaggaacaaaagtaacagtactagga

SEQ ID NO: 50695 - RNA, 333 nt, synthetic construct
  misc_feature 1..333: note = derived and/or modified sequence opt6 from anti-influenza_Chain
  source 1..333: mol_type = other RNA
gaaatagtactaacacaaagcccaggaacattaagtttaagcccaggagaaagagcaacattaagctgtagagcaagccaaagcgtaagctcaagctatctagcatggtatcaacaaaaaccaggacaagcaccaagattactaatattcggagcatcaacaagagcaacaggaataccagatagatttagcggaagcggaagcggaacagatttcacactaacaatatcacgattagaaccagaagatttcgcagtattttactgtcaacaatacggatcattaccattaacatttggaggaggaacaaaagtagaaataaaaggaacagta

SEQ ID NO: 50696 - RNA, 333 nt, synthetic construct
  misc_feature 1..333: note = derived and/or modified sequence opt6 from anti-influenza_Chain
  source 1..333: mol_type = other RNA
gaaatagtactaacacaatcaccaggaacattatcattaagcccgggagaaagagcaacattaagctgtagagcaagccaaagcgtaagatcaaacaatctagcatggtatcaacataaaccaggacaagcaccaagattactaatattcggagcatcaagcagagcaacaggaataccagatagatttagcggaagcggaagtggaacagatttcacactaacaatatcaagattagaaccagaagatttcgcagtatattactgtcaacaatacggaagctcaccagcactaacattcggaggaggaacaaaagtagaaataaaaagaaca

SEQ ID NO: 50697 - RNA, 333 nt, synthetic construct
  misc_feature 1..333: note = derived and/or modified sequence opt6 from anti-influenza_Chain
  source 1..333: mol_type = other RNA
caaagcctagaagaaagtggaggaggattagtaaaaccaggaggaagcctaacactaacatgtacagtaagcggactatcactatatagcaatgaaataaactgggtaagacaagcaccaggaaacggactagaatggataggagcaatagcaggatcaggatcagcagattacgcaagctgggcaaaaggaagaagcacaataacaagaaatacagatctaaatacagtaacattaaaaatgacatcactaacagcagcagacacagcaacatacttttgcgcatcattttgggatctatggggaccaggaacattagtaacagtaagcagc

SEQ ID NO: 50698 - RNA, 333 nt, synthetic construct
  misc_feature 1..333: note = derived and/or modified sequence opt6 from anti-influenza_Chain
  source 1..333: mol_type = other RNA
caaagcgtagaagaaagcggaggaggattagtaaaaccaggaggaagcctaacattaacatgtacagtaagcggactatcactatatagcaatgaaataaactgggtaagacaagcaccaggaaacggactagaatggataggagcaatagcaggatcaggatcagcagattacgcaagttgggcaaaaagcagaagcacaataacaagaaatacaaatctaaatacagtaacattaaaaatgacatcactaacagcagcagacacagcaacatacttttgcgcatcattttgggatttatggggaccaggaacattagtgacagtaagcagc

SEQ ID NO: 50699 - RNA, 333 nt, synthetic construct
  misc_feature 1..333: note = derived and/or modified sequence opt6 from anti-influenza_Chain
  source 1..333: mol_type = other RNA
caaagcctagaagaaagcggaggaggattagtaaaaccaggaggaagcctaacattaacatgtacagtaagcggactatcactatatagcaatgaaataaactgggtaagacaagcaccaggaaacggactagaatggataggagcaatagcaggatcaggatcagcagattacgcaagttgggcaaaaagcagaagcacaataacaagaaatacaaatctaaatacagtaacattaaaaatgacatcactaacagcagcagacacagcaacatacttttgcgcatcattttgggatctatggggaccaggaacattagtaacagtaagcagc

SEQ ID NO: 50700 - RNA, 333 nt, synthetic construct
  misc_feature 1..333: note = derived and/or modified sequence opt6 from anti-influenza_Chain
  source 1..333: mol_type = other RNA
aatatagtattaacacaatcaccagcatcattagcagtatcattaggacaaagagcaacaataagctgtagagcaagcgaaagcgtagacatatacggaaacagcttcatgcactggtaccaacaaaaaccaggacaaccaccaaaattattaatatatctagcaagcaaactagaatgcggagtatgtgcaagattcaatggaagcggatgtagaacagactttacattagcaatagacccagtagaaggagatgacggagcaacatactattgccaacaaaattacgaagacccatggacattcggaggaggaacaaaactagaaataaaa

SEQ ID NO: 50701 - RNA, 333 nt, synthetic construct
  misc_feature 1..333: note = derived and/or modified sequence opt6 from anti-influenza_Chain
  source 1..333: mol_type = other RNA
aatatagtattaacacaatcaccagcaagcctagcagtaagcccaggacaaagagcaacaataagctgcagagcaagcgaaagcatagacatatacggaaactcattcatgcactggtaccaaaaaaaaccaggacaaccaccaaaactattaatatatagagcaagcaatctagaaagcggagtaccagcaagattcaatggatcaggatcaagaacagactttacattaacaatagacccagtagaaggagatgacggagcaacatactactgccaacaaaattacgaagacccatggacattcggaggaggaacaaaactagaaataaaa

SEQ ID NO: 50702 - RNA, 333 nt, synthetic construct
  misc_feature 1..333: note = derived and/or modified sequence opt6 from anti-influenza_Chain
  source 1..333: mol_type = other RNA
gaaatagtactaacacaatcaccagcaacactatcactatacccaggagaaagagcaacactaagctgcagagcatcacaatcagtaagcagatacctagcatggtaccaacaaaaaccaggacaagcaccaagactactaatatacgacgcatcaaacagagcaacaggaataccagcaagattctcaggatcaggatcaggaacagacttcacattaacaatatcatcactagaaccagaagacttcgcagtatactactgccaacaaagaagcaactggctaaaaataacattcggacaaggaacacgactagaaataaaaggaacagta

SEQ ID NO: 50703 - RNA, 336 nt, synthetic construct
  misc_feature 1..336: note = derived and/or modified sequence opt6 from anti-influenza_Chain
  source 1..336: mol_type = other RNA
gacatagtaatgacacaatcaccagactcactagcagtatcactaggagaaagagcaacaataaactgcaaatcatcacaatcagtactatactcatcaaacaacaaaaactacttagcatggtaccaacaaaaaccaggacaaccaccaaaactactaatagactgggcatcaacaagagaatcaggagtaccagacagattctcaggatcaggatcaggaacagacttcacactaacaatatcaaacctacaagtagaagacgtagcagtatactactgccaacaatactacagatcaccatcattcggacaaggaacaaaactagaaataaaa

SEQ ID NO: 50704 - RNA, 336 nt, synthetic construct
  misc_feature 1..336: note = derived and/or modified sequence opt6 from anti-influenza_Chain
  source 1..336: mol_type = other RNA
gacatagtaatgacacaaacaccactatcattatcagtaacaccaggacaaccagcatcaatatcatgcaaatcatcacaatcactactacactcagacggaaaaacatacctatactggtacctacaaaaaccaggacaatcaccacaactactaatatacgaagtatcaaacagattctcaggagtaccagacagattctcaggatcaggatcaggaacagacttcacactaaaaatatcaagagtagaagcagaagacgtaggagtatactactgcatgcaaaacatactactaccattaacattcggaggaggaacaaaagtagaaataaaa

SEQ ID NO: 50705 - RNA, 336 nt, synthetic construct
  misc_feature 1..336: note = derived and/or modified sequence opt6 from anti-influenza_Chain
  source 1..336: mol_type = other RNA
gaaatagtaatgacacaaacaccactatcactatcagtaacaccaggacaaccagcatcaatatcatgcagatcatcacaatcactactacactcagacggaaaaacatacttatactggtacctacaaaaaccaggacaaccaccacaattactaatatcagaagtattcaacagattctcaggagtaccagacagattctcaggatcaggatcaggaacagacttcacactaaaaatatcaagagtagaagcagaagacgtaggagtatactactgcatgcaatcactacaactaccactaacattcggaggaggaacaaaagtagaaataaaa

SEQ ID NO: 50706 - RNA, 336 nt, synthetic construct
  misc_feature 1..336: note = derived and/or modified sequence opt6 from anti-influenza_Chain
  source 1..336: mol_type = other RNA
gacatagtaatgacacaatcaccattatcattaccagtaacaccaggagaaccagcatcaatatcatgtagagcatcacaatcattactacattcaaatggatataactatttagactggtatctacaaaaaccaggacaatcaccacaattactaatacaattaggatcaacaagagcatcaggagtaccagacagattttcaggatcaggatcaggaacagatttcacactagaaatatcaagagtagaagcagaagatgtaggagtatattactgtatgcaagcattacaattaccattagcatttggacaaggaacaagattagaaataaaa

SEQ ID NO: 50707 - RNA, 336 nt, synthetic construct
  misc_feature 1..336: note = derived and/or modified sequence opt6 from anti-influenza_Chain
  source 1..336: mol_type = other RNA
gacatagtaatgacacaatcaccattatcattaccagtatcaccaggagaaccagcatcaatatcatgtagatcatcacaatcattactacacggcaatggatataactatctagattggtatctacaaaaaccaggacaatcaccaagattactaatatacttaggatcaaacagagcatcaggagtaccagatcgattttcaggatcaggttcaggaacagatttcacactaaaaatatcaagagtagaagcagaagatgtaggagtatattactgtatgcaagcactacaaacaccattaacatttggaggaggaacaaaagtagaaataaaa

SEQ ID NO: 50708 - RNA, 336 nt, synthetic construct
  misc_feature 1..336: note = derived and/or modified sequence opt6 from anti-influenza_Chain
  source 1..336: mol_type = other RNA
caatcagtactaacacaaccaccatcagtatcaggagcaccaggacaaagagtaacaatatcatgcacaggatcatcatcaaacataggagcaggatacgacgtacactggtaccaacaactaccaggaacagcaccaaaactactaatatacgacaacaataacagaccatcaggagtaccagacagattctcaggatcaaaatcaggagcatcagcatcactagcaataacaggactacaagcagaagacgaagcacactactactgccaatcatacgacaactcactatcaggatcagtattcggaggaggaacacaactaacagtactatca

SEQ ID NO: 50709 - RNA, 336 nt, synthetic construct
  misc_feature 1..336: note = derived and/or modified sequence opt6 from anti-influenza_Chain
  source 1..336: mol_type = other RNA
caatcagtactaacacaaccaccatccgtatcaggagcaccaggacaaagagtaacaatatcatgcacaggatcatcatcaaacataggatcagactacgacgtacactggtacaaacaactaccaggaacagcaccaaaactactaatattcggaaactcaaacagaccatcaggagtaccagacagattctcaggatcaaaatcaggaacatcagcatcattagcaataacaggactacaagcagaagacgaagcagactactactgccaatcatacgactcatcactatcaggattccacgtattcggatcaggaacaaaagtaacagtacta

SEQ ID NO: 50710 - RNA, 336 nt, synthetic construct
  misc_feature 1..336: note = derived and/or modified sequence opt6 from anti-influenza_Chain
  source 1..336: mol_type = other RNA
caatcagtactaacacaaccaccatcagtatcagcagcaccaggacaaaaagtaacaatatcatgctcaggatcatcatcaaacataggaaacgactacgtatcatggtaccaacaactaccaggaacagcaccaaaactattaatatacgacaacaacaaaagaccatcaggaataccagacagattctcaggatcaaaatcaggaacatcagcaacattaggaataacaggattacaaacaggagacgaagcaaactactactgcgcaacatgggacagaagaccaacagcatacgtagtattcggaggaggaacaaaattaacagtactagga

SEQ ID NO: 50711 - RNA, 336 nt, synthetic construct
  misc_feature 1..336: note = derived and/or modified sequence opt6 from anti-influenza_Chain
  source 1..336: mol_type = other RNA
gaaatagtactaacacaatcaccaggaacactatcactatcaccaggagaaagagcaacactatcatgcagagcatcacaatcagtatcatcatcatacctagcatggtaccaacaaaaaccaggacaagcaccaagattactaatatacggagcatcaacaagagcaacaggaataccagacagattctcaggacgaggatccggaacagacttcacactaacaatatcatcactagaaccagaagacttcgcagtatactactgccaaaactacggatcaccattcctattcacattcggaccaggaacaaaagtagacataaaaagaacagta

SEQ ID NO: 50712 - RNA, 336 nt, synthetic construct
  misc_feature 1..336: note = derived and/or modified sequence opt6 from anti-influenza_Chain
  source 1..336: mol_type = other RNA
gacatacaactaacacaatcaccattatcaccaccagtaacactaggacaaccagcatcaatatcatgcagatcatcacaatcattattatacacagacggattcacatacctatcatggtaccaccaaagaccaggacaatcaccaagaagactaatatacaaaatatcaaacagagactcaggagtaccagacagattctcaggatcaggatcaggaacagacttcacactaaaaatatcaagagtagaagcagaagacgtaggagtatactactgcatgcaagcaacacactggccactaacattcggagaaggaacaaaagtagaaataaaa

SEQ ID NO: 50713 - RNA, 336 nt, synthetic construct
  misc_feature 1..336: note = derived and/or modified sequence opt6 from anti-influenza_Chain
  source 1..336: mol_type = other RNA
gacatagaattaacacaagaaccaagcgcaagcggaacaccaggacaaagagtaacaataagctgtagcggagacacaagcaatataggaagcaatacagtaagctggttccaactattaccaggaacagcaccaaaattattaatatttacagataaccaaagaccaagcggagtaccaggaagattcagcggatcaaaatcaggaacaagcgcatcattagcaataagcggactacaaagcgaagacgaaacagattactactgcgcagcatgggacgatagcttaaacggatgggtattcggaggaggaacaaaactaacagtattaggacaa

SEQ ID NO: 50714 - RNA, 336 nt, synthetic construct
  misc_feature 1..336: note = derived and/or modified sequence opt6 from anti-influenza_Chain
  source 1..336: mol_type = other RNA
gatatagtactaacacaaagcccatcagcatcaggatcaccaggacaatcagtaacaatatcatgcacaggaacaagctcagacgtaggaggatacgattacgtgagctggtaccaacaacatccaggaaaagcaccaaaactaatgatatatgaagtaagaaaaagaccaagcggagtaccagacagattctcaggatcaaaatcaggaaatacagcatcattaacagtaagcggactacaagcagaagacgaagcatattactattgcgcaagctatgcaggaacatatatacatctatttggaggaggaacaaaattaacagtactaggacaa

SEQ ID NO: 50715 - RNA, 336 nt, synthetic construct
  misc_feature 1..336: note = derived and/or modified sequence opt6 from anti-influenza_Chain
  source 1..336: mol_type = other RNA
caagaacaactaatggaaagcggaggaggattagtaaaaccaggaggaagcctaacattaacatgtacagtaagcggactatcactatatagcaatgaaataaactgggtaagacaagcaccaggaaacggactagaatggataggagcaatagcaggatcaggatcagcagattacgcaagttgggcaaaaagcagaagcacaataacaagaaatacaaatctaaatacagtaacattaaaaatgacatcactaacagcagcagacacagcaacatacttttgcgcaagtttttgggatctatggggaccaggaacattagtaacagtaagctca

SEQ ID NO: 50716 - RNA, 336 nt, synthetic construct
  misc_feature 1..336: note = derived and/or modified sequence opt6 from anti-influenza_Chain
  source 1..336: mol_type = other RNA
caacaacaactaatggaaagcggaggaggattagtaaaaccaggaggaagcctaacattaacatgtacagtaagcggactatcattatatagcaatgaaataaactgggtaagacaagcaccaggaaacggactagaatggataggagcaatagcaggatcaggatcagcagattacgcaagctgggcaaaaagcagaagcacaataacaagaaatacagatctaaatacagtaacattaaaaatgacatcactaacagcagcagacacagcaacatacttttgcgcatcattttgggatctatggggaccaggaacattagtaacagtaagcagc

SEQ ID NO: 50717 - RNA, 336 nt, synthetic construct
  misc_feature 1..336: note = derived and/or modified sequence opt6 from anti-influenza_Chain
  source 1..336: mol_type = other RNA
caacaacaattagtagaaagcggaggaggcctagtaaaaccaggaggaagcctaacattaacatgtagagtaagcggactatcactatttagcaatgaaataaactgggtaagacaagcaccaggaaacggactagaatggataggagcaataggaggaggaggatcggcagattacgcaagctgggcaaaaagcagaagtacaataacaagaaatacaaatctaaatacagtaacattaagaatgacatcactaacagcagcagacacagcagcatacttttgcgcatcattttgggatttatggggaccaggaacattagtaacagtaagcagc

SEQ ID NO: 50718 - RNA, 336 nt, synthetic construct
  misc_feature 1..336: note = derived and/or modified sequence opt6 from anti-influenza_Chain
  source 1..336: mol_type = other RNA
gaagtacaattagtagaaagtggaggaggattagtaaaaccaggaggaagtttaagattaagttgtgcagcaagtggattatcattatttagtaatgaaataaattgggtaagacaagcaccaggaaaaggattagaatggataggagcaataggaggaggaggatcagcagattatgcaagttgggcaaaaagtagatttacaatatcaagagataatgcaaaaaatagtttatatttacaaatgaattcattaagagcagaagatacagcagtatatttttgtgcaagtttttgggatttatggggaccaggaacattagtaacagtaagttca

SEQ ID NO: 50719 - RNA, 336 nt, synthetic construct
  misc_feature 1..336: note = derived and/or modified sequence opt6 from anti-influenza_Chain
  source 1..336: mol_type = other RNA
gacatagtaatgacacaatcaccactatcactaccagtaacaccaggagaaccagcatcaatatcatgcagatcatcacaatcactactaagatcaaacggatacaactacctagactggtacctacaaaaaccaggacaatcaccacaactactaatatacctaggatcaaacagagcatcaggagtaccagacagattctcaggatcaggatccggaacagacttcacactaaaaatatcaagagtagaagcagaagacgtaggagtatactactgcatgcaagcactacaaacaccatacacattcggacaaggaacaaaactagaaataaaa

SEQ ID NO: 50720 - RNA, 339 nt, synthetic construct
  misc_feature 1..339: note = derived and/or modified sequence opt6 from anti-influenza_Chain
  source 1..339: mol_type = other RNA
gacatagtaatgacacaatcaccagacttcctaccagtaagcctaggagaaagagcaacaataaactgcaaatcatcacaaagagtattatacagctcaaacaacaaaaactacctagcatggtaccaactaaaaccaggacaaccaccaaaactaataatatactgggcaagcacaagagaaagcggagtaccagacagattctcaggatcaggatcaggaacagaattcacactaacaataagctcactacaagcagaagacgtagcagtatactactgccaacaatactactcaagaccatacacattcggacaaggaacaaaactagaaataaaa

SEQ ID NO: 50721 - RNA, 339 nt, synthetic construct
  misc_feature 1..339: note = derived and/or modified sequence opt6 from anti-influenza_Chain
  source 1..339: mol_type = other RNA
gacatagtaatgacacaatcaccagactcactagcagtaagcctaggagaaagagcaacaataaactgtaaatcaagccaaagcgtactatacagctcaaacaataaaaattacttagcatggtaccaacaaaaaccaggacaaccaccaaaattactaatatactgggcaagcacaagagaaagcggagtaccagacagaatatcaggatcaggatcaggagcagactttacattaacaataagctcactacaagcagaagacgtagcagtatactactgccaacaatatttcgcaacaccaagaacattcggacaaggaacaaaagtagaaataaaa

SEQ ID NO: 50722 - RNA, 339 nt, synthetic construct
  misc_feature 1..339: note = derived and/or modified sequence opt6 from anti-influenza_Chain
  source 1..339: mol_type = other RNA
gacatagtaatgacacaatcaccagactcactagcagtatcattaggagaaagagcaacaataaactgcaaatcatcacaatcagtactatactcatcaaacaacaaatcacacctagcatggtaccaacaaaaaccaggacaaccaccaaaactactaatatactgggcatcaacaagagaatcaggagtaccagacagattctcaggatcaggatcaggaacagacttcacactaataatatcatcactacaagcagaagacgtagcagtatactactgccaacaatactacttctcaccactaacattcggaggaggaacaaaagtagaaataaaa

SEQ ID NO: 50723 - RNA, 339 nt, synthetic construct
  misc_feature 1..339: note = derived and/or modified sequence opt6 from anti-influenza_Chain
  source 1..339: mol_type = other RNA
gacatagtaatgacacaatcaccagactcactagcagtatcactaggagaaagagcaacaataaactgcagatcatcacaatcaatattccacaactcaaacaacgaaaactacctagcatggtaccaacaaaaaccaggacaaccaccaaaactactaatatactgggcatcaacaagagaatcaggagtaccagacagattctcaggatcaggatcaggaacagacttcacactaacaatatcatcactacaagcagaagacgtagcagtatacttctgccaacaatactacaacgcaccactaacattcggaggaggaacaaaagtagaaataaaa

SEQ ID NO: 50724 - RNA, 339 nt, synthetic construct
  misc_feature 1..339: note = derived and/or modified sequence opt6 from anti-influenza_Chain
  source 1..339: mol_type = other RNA
gaaatagtactaacacaatcaccactatcattaccagtcacaccaggagaaccagcatcaatatcatgcagatcatcacaatcactactacactcaaacggatacaactacctagactggtacctacaaaaaccaggacaatcaccacaactactaatatacctaggatcaaacagagcatcaggagtaccagacagattctcaggatcaggatcaggaacagacttcacactaaaaatatcaagagtagaagcagaagacgtaggagtatactactgcatgcaagcactacaaacaccactaacattcggaggaggaacaaaagtagaaataaaaaga

SEQ ID NO: 50725 - RNA, 339 nt, synthetic construct
  misc_feature 1..339: note = derived and/or modified sequence opt6 from anti-influenza_Chain
  source 1..339: mol_type = other RNA
gacatagtattaacacaaccaccatcagtatcagtagcaccaggacaaacagcaacaataacatgtggaggaaactatataggatcaaaatcagtaaactggtaccaacaaagaccaggacacgcaccagtattagtagtatatgacgattcagatagaccatcaggaataccagacagattctcaggatcaaactcaagatcaacagcaacaacagcaacactaacaatatcaagagtagaagcaggagatgaagcagactattactgtcaagtatgggaaacatcagaagatctatgggtatttggaggaggaacaaaactaacagtactaggacaa

SEQ ID NO: 50726 - RNA, 342 nt, synthetic construct
  misc_feature 1..342: note = derived and/or modified sequence opt6 from anti-influenza_Chain
  source 1..342: mol_type = other RNA
gacgtagtaatgacacaatcaccagactcactagcagtatcactaggagaaagagcaacaataaactgcaaatcatcacaatcagtactatactcatcaaacaacaaaaactacctagcatggtaccaacaaaaaccaggacaaccaccaaaactactaatatactgggcatcaacaagagaatcaggagtaccagacagattctcaggatcaggatcaggaacagacttcacactaacaatatcatcattacaagcagaagacgtagcagtatactactgccaacaatactactcaacaccactaacattcggaggaggaacaaaagtagacataaaaaga

SEQ ID NO: 50727 - RNA, 342 nt, synthetic construct
  misc_feature 1..342: note = derived and/or modified sequence opt6 from anti-influenza_Chain
  source 1..342: mol_type = other RNA
gacatacaaatgacacaatcaccagactcactagcagtatcactaggagaaaaagcaacaataaactgcaaatcatcacaatcaatactaaactcatcaaacaacaaaaactacctagcatggtaccaacaaaaaccaggacaaccaccaaaactactaatatactgggcatcaacaagagaatcaggagtaccagacagattctcaggatcaggatcaggaacagacttcacactaacaatatcatcactacaagcagaagacgtagcagtatactactgccaacaatactactcatcaccaccaacattcggacaaggaacaaaagtagaaataaaaaga

SEQ ID NO: 50728 - RNA, 342 nt, synthetic construct
  misc_feature 1..342: note = derived and/or modified sequence opt6 from anti-influenza_Chain
  source 1..342: mol_type = other RNA
gaaatagtactaacacaatcaccagcaacattaagcctatacccaggagaaagagcaacattaagctgtagagcaagccaaagcgtaagcagatacttagcatggtaccaacaaaaaccaggacaagcaccaagactattaatatatgacgcaagtaatagagcaacaggaataccagcaagattctcaggatcaggatcaggaacagactttacattaacaataagctcactagaaccagaagactttgcagtatactattgctgtgacagacaacaaagatcaaactggctaaaaataacattcggacaaggaacaagactagaaataaaaggaacggta

SEQ ID NO: 50729 - RNA, 342 nt, synthetic construct
  misc_feature 1..342: note = derived and/or modified sequence opt6 from anti-influenza_Chain
  source 1..342: mol_type = other RNA
gacatagtaatgacacaatcacaaaaattcgtaagcacatcagtaggagacagagtatcagtaacatgcaaagcatcacaaaacgtaggatcaaacgtagcatggtaccaacacaaaccaggacactcaccaacagcactaatatactcagcatcacacagatactcaggagtaccagacagattcacaggatcagaatcaggaacagacttcacactaacaatatcaaacgtacaaagcgaagacctagcagaatacttctgccaacaatactactcatacccatacacattcggaggaggaacaaaactagaaataaaaagagcagacgcagcaccaaca

SEQ ID NO: 50730 - RNA, 342 nt, synthetic construct
  misc_feature 1..342: note = derived and/or modified sequence opt6 from anti-influenza_Chain
  source 1..342: mol_type = other RNA
gacatagaaatgacacaatcaccactatcactaccagtaacaccaggagaatcagcatcaatatcatgcagatcatcacaatcattactacactcaaacggatacaactacctagactggtacctacaaaaaccaggacaatcaccacaactactaatatacctaggatcatcaagagcatcaggagtaccagacagattctcaggatcaggatcaggaacagacttcacactaaaaatatcaagagtagaagcagaagacgtaggagtatactactgcatgcaaggattacaaacaccatacacattcggacaaggaacaaaattagaaataaaaagaaca

SEQ ID NO: 50731 - RNA, 342 nt, synthetic construct
  misc_feature 1..342: note = derived and/or modified sequence opt6 from anti-influenza_Chain
  source 1..342: mol_type = other RNA
gacatagaaatgacacaatcaccactatcactaccagtaacaccaggagaaccagcatcaatatcatgcagatcatcacaatcactattacactcaaacggatacaaccacctagcatggtatttacaaaaaccaggaagatcaccacacttactaatatacctagcatcaacaagagcatcaggagtaccagacagattctcaggatcaggatcaggaacagacttcacactaaaaatatcaagagtagaagcagaagacgtaggaatatactactgcatgcaatcattacaaacatcaataacattcggacaaggaacaagactagaaataaaaagaaca

SEQ ID NO: 50732 - RNA, 345 nt, synthetic construct
  misc_feature 1..345: note = derived and/or modified sequence opt6 from anti-influenza_Chain
  source 1..345: mol_type = other RNA
caagtacaattagtacaaagtggagcagaagtaaaaaaaccaggaagtagtgtaagagtaagttgtaaaacaagtggaggaacatttagtagttatgcagtaacatgggtaagacaagcaccaggacaaggattagaatggatgggaggaataataggaatgtttggaacaacaaattatgcgcaaaaatttcaaggaagattaacaataacagcagatgaaatgacaagtacagcatatatggaattaagtagtttaagaagtgaagatacagcagtatattattgtgcaagaggaagttattattatgaaacaacattagattattggggaagaggaacatta

SEQ ID NO: 50733 - RNA, 345 nt, synthetic construct
  misc_feature 1..345: note = derived and/or modified sequence opt6 from anti-influenza_Chain
  source 1..345: mol_type = other RNA
gaagtacaattagtacaaagcggagcagaagtaaaaaaaccaggaagtagtgtaaaagtaagttgtaaaacaagtggaggaacatttagcagttatgcagtaacatgggtaagacaagcaccaggacaaggattagaatggatgggagcaataataggaatgtttggaacaacaaattatgcacaaaaatttcaaggaagagtaacaataacagcagatgaattaacaagtacagcatatatggaattaagtagcttaagaagtgatgatacagcagtatattactgtgcaagaggaagttattattatgaaagtagtctagattattggggaaaaggaacatta

SEQ ID NO: 50734 - RNA, 345 nt, synthetic construct
  misc_feature 1..345: note = derived and/or modified sequence opt6 from anti-influenza_Chain
  source 1..345: mol_type = other RNA
caagtacaattagtacaaagcggagcagaagtaaaaaaaccaggaagtagtgtaaaagtaagctgtaaaacaagtggaggaacatttagtagttatgcagtaacatgggtaagacaagcaccaggacaaggattagaatggatgggaggaataataggaatgtttggaacaacaaattatgcacaaaaatttcaaggaagagtaacaataacagcagatgaattaacaagtacagcatatatggaattaagtagtctaagaagtgaagatacagcagtatattattgtgcaagaggaagttattattatgaaagtagtttagattattggggaagaggaacatta

SEQ ID NO: 50735 - RNA, 345 nt, synthetic construct
  misc_feature 1..345: note = derived and/or modified sequence opt6 from anti-influenza_Chain
  source 1..345: mol_type = other RNA
gaagtacaattagtacaaagtggagcagaagtaaaaaaaccaggagcaagtgtaaaagtaagttgtaaagcaagtggatatacatttacaggatattatgtatattgggtaagacaagcaccaggacaaggattagaatggatgggatggataagtgcatataatggaaatacaaattatgcacaaaaatttcaaggaagagtaacaataacagcagataaaagtacaagtacagcatatatggaattaagtagtttaagaagtgaagatacagcagtatattattgtgcaagaagtagaagtttagatgtatggggacaaggaacaacagtaacagtaagtagt

SEQ ID NO: 50736 - RNA, 345 nt, synthetic construct
  misc_feature 1..345: note = derived and/or modified sequence opt6 from anti-influenza_Chain
  source 1..345: mol_type = other RNA
gacatagtaatgacacaatcaccactatcactaccagtaacaccaggagaaccagcatcaatatcatgcagatcatcacaatcactactacactcaaacggacacatatacttcgactggtacctacaaaaaccaggacaatcaccacaactactaatatacctagtatcaaaaagagcatcaggagtaccagacagattctcaggatcaggatcaggaacagacttcacactaaaaatatcaagagtagaagcagaagacgtaggagtatactactgcatgcaagcactagaaacaccattcacattcggaccaggaacaaaagtacacataaaaagaacagta

SEQ ID NO: 50737 - RNA, 345 nt, synthetic construct
  misc_feature 1..345: note = derived and/or modified sequence opt6 from anti-influenza_Chain
  source 1..345: mol_type = other RNA
caatcagcactaacacaaccagcatcagtatcaggatcaccaggacaatcaataacaatatcatgcacaggaacatcatcagacgtaggagcatacaactacgtatcatggtatcaacaccacccaggaaaagcaccaaaactaatgatatacgacgtaacatacagaccatcaggagtatccacaagattctcaggatcaaaatcaggaaacacagcatcactaacaatatcaggactacaagcagaagacgaagcagactactactgctcatcacaatcaagatcatcaacactagtaatattcggaggaggaacaaaactaacagtactaggacaaccaaaa

SEQ ID NO: 50738 - RNA, 345 nt, synthetic construct
  misc_feature 1..345: note = derived and/or modified sequence opt6 from anti-influenza_Chain
  source 1..345: mol_type = other RNA
gacatagtactaacacaatcaccagtatcactagcagtatcactaggagaatcagcaacagtaaactgcaaatcatcacaatcagtactatcaaactccaaaaacctaaactacctagcatggtaccaacacaaaccaggacaaccaccaaaactactaatatactgggcatcaacaagagaatcaggagtaccagacagattctcaggatcaggatcaggaacagacttcacactaacaatatcatcactacaagcagaagacgtagcagtatactactgccaacaacactactcaataccactaacattcggaccaggaacaaaagtagacataaaaagaaca

SEQ ID NO: 50739 - RNA, 348 nt, synthetic construct
  misc_feature 1..348: note = derived and/or modified sequence opt6 from anti-influenza_Chain
  source 1..348: mol_type = other RNA
gacatagtactaacacaatcaccattatcactaccagtaacaccaggagaaccagcatcaatatcatgcagatcatcacaatcactactagactcaaacggatacaactacctagactggtacctacaaaaaccaggacaatcaccacaactactaatatacctagcatcatacagagcaccaggagtaccagacagattctcaggatcaggatcaggaacagacttcacactaaaaatatcaagagtagaagcagaagacgtaggactatactactgcatgcaagcactacaaaccccaccaatgtacacattcggacaaggaacaaaactagaaataaaaagaaca

SEQ ID NO: 50740 - RNA, 351 nt, synthetic construct
  misc_feature 1..351: note = derived and/or modified sequence opt6 from anti-influenza_Chain
  source 1..351: mol_type = other RNA
ctagaaagcggaggaggattagtacaaccaggaggaagcctaagactaagctgtgcagcaagtggaataacattctcaagctatgcaatgagttgggtaagacaagcaccaggaaaaggactagaatgggtaagcacagtaaatagcggaggaggaagcacatactatggagatagtgtaagaggaagatttacaataagcagagacaatagcaaaagcacactatatctacaactaaatagcttaagagcagaagatacagcaatatattactgtgcaaaagacaaaggaagaccaatattcggattagtaacaccaagctattacatggacgtatggggaaacggaaca

SEQ ID NO: 50741 - RNA, 351 nt, synthetic construct
  misc_feature 1..351: note = derived and/or modified sequence opt6 from anti-influenza_Chain
  source 1..351: mol_type = other RNA
caagaacaattagtacaaagcggagcagaagtaaaaaaaccaggagcaagcgtaaaagtaagctgtaaagcaagcagaaaatcattcataggatattacgtacactgggtaagacaagcaccaggacaaggactagaatggatgggatggatatcaccagatagcgatgcaacaaaatatgcacaaaaatttcaaggaagcgtaataatgacaagagacacaagcgtaagcacagtatatatggaactatcaagattaacatcagacgatacagcactatattactgtctattattcagaggaggaaactcactatcatggggacaaggaacattagtaacagtatcaagc

SEQ ID NO: 50742 - RNA, 351 nt, synthetic construct
  misc_feature 1..351: note = derived and/or modified sequence opt6 from anti-influenza_Chain
  source 1..351: mol_type = other RNA
caagtacaattacaagaaagcggaccaggattagtaaaaccaagcgaaacattaagcctaacatgtacagtaagcggaagctcaatatcaaactattactggagctggataagacaatcaccaggaaaaggactagaatggataggatttatatattacggaggaaatacaaaatacaatccatcactaaaaagcagagtaacaatatcacaagatacatcaaaatcacaagtaagcctaacaatgagctcagtaacagcagcagaatcagcagtatacttttgcgcaagagcaagctgtagcggaggatattgcatattagattactggggacaaggaacattagtaaca

SEQ ID NO: 50743 - RNA, 351 nt, synthetic construct
  misc_feature 1..351: note = derived and/or modified sequence opt6 from anti-influenza_Chain
  source 1..351: mol_type = other RNA
gaagtacaattagtagaaagtggaggaggattagtacaaccaggagggagtttaagattaagttgtgcagcaagtggatttacatttagtatatatgcaatgagttgggtaagacaagcaccaggaaaaggattagaatgggtaagtgcaataagtagtagtggagatagtacatattatgcagatagtgtgaaaggaagatttacaataagtagagataatgcaagaaatacattatatttacaaatgaatagtttaagagcagaagatacagcagtatattattgtgcaagagcatatggatatacatttgatccatggggacaaggaacattagtaacagtaagtagt

SEQ ID NO: 50744 - RNA, 354 nt, synthetic construct
  misc_feature 1..354: note = derived and/or modified sequence opt6 from anti-influenza_Chain
  source 1..354: mol_type = other RNA
caagtacaactacaagaatcaggaccaggattagtaaaaccatcagaaacactatcactaacatgcacagtatcaggatactcattcgactcaggatactactggggatggctaagacaaccaccaggaaaaggactagaatggataggatcaatataccactcaagaaacacatactacaacccatcactaaaatcaagagtaacaatatcagtagacacatcaaaaaaccaattctcactacaactatcatcagtaacagcagcagacacagcagtatactactgcgcaagaggaacatggtactcatcaaacctaagatactggttcgacccatggggaaaaggaacacta

SEQ ID NO: 50745 - RNA, 354 nt, synthetic construct
  misc_feature 1..354: note = derived and/or modified sequence opt6 from anti-influenza_Chain
  source 1..354: mol_type = other RNA
caaccagtattaacacaaccaccaagcgcaagtgcaagcttaggagcaagcgtaacattaacatgtacattaagctcagcatatagcaattacaaagtagattggtatcaacaaagaccaggaaaaggaccaagatttgtaatgagagtaggaacaggaggaatagtaggatcaaaaggagacggaataccagacagattcagcgtattaggatcaggattaaacagatacttaacaataaaaaatatacaagaagaagacgaaagcgattaccattgcggagcagatcacggaagcggaagcaatttcgtaagcccatacgtattcggaggaggaacaaaactaacagtatta

SEQ ID NO: 50746 - RNA, 354 nt, synthetic construct
  misc_feature 1..354: note = derived and/or modified sequence opt6 from anti-influenza_Chain
  source 1..354: mol_type = other RNA
caagtacaattagtacaaagcggagcagatgtaaaaaaaccaggatcaagcgtaacagtaagctgtaaagcaagcggaggatcattctcaaactatggaataaactgggtaagacaagcaccaggacaaggactagaatggatgggaggaataataccattaataaatgcaccaaactatgcaccaaaatttcaaggaagagtaacaataacagcagacatgttctcaaacatagtatcactacaactaacaagcttaagaacagacgatacagcagtatattactgtgcaagaagaaaaatgacaacagcaatagattactggggacaaggaacactagtaacagtaagctca

SEQ ID NO: 50747 - RNA, 354 nt, synthetic construct
  misc_feature 1..354: note = derived and/or modified sequence opt6 from anti-influenza_Chain
  source 1..354: mol_type = other RNA
caagtacaattagtacaaagcggagcagaagtaaaaaaaccaggaagtagcgtaaaagtaagctgtagagaaagcggaggaacattcaatggatatacaataacatgggtaagacaagcaccaggacaaggactagaatggatgggaggaataataccaatgatgggaacagtaaactatgcacaaaaattacaaggaagagtaacaataacaacagactatttcacaaaaacagcatatatggatttaaataacttaagatcagaagatacagcaatgtattactgtgtaaaaataagatacacaggacaacaactactatggggacaaggaacactagtaacagtaagctca

SEQ ID NO: 50748 - RNA, 354 nt, synthetic construct
  misc_feature 1..354: note = derived and/or modified sequence opt6 from anti-influenza_Chain
  source 1..354: mol_type = other RNA
caagtacaattagtacaaagcggagcagaagtaaaaaaaccaggagcaagcgtaaaagtaagctgtaaagcaagcggacacacattcacaggatattacatacactgggtaagacaagcaccaggacaaggactagaatggatgggatggataaatccagatagcggagcaacaagctcagcacaaaactttcaaggaagagtaacaatgacaggagacacaagttcaagcacagcatatatggaattatcaagattaagctttgacgatacagcagtatattactgtgcaagagtattattcacaagcccattcgatttctggggagaaggaacactagtaacagtaagctca

SEQ ID NO: 50749 - RNA, 354 nt, synthetic construct
  misc_feature 1..354: note = derived and/or modified sequence opt6 from anti-influenza_Chain
  source 1..354: mol_type = other RNA
caaccagtattaagtcaaccaccaagcgcaagcgcaagtctaggagcaagcgtaacattaacatgtacattaagctcaggatttgacaattaccaagtagcatggtatcaacaaagaccaggaaaaggaccaagatttgtaatgagagtaggaaatggaggaaacgtagcatcaaaaggagacggaataccagacagattctcagtatcaggatcaggactaaacagatacttaacaataaaaaatatacaagaagatgacgaaagcgattactattgcggagcagatcacggaagcggaaacaatttcgtaagcccatacgtattcggaggaggaacaaaactaacagtatta

SEQ ID NO: 50750 - RNA, 354 nt, synthetic construct
  misc_feature 1..354: note = derived and/or modified sequence opt6 from anti-influenza_Chain
  source 1..354: mol_type = other RNA
gaagtacaattagtagaaagtggagcagaagtaaaaaaaccaggagcaagtgtaaaagtaagttgtaaagcaagtggatatacatttagcagatattatatacattgggtaagacaagcaccaggacaagaattagaatggatgggatggataaatccagatagtggagatacaaattatgcacaaaaatttagaggaagagtaacaatggcaagagatacaagtataagtacagtatatatggaattaaatagtttaagatatgatgatacagcagtatatttttgtgcaagaataatatggagtagtagtggaatggatgtatggggacaaggaacaacagtaacagtaagt

SEQ ID NO: 50751 - RNA, 354 nt, synthetic construct
  misc_feature 1..354: note = derived and/or modified sequence opt6 from anti-influenza_Chain
  source 1..354: mol_type = other RNA
gaagtacaattattagaaagtggaggaggagtagtacaaccaggaagaagtttaagattaagttgtgcagcaagtggatttacatttagaacatatggaatgcattgggttagacaagcaccaggaaaaggattagaatgggtagcagtaataagtcatgatggaaatttaaaatattatggaggaagtgtaaaaggaagatttacaataagtagagataatagtaaaaatgcattatatctacaaatgaatagtttaagagtagatgatacagcattatattattgtgcaagaggaataggaataacagatgcatttgatataagaggacaaggaacaatggtagtagtaagt

SEQ ID NO: 50752 - RNA, 354 nt, synthetic construct
  misc_feature 1..354: note = derived and/or modified sequence opt6 from anti-influenza_Chain
  source 1..354: mol_type = other RNA
gaagtacaattagtagaaagcggaggaggattagtacaaccaggaggatcattaagattaagttgtacagcaagcggactatcagtatcaagtacatacatgaactgggtaagacaagcaccaggaaaaggattagaatgggtaagcgtattctatagcgaaacaagaacatattacgcagactcagtaaaaggaagattcacagtatcaagacataattcaaataatacattatatttacaaatgaatagcttaagagtagaagacacagcagtatattattgtgcaagagtacaaagattatcatacggaatggatgtatggggacaaggaacaacagtaacagtaagttca

SEQ ID NO: 50753 - RNA, 354 nt, synthetic construct
  misc_feature 1..354: note = derived and/or modified sequence opt6 from anti-influenza_Chain
  source 1..354: mol_type = other RNA
gaagtacaattagtagaaagcggaggaggattagtacaaccaggaggaagtttaagattaagctgtacagcaagcggactatcagtatcaagtacatacatgaactgggtaagacaagcaccaggaaaaggactagaatgggtaagcgtattctatagcgaaacaagaacatattacgcagactcagtaaaaggaagattcacagtatcaagacataattcaaataatacattatatttacaaatgaactcattaagagcagaagacacagcagtatattattgtgcaagagtacaaagactatcatacggaatggatgtatggggacaaggaacaacagtaacagtaagttca

SEQ ID NO: 50754 - RNA, 354 nt, synthetic construct
  misc_feature 1..354: note = derived and/or modified sequence opt6 from anti-influenza_Chain
  source 1..354: mol_type = other RNA
gatatgcaattagtagaaagtggaggaggattagtaccaccaggaggaagtttaagattaagttgtgcagcaagtggattctcagtatcagataattatataaattgggtaagacaagcaccaggaaaaggattagattgggtaagtgtattttatagtgcagatagaacatcatatgcagattcagtaaaaggaagatttacagtatcaagtcatgatagtaaaaatacagtatatttacaaatgaatagtttaagagcagaagatacagcagtatattattgtgcaagagtacaaaaatcatattatggaatggatgtatggggacaaggaacaacagtaacagtatcatca

SEQ ID NO: 50755 - RNA, 357 nt, synthetic construct
  misc_feature 1..357: note = derived and/or modified sequence opt6 from anti-influenza_Chain
  source 1..357: mol_type = other RNA
gaagtacaattagtagaaagcggaccagtattagtaaaaccaacagaaacactaacagtaacatgtacagtaagcggattctcagtagataacgatagaatgggagtaagctggataagacaaccaccaggaaaagcactagaatggttagcacatatatttagcaatgacgaaaaatcatactcaacaagtctaagaagcagactaacaatatcaaaagatacatcaaaaagacaagtagtattaagcatgacagatatggatccagtagacacagcaacatactattgcgcaagagcaccatcagaatatgcagcaatggatgtatggggacaaggaacaatggtaacagtaagc

SEQ ID NO: 50756 - RNA, 357 nt, synthetic construct
  misc_feature 1..357: note = derived and/or modified sequence opt6 from anti-influenza_Chain
  source 1..357: mol_type = other RNA
caagtacaagtagtacaaagcggaacagaagtaaaaaaaccaggaagtagcgtaaaagtaagttgtcaaacaagtggaggaagatttatgagctatgcaataacatgggtaaggcaagcaccaggacaaggattagaatggatgggaggaatagtaccagtatttggaacagcaaattatgcacaaaaatttcaaggaagagtaacaataacaacggatgatagtacaagaacagcatatatggaattaagtagcttaagaagtgaagatacagcagtatattattgtggatttagatatggaagtggatatggatttgatagttggggacaaggaacattagtaacagtaagtagt

SEQ ID NO: 50757 - RNA, 357 nt, synthetic construct
  misc_feature 1..357: note = derived and/or modified sequence opt6 from anti-influenza_Chain
  source 1..357: mol_type = other RNA
gaagtacaattagtagaatcaggagcaggagtaaaaaaaccaggaagttcagtaaaagtatcatgtaaagcatcaggaaatacatttagttcaaatgcaataagttgggtaagacaagcaccaggacaaggattagaatggatgggaggaatattaggaatgctaagaacaacaaattatgcacaaaaatttcaaggaagagtaacaataacagcagatgaatttatgaatacagcatatatggaactaagttcactaacaagtgaagacacagcagtatattattgtgcaagatcaagcggatattatccagattattttcatttatggggacaaggaacattagtaacagtatca

SEQ ID NO: 50758 - RNA, 357 nt, synthetic construct
  misc_feature 1..357: note = derived and/or modified sequence opt6 from anti-influenza_Chain
  source 1..357: mol_type = other RNA
caagtacaattacaagaaagcggaccaggattagtaaaaccaagcgaaacattaagcctaacatgtacagtaagcggaagctcaatatcaaactattactggagctggataagacaatcaccaggaaaaggactagaatggataggatttatatattacgggggaaatacaaaatacaatccatcactaaaaagcagagtaacaatatcacaagatacatcaaaatcacaagtaagcctaacaatgagctcagtaacagcagcagaatcagcagtatacttttgcgcgagagcaagctgtagtggaggatattgcatactagattactggggacaaggaacattagtaacagtaagc

SEQ ID NO: 50759 - RNA, 357 nt, synthetic construct
  misc_feature 1..357: note = derived and/or modified sequence opt6 from anti-influenza_Chain
  source 1..357: mol_type = other RNA
gaagtacaattagtagaatcaggaggaggattagtacaaccaggaggaagtttaagaataagttgtgcagcaagtggattcacagtatcgagtaattatatgagttgggtaagacaagcaccaggaaaaggactagaatgggtaagtgtaatatatagtggaggatcaacatattatgcagactcagtaaaaggaagattctcattctcacgagataatagtaaaaatacagtattcttacaaatgaatagtttaagagcagaagacacagcagtatattattgcgcaagatgtctatcaagaatgagaggatacggactagatgtatggggacaaggaacaacagtaacagtatca

SEQ ID NO: 50760 - RNA, 357 nt, synthetic construct
  misc_feature 1..357: note = derived and/or modified sequence opt6 from anti-influenza_Chain
  source 1..357: mol_type = other RNA
caagtacaattacaagaatcaggaccaggactagtaaaaccatcagaaacactatcactaacatgcacagtatcaggagcatcaatatcatcagactactggtcatggataagactaccaccaggaaaaggactagaatggataggatacatatacaacagaggatcaacaaaatacacaccatcactaaaatcaagagtaacaatatcactagacacagcagaaaaccaattctcactaagactaagatcagtaacagcagcagacacagcaatatactactgcgcaagacacgtaggaggacacacatacggaatagactactggggacaaggaacactagtaacagtatcatca

SEQ ID NO: 50761 - RNA, 357 nt, synthetic construct
  misc_feature 1..357: note = derived and/or modified sequence opt6 from anti-influenza_Chain
  source 1..357: mol_type = other RNA
caagtacaactacaagaatcaggaccaggattagtaaaaccatcagaaacactatcactaacatgcacagtatcaggagcatcaatatcatcagactactggtcatggataagactaccaccaggaaaaggactagaatggataggatacatatacaacagaggatcaacaaaatacacaccatcactaaaatcacgagtaacaatatcactagacacagcagaaaaccaattctcactaagactaagatcagtaacagcagcagacacagcagtatactactgcgcaagacacgtaggaggacacacatacggaatagactactggggacaaggaacattagtaacagtatcatca

SEQ ID NO: 50762 - RNA, 357 nt, synthetic construct
  misc_feature 1..357: note = derived and/or modified sequence opt6 from anti-influenza_Chain
  source 1..357: mol_type = other RNA
caagtacaattacaagaaagcggaccaagattagtaaaaccaagcgaaagcctatcattaacatgtacagtaagcggaggaagcatatcaaactcattctggggatggataagacaaccaccaggagaaggattagaatggataggatatgtatataactcaggaaatacaaaatacaatccatcactaaaaagcagagtaacaatatcaagagatacatcaaaatcacaattatacatgaaattaagatcagtaacagcagcagacacagcagtatactattgcgcaagacatgacgacgcatcacacggatactcaatatcatggggacacggaacattagtaacagtatcaagc

SEQ ID NO: 50763 - RNA, 357 nt, synthetic construct
  misc_feature 1..357: note = derived and/or modified sequence opt6 from anti-influenza_Chain
  source 1..357: mol_type = other RNA
gaagtacatctacaacaatcaggaccagaattagtaaaaccaggagcatcagtaaaaatgtcatgcgaagcatcaggatatacatttacagattactatgtagcatgggtaaaacaaagcccaggagaatcatttgaatggataggaagagtaaacccatacagcggaggaacatcatacaatcaaaaattcaaaggaaaagcaacactaatagtagataaatcaagctcaacagcatacatggaattaagctcactaacaagcgaagacagtgcagtatactattgcgcaagatgggactatggagtatacgaaggatatatagattactggggacaaggatcagcattaacagta

SEQ ID NO: 50764 - RNA, 360 nt, synthetic construct
  misc_feature 1..360: note = derived and/or modified sequence opt6 from anti-influenza_Chain
  source 1..360: mol_type = other RNA
caagtacaattagtacaaccaggagcagaagtaaaaaaaccaggatcaagcgtaaaagtaagctgtaaagcaagcggaggaatattctcaccatatgcaataagctgggtaagacaagcaccaggacaaggactagaatggatgggaggaataatagcaatattcggaacaacaaactatgcacaaaaatttcaaggaagagtaacaataacagcagacaaaagcacaacaacagcatatctagaactaaatagcttacgatttgaagatacagcagtatattactgtgcaagaggaggaagatattacgtagactatttcgattactggggacaaggaacactagtaagcgtaagctca

SEQ ID NO: 50765 - RNA, 360 nt, synthetic construct
  misc_feature 1..360: note = derived and/or modified sequence opt6 from anti-influenza_Chain
  source 1..360: mol_type = other RNA
caagtacaattacaagaaagcggaccagatctagtaaaaccaggagcaagtgtaaaaatgagctgtaaagcaagcggatactcattcacatactatcacatgcactgggtaaaacaaacacacggaaaatcactagaatggataggaagaataccatacaatggaggaacaaattactcacaaagattcaaaggaaaagcagtattcacagtagatatgtcaagctcaacagcatacatggaattaagatcactaacaagcgaagactcagcagtatactattgcgcaagagatgcaaattacgaaggagattggtatttcgatgtatggggacaaggaacaacagtaacagtaagttca

SEQ ID NO: 50766 - RNA, 360 nt, synthetic construct
  misc_feature 1..360: note = derived and/or modified sequence opt6 from anti-influenza_Chain
  source 1..360: mol_type = other RNA
caagtacaattagtacaaagcggagcagaagtaaaagaaccaggatcagcaatgaaagtaagctgtaaagcaagcggaggaacattctcaagtgatgcattttgctgggtaagacaagcaccaggaagaggactagaatggatgggaggaataataccagtattccaaacagcaaactatggaccaaattttcaaggaagagtaacaataagtgcagacgtatacacaacaacactatatctagaactatcaggattaacatcagaagatacagcagtatatttctgtgcaagaagtggagatggatacaattactatttcccactatggggacaaggaacattagtaacagtaagttca

SEQ ID NO: 50767 - RNA, 360 nt, synthetic construct
  misc_feature 1..360: note = derived and/or modified sequence opt6 from anti-influenza_Chain
  source 1..360: mol_type = other RNA
caaataacactaagagaatcaggaccaacactagtaaaaccaacacaaacactaacactaacatgcacattctcaggattctcactatcaacaaacggagtaaacgtaggatggataagacaaccaccaggaaaagcactagaatggctagcactaatatactgggacgacgacaaaagatactcaccatcactaaaaagaagactaacaataacaaaagacacatcaaaaaaccaagtagtactaacactaacaaacatggacccagtagacacagcaacatactactgcgcacacagaccagacttctacggagacttcgaatactggggaccaggaacactagtaacagtatcatca

SEQ ID NO: 50768 - RNA, 360 nt, synthetic construct
  misc_feature 1..360: note = derived and/or modified sequence opt6 from anti-influenza_Chain
  source 1..360: mol_type = other RNA
caagtacaattagtacaaagcggaagcgaagtaaaaaaaccaggaacaagcgtaaaagtaagctgtacagcaagcggaagcgtattcacaaactatggaataagttgggtaagacaagcaccaggacaaggactagaatggatgggcggaataataccattattcggagcagcaaaatatgcacaaaaatttcaaggaagagtaacaataacagcagacgaaagcacaaaaacagtatatatggaactatcaagattaacatcaaaagatacagcaatatatttctgtgcaaaagcaccaagagtatacgaatactatttcgatcaatggggacaaggaacaccagtaacagtaagctca

SEQ ID NO: 50769 - RNA, 360 nt, synthetic construct
  misc_feature 1..360: note = derived and/or modified sequence opt6 from anti-influenza_Chain
  source 1..360: mol_type = other RNA
caagtacaattagtacaaagcggagcagatttaaaaaaaccaggagcaagcgtaaaagtaagctgtaaagcaagcggatacacattcacagactattacatacactgggtaagacaagcaccaggacaaggactagaatggatgggatggataaatccagaaagcggagacacaaaatatgcacaaaaatttcaaggacgagtaacaatgacaagagacacaagtataacaacagcatatatggaactaggaagattaagatcagacgacacagcagtatattactgtgcaagagacgtaagtacaacatggagctggttcgcaccatggggacaaggaacattagtaacagtaagttca

SEQ ID NO: 50770 - RNA, 360 nt, synthetic construct
  misc_feature 1..360: note = derived and/or modified sequence opt6 from anti-influenza_Chain
  source 1..360: mol_type = other RNA
caagtacaactacaagaatcaggaccaggactagtaaaaccatcagaaacactatcattaacatgctcagtatcaggaggatcaataaactactactactggagctggataagacaaccaccaggaaaaggactagaatgcataggatacatatcagacacaggaagaacatactacaacccatcactaagatcaagagtaacaatatcagtagacacatcaaaaaaccaattctcactaaacctaacatcaatgacagcagcagacacagcagtatactactgcgcaagagacccaacaggatcaagacaaaaaaacgcattcgacatgtggggacaaggaacaatggtaacagtatca

SEQ ID NO: 50771 - RNA, 360 nt, synthetic construct
  misc_feature 1..360: note = derived and/or modified sequence opt6 from anti-influenza_Chain
  source 1..360: mol_type = other RNA
caagtacaattacaagaatcaggaccaagagtagtaagaccaagcgaaacattatcattaacatgtacagtaagcggtggatcaatatcaagctataactggatatggataagacaaccaccaggaaaaggactagaatggataggacatatatatgactatggaagaacattttacaatagctcactacaaagcagaccaacaatatcagtagatgcaagcaaaaatcaattatcattaagattaacaagcgtaacagcatcagacacagcagtatactattgcgcaagaccactaggaatattacactattacgcaatggatctatggggacaaggaacaacagtaacagtaagctca

SEQ ID NO: 50772 - RNA, 360 nt, synthetic construct
  misc_feature 1..360: note = derived and/or modified sequence opt6 from anti-influenza_Chain
  source 1..360: mol_type = other RNA
caagtacaactacaagaaagtggaccaggattagtaaaaccaagcgaaacattaagcttaacatgtagcgtaagcggaggatcaatatcaagcgatttctggagctggataagacaaccaccaggaaaaggactagaatggataggatatgtatataacagaggatcaacaaaatactcaccatcactaaaaagcagagtaacaatatcagcagatatgtcaaaaaatcaatttagcttaaacatgagctcagtaacagcagcagacacagcagtatactattgcgcaaaaaatggaagaagctcaacatcatggggaatagatgtatggggaaaaggaacaacagtaacagtaagctca

SEQ ID NO: 50773 - RNA, 360 nt, synthetic construct
  misc_feature 1..360: note = derived and/or modified sequence opt6 from anti-influenza_Chain
  source 1..360: mol_type = other RNA
caagtacaactacaagaatcaggaccaggactagtaaaaccatcagaaacactatcactaacatgcacagtatcaggaggatcaatatcagcataccactggtcatggataagacaaccaccaggaaaaggactagaatggataggacacatattcgactcaggaagcacatactacaacccatcactaaaatcaagagtaacaatatcactagacgcatcaaaaaaccaactatcactaagactaacatcagtaacagcatcagacacagcaatatactactgcgcaagaccactaggatcaagatactactacggaatggacgtatggggacaaggaacaacagtaacagtatcatca

SEQ ID NO: 50774 - RNA, 360 nt, synthetic construct
  misc_feature 1..360: note = derived and/or modified sequence opt6 from anti-influenza_Chain
  source 1..360: mol_type = other RNA
gaagtacaattagtagaatcaggaggaggattagtacaaccaggaggaagtttaagaataagttgtgcagcaagtggatttacagtatcaagtaattatatgagttgggtaagacaagcaccaggaaaaggattagaatgggtgagtgtaatatatagcggaggatcaacatattatgcagattcagtaaaaggaagatttagtttttcaagagataatagtaaaaatacagtatttttacaaatgaatagtttaagagcagaagacacagcagtatattattgtgcaagatgtttatcaagaatgagaggatatggactagatgtatggggacaaggaacaacagtaacagtatcatca

SEQ ID NO: 50775 - RNA, 360 nt, synthetic construct
  misc_feature 1..360: note = derived and/or modified sequence opt6 from anti-influenza_Chain
  source 1..360: mol_type = other RNA
caagtacaattacaagaaagcggaccaggattagtaaaaccaagcgaaacactaagcctaacatgtacagtaagcggaagctcaatatcaaactattactggagctggataagacaatcaccaggaaaaggactagaatggataggatttatatattacggaggaaatacaaaatacaatccatcactaaaaagtagagtaacaatatcacaagatacatcaaaatcacaagtaagcctaacaatgagctcagtaacagcagcagaatcagcagtatacttttgcgcaagagcaagctgtagtggaggatattgcatactagattactggggacaaggaacattagtaacagtaagctca

SEQ ID NO: 50776 - RNA, 360 nt, synthetic construct
  misc_feature 1..360: note = derived and/or modified sequence opt6 from anti-influenza_Chain
  source 1..360: mol_type = other RNA
caagtacaattacaacaatcaggagcagaagtaaaaaaaccaggaagttcagtaaaagtatcatgtaaagtatcaggagtaatattcagtggaagtgcaatatcatgggtaagacaagcaccaggacaaggactagaatggatgggaggaataagtccactattcggaacaacaaattacgcacaaaaattccaaggaagagtaacaataacagcagaccaatcaacaaatacaacatacatggaagtaaattcactaagatatgaagacacagcagtatatttctgtgcaagaggaccaaaatactacagcgaatacatggacgtatggggaaaaggaacaacagtaacagtatcaagc

SEQ ID NO: 50777 - RNA, 360 nt, synthetic construct
  misc_feature 1..360: note = derived and/or modified sequence opt6 from anti-influenza_Chain
  source 1..360: mol_type = other RNA
caagtacaattagtacaaagcggagcagaagtaaaaaaaccaggatcaagcgtaaaagtaagctgtaaagcaagcggaggaacattctcaagttatgcaataagctgggtaagacaagcaccaggacaaggactagaatggatgggaggaataatgggaatgttcggaacaacaaactatgcacaaaaatttcaaggaagagtaacaataacagcagacgaattcacaagcgcagcatatatggaattaagaagtttaagatcagaagatacagcagtatattactgtgcaagaagctcaggatattacccagaatatttccaagactggggacaaggaacactagtaacagtaagctca

SEQ ID NO: 50778 - RNA, 360 nt, synthetic construct
  misc_feature 1..360: note = derived and/or modified sequence opt6 from anti-influenza_Chain
  source 1..360: mol_type = other RNA
caaatgcaattagtacaaagcggagcagaagtaaaaaaaccaggatcaagcgtaaaagtaagctgtaaagcaagcggaggaacattctcaagctatgcaataacatgggtaagacaagcaccaggacaaggattagaatggatgggaggaataataggaatgttcggaagcacaaactatgcacaaaactttcaaggaagagtaacaataacagcagacgaaagcacaagcacagcatatatggaactatcaagcttaagaagtgaagatacagcagtatattactgtgcaagaagcacaggatattacccagcatatctacatcactggggacaaggaacactagtaacagtaagctca

SEQ ID NO: 50779 - RNA, 360 nt, synthetic construct
  misc_feature 1..360: note = derived and/or modified sequence opt6 from anti-influenza_Chain
  source 1..360: mol_type = other RNA
gaagtacaactagtagaaagcggagcagaagtaaaaaaaccaggaagtagcgtaaaagtaagctgtaaagcaagcggaggaacattctcaagctatggaataagctgggtaagacaagcaccaggacaaggactagaatggatgggagatataataggaatgttcggaagcacaaactatgcacaaaactttcaaggaagattaacaataacagcagacgaaagcacaagtacagcatatatggaactatcaagcttaagatcagaagatacagcagtatattactgtgcaagaagctcaggatattacccagcatatctaccacactggggacaaggaacactagtaacagtgagctca

SEQ ID NO: 50780 - RNA, 360 nt, synthetic construct
  misc_feature 1..360: note = derived and/or modified sequence opt6 from anti-influenza_Chain
  source 1..360: mol_type = other RNA
gaagtacaattagtagaaagcggagcagaagtaaaaaaaccaggatcaagcgtaaaagtaagctgtaaagcaagcggaggaacattctcaagctatgcaataagctgggtaagacaagcaccaggacaaggactagaatggatgggaggaataataggaatgttcggaacagcaaactatgcacaaaaatttcaaggaagagtaacaataacagcagacgaattcacaagcacagcatatatggaattatcaagcttaagatcagaagatacagcagtatattactgtgcaagaggaaattactattacgaaagcagtctagattactggggacaaggaacattagtaacagtaagctca

SEQ ID NO: 50781 - RNA, 360 nt, synthetic construct
  misc_feature 1..360: note = derived and/or modified sequence opt6 from anti-influenza_Chain
  source 1..360: mol_type = other RNA
caagtacaattagtacaaagcggagcagaagtaaaaaaaccaggaagtagtgtaaaagtaagttgtaaagcaagtggaggaccatttagaaattttgcaataaattgggtaagacaagcaccaggacaaggactagaatggatgggaggaataatagcagtatttggaacaacaaaatatgcacataaatttcaaggaagagtaacaataacagcagacgatagtacaaatacagcatatatggaattaggaagtttaaaaagtgaagatacagcagtatattattgtgcaagaggaccacattattatagtagttatatggatgtatggggagaaggaacaacagtaacagtaagtagt

SEQ ID NO: 50782 - RNA, 360 nt, synthetic construct
  misc_feature 1..360: note = derived and/or modified sequence opt6 from anti-influenza_Chain
  source 1..360: mol_type = other RNA
gaagtagcattagtagaaacaggagcagaagtaaaaaaaccaggaagtagtgtaaaagtaccatgtaaaagtagtggaagcccatttagaagtaatgcagtaagttgggtaagacaagcaccaggacaaggactagaatgggtaggaggaatattaggagtatttggaagtccaagttatgcacaaaaatttcaaggaagagtaacaataacagcagatgaatcaacaaatacagtacatatggaattaagaggattaagaagtgaagatacagcagtatattattgtgcgagaggaccaacatattattatagttatatggatgtatggggaaaaggaacaacagtaacagtaagtagt

SEQ ID NO: 50783 - RNA, 360 nt, synthetic construct
  misc_feature 1..360: note = derived and/or modified sequence opt6 from anti-influenza_Chain
  source 1..360: mol_type = other RNA
caaatgcaattagtacaaagcggagcagaagtaaaaaaaccaggatcaagcgtaaaagtaagctgtaaagcaagcggaggaacattcagtagttatgcaataagttgggtaagacaagcaccaggacaaggactagaatggatgggaggaatatttggaatgttcggaacagcaaactatgcacaaaaatttcaaggaagagtaacaataacagcagacgaattcacaagtgcagcatatatggaactatcaagcttaggatcagaagatacagcaatgtattactgtgcaagaagctcaggatattacccacaatatttccaagactggggacaaggaacactagtaacagtaagttca

SEQ ID NO: 50784 - RNA, 360 nt, synthetic construct
  misc_feature 1..360: note = derived and/or modified sequence opt6 from anti-influenza_Chain
  source 1..360: mol_type = other RNA
caagtacaattagtacaaagcggagcagaagtaaaaaaaccaggatcatcagtaaaagtaagctgtaaagcaagcggagtaacattctcatactatgcaatgagctgggtaagacaagcaccaggacaaggattagaatggatgggaggaatatcaccaatgttcggaacaacaacatatgcacaaaaatttcaaggaagagtaacaataacagcagacgatagcacaagcacagcatatatggaagtaagaagcttaagatcagaagatacagcagtatattactgtgcaagaagctcaaactattacgatagcgtatacgattactggggacaaggaacactagtaacagtaagctca

SEQ ID NO: 50785 - RNA, 360 nt, synthetic construct
  misc_feature 1..360: note = derived and/or modified sequence opt6 from anti-influenza_Chain
  source 1..360: mol_type = other RNA
gaagtacaattagtagaaacaggagcagaagtaaaaaaaccaggaagtagtgtaaaagtgccatgtaaaagtagtggaagtccatttagatcaaatgcagtaagttgggtaagacaagcaccaggacaaggattagaatgggtaggaggaatattaggagtatttggaagtccaagttatgcacaaaaatttcaaggaagagtaacaataacagcagatgaaagcacaaatacagtacatatggaattaagaggattaagaagtgaagatacagcagtatattattgtgcaagaggaccaacatattattatagttatatggatgtatggggaaaaggaacaacagtaacagtaagtagt

SEQ ID NO: 50786 - RNA, 360 nt, synthetic construct
  misc_feature 1..360: note = derived and/or modified sequence opt6 from anti-influenza_Chain
  source 1..360: mol_type = other RNA
caagtacatttagtacaaagcggagcagaagtaagaaaaccaggagcaagcgtaaaagtaagctgtaaagtaagcggatacacactaaatgaattaagcatacactggttaagacaagcaccaggaagaggactagaatggatgggatcattcgatccagaagacggagaaacaatatatgcacaaaaatttcaaggaagagtaacaatgacaggagacacaagtacagacacagcatatctagaactaaccagcttaagatcagaagatacagcactatattactgtgcaagaggatggggagcagtaacaagtccattcgatttctggggacaaggaacattagtaacagtaagttca

SEQ ID NO: 50787 - RNA, 360 nt, synthetic construct
  misc_feature 1..360: note = derived and/or modified sequence opt6 from anti-influenza_Chain
  source 1..360: mol_type = other RNA
gaagtacaattagtacaaagcggagcagaagtaaaaaaaccaggatcaagcatgaaagtaagctgtaaagcaagcggaagcatattctcaaactatggaataagttgggtaagacaagcaccaggacaaggactagaatggatgggaggaataataccaatattcggagcagcaaactatgcacaaaaatttcaaggaagagtaacaataacagcagacgaaagcacaagcacagtatatatggaagtaagaagcctaagatcagaagatacagcagtatattactgtgcaagaagacaacaattatacaaaggatattaccatcactggggacaaggaacattagtaacagtaagctca

SEQ ID NO: 50788 - RNA, 360 nt, synthetic construct
  misc_feature 1..360: note = derived and/or modified sequence opt6 from anti-influenza_Chain
  source 1..360: mol_type = other RNA
caagtacaattagtacaaagtggagcaggagtaaaaaaaccaggaagtagcatgaaagtaagttgtaaagcaagtggaagtatatttagtaattatggaataagttgggtaagacaagcaccaggacaaggattagaatggatgggaggaataataccaatatttggagcagcaaattatgcacaaaaatttcaaggaagagtaacaataacagcagatgaaagtacaagcacagtatatatggaagtaagaagtctaagaagtgaagatacagcagtatattattgtgcaagaagacaacaactatataaaggatattatcatcactggggtcaaggaacattagtaacagtaagtagt

SEQ ID NO: 50789 - RNA, 360 nt, synthetic construct
  misc_feature 1..360: note = derived and/or modified sequence opt6 from anti-influenza_Chain
  source 1..360: mol_type = other RNA
caagtacaactacaagaatcaggaccaggattagtaaaaccatcagaaacactatcactaacatgcacagtatcaggaggattaataggaacaggatcatattactggggatggataagacaaacaccaggaaaaggaatggaatggataggatcaatatcatactcaggatcaacatactaccacccatcattaaaatcaagagtaacaatatcagacgacacatcaaaaaatcaactattcctaaaactaagatcagtaacagcagcagacacagcacaatactactgcgcaagatacaactggggaataagatacttcgacttctggggaagaggaacactagtaacagtatcatca

SEQ ID NO: 50790 - RNA, 360 nt, synthetic construct
  misc_feature 1..360: note = derived and/or modified sequence opt6 from anti-influenza_Chain
  source 1..360: mol_type = other RNA
caagtacaattagtacaaagcggagcagaagtaagaaaaccaggaagtagtgtaaaagtaagctgtaaagtaagtggaggaataataaggaaatatgcaataaactgggtaagacaagcaccaggacaaggattagaatggatgggaggaataatagcaatatttaatacagcaaattatgcacaaaaatttcaaggaagagtaacaataacagcagatgaaagtacaagtacagtatatatggaattaagtagtctaagaagtgaagatacagcattatattattgtgcaagaggaatgaattattacagtgactatttcgattactggggacaaggaagtttagtaacagtaagccca

SEQ ID NO: 50791 - RNA, 360 nt, synthetic construct
  misc_feature 1..360: note = derived and/or modified sequence opt6 from anti-influenza_Chain
  source 1..360: mol_type = other RNA
caagtacaattagtacaaagcggaggaggagtagtacaaccaggaagaagtttaagattaagctgtgcagcaagcggatttacatttagaagtcatgcaatgcactgggtaagacaagcaccaggaaaaggaccagaatgggtagcattaatatcatatgatgaagtaaataaattctatgcagatagtgtaaaaggaagatttacaataagcagagatgtaagtaaaaatacagtatttttacaaatgaatagtttaagtgcagacgatacagcagtatattattgtgcaagaggacatagtggaagttatagattatttgatttttggggacaaggaacattagtaacagtaagttca

SEQ ID NO: 50792 - RNA, 360 nt, synthetic construct
  misc_feature 1..360: note = derived and/or modified sequence opt6 from anti-influenza_Chain
  source 1..360: mol_type = other RNA
caagtacaattagtagaaagtggaggaggattagtacaaccaggaggaagtttaagattaagttgtgcagcaagtggatttatatttggagattttgcaatacattgggtaaggcaagcaagtggaaaaggattagaatgggtagcaagaataagaagtggattaaatagatttgaaacagcatatgcagcaagtgtagaaggaagattaacaataagtagagatgatagtaaaagtatggcatatttacaaatgaataatgtaaaagcagaagatacagcagtatatttatgtacatatttagtaggagcagtaggatttcaacattggggacaaggaacattagtaacagtaagtagt

SEQ ID NO: 50793 - RNA, 360 nt, synthetic construct
  misc_feature 1..360: note = derived and/or modified sequence opt6 from anti-influenza_Chain
  source 1..360: mol_type = other RNA
caagtacaattagtagaaagtggaggaggagtagtacaaccaggaagaagtttaagattaagctgtgcagcaagcggattcacattctcaagctatggaatatactgggtaagacaagcaccaggaaaaggactagaatgggtagcatttatatcatacgatgaaataaacaaattctatgcagatagcgtaaaaggaagatttacaataagcagagacaatagcaaaaacacagtatttctacaaatgaatagcttaagagatgaagatacagcagtatattactgtgcaaaaccattaagaggaagctatagatatttcgatctatggggaagaggaacagtagtaacagtaagctca

SEQ ID NO: 50794 - RNA, 363 nt, synthetic construct
  misc_feature 1..363: note = derived and/or modified sequence opt6 from anti-influenza_Chain
  source 1..363: mol_type = other RNA
caagtacaactacaagaaagcggaccagatttagtaaaaccaggagcaagtgtaatgataagctgtaaagcaagcggatactcatttacatactattatatgcactgggtaaaacaatcacacggaaaaacactagaatggataggaagaatatatccatataacggagacacaaactataacagaagatttaaagataaagcaatattaacagtagacgaaagctcaagcacagcatatatggaactaagaagtttaacatcagaagacagcgcagtatatttctgtgcaagagacgcaaactatgaaggagactggtattttgacgtatggggacaaggaacaacagtaacagtatcaagc

SEQ ID NO: 50795 - RNA, 363 nt, synthetic construct
  misc_feature 1..363: note = derived and/or modified sequence opt6 from anti-influenza_Chain
  source 1..363: mol_type = other RNA
caagtacaattagtacaatcaggaggaggagtagtacaaccaggaagatcactaagactatcatgcgcagcatcaggattcacatttagctcatacgcaatgcattgggtaagacaagcaccaggaaaaggactagaatgggtagcaataataagctatgacggaaacgatcaatattacacagactcagtaaaaggaagattcacaatatcaagagatagctcaaaagtatacttacaaatgcacagactaagaccagaagacacagcagtatactattgcgcaaaagaatttgaaacatcaggatatttccatggatcattcgattactggggacaaggaatattagtaacagtaagttca

SEQ ID NO: 50796 - RNA, 363 nt, synthetic construct
  misc_feature 1..363: note = derived and/or modified sequence opt6 from anti-influenza_Chain
  source 1..363: mol_type = other RNA
caagtacaagtagtacaaagcggagcagaagtaaaaaaaccaggatcaagcgtaagagtaagctgtcaagcaagcggaggaacattcatgaattatgcaataatatgggtaagaagagcaccaggacaaggactagaatggatgggaggaataataccagtattcccaacaccaaactatgcacaaatgtttcaaggaagagtaacaataagtacagacgaaagcagaagtacaagttttctagaactaacaaatttaagatatgaagatacagcagtatattactgtgcaagaagaatataccatggaggaaactcaggatttgacttttggggacaaggaacattagtaacagtatcaagc

SEQ ID NO: 50797 - RNA, 363 nt, synthetic construct
  misc_feature 1..363: note = derived and/or modified sequence opt6 from anti-influenza_Chain
  source 1..363: mol_type = other RNA
caagtacaattacaagaatcaggaccaggattactaaaaccatcagacacactagcattaacatgcacagtatcaggaggatcaataacatcagactactggtcatggataagacaaccaccaggaagaggactagactggataggattcttctacaacggaggatcaacaaaatacaacccatcactaaaatcaagagtaacaatatcagcagacacatcaaaaaaccaactatcactaaaactaacatcagtaacagcagcagacacaggagtatactactgcgcaagacacgacgcaaaattctcaggatcatactacgtagcatcatggggacaaggaacaagagtaacagtatcatca

SEQ ID NO: 50798 - RNA, 363 nt, synthetic construct
  misc_feature 1..363: note = derived and/or modified sequence opt6 from anti-influenza_Chain
  source 1..363: mol_type = other RNA
caagtacaactacaagaatcaggaccaggactactaaaaccatcagacacactagcactaacatgcacagtatcaggaggatcaataacatcagactactggtcatggataagacaaccaccaggaagaggactagactggataggattcttctacaacggaggatcaacaaaatacaacccatcactaaaatcaagagtaacaatatcagcagacacaagcaaaaaccaactatcattaaaattaacatcagtaacagcagcagacacaggagtatactactgcgcaagacatgacgtaaaattctcaggatcatactacgtagcatcatggggacaaggaacaagagtaacagtatcaagc

SEQ ID NO: 50799 - RNA, 363 nt, synthetic construct
  misc_feature 1..363: note = derived and/or modified sequence opt6 from anti-influenza_Chain
  source 1..363: mol_type = other RNA
caagtacaactacaagaatcaggaccaggattagtaaaaccatcagaaacactatcagtaacatgcaaagtatcaggagactcaatatcatcatactcatggtcatggataagacaaccaccaggaaaaggactagaatgggtaggatacctatactactcaggatcaacaaaatacaacccatcactaaaatcaagaacaacaatatcagtagacacatcaacaaaccaactatcactcaaactatcattcgtaacagcagcagacacagcagtatacttctgcgcaagaacaggatcagaatcaacaacaggatacggaatggacgtatggggacaaggaacaacagtaacagtatcatca

SEQ ID NO: 50800 - RNA, 363 nt, synthetic construct
  misc_feature 1..363: note = derived and/or modified sequence opt6 from anti-influenza_Chain
  source 1..363: mol_type = other RNA
gaagtacaattagtagaaagtggagcagaagtaaaaaaaccaggaagtagtgtaaaagtaagttgtaaagcaagtggaggaccatttagaagttatgcaataagttgggtaagacaagcaccaggacaaggaccagaatggatgggaggaataataccaatatttggaacaacaaaatatgcaccaaaatttcaaggaagagtaacaataacagcagatgattttgcaggaacagtatatatggaattaagtagtttaagaagtgaagatacagcaatgtattattgtgcaaaacatatgggatatcaagtaagagaaacaatggatgtatggggaaaaggaacaacagtaacagtaagtagt

SEQ ID NO: 50801 - RNA, 363 nt, synthetic construct
  misc_feature 1..363: note = derived and/or modified sequence opt6 from anti-influenza_Chain
  source 1..363: mol_type = other RNA
caagtacaattagtacaaagcggagcagaagtaaaaaaaccaggatcaagcgtaaaagtaagctgtaaagcaagcggaggaccattcagaagctatgcaataagctgggtaagacaagcaccaggacaaggaccagaatggatgggaggaataataccaatattcggaacaacaaaatatgcaccaaaatttcaaggaagagtaacaataacagcagacgatttcgcaggaacagtatatatggaattatcaagcttaagaagtgaagatacagcaatgtattactgtgcaaaacacatgggatatcaagtaagagaaacaatggacgtatggggaaaaggaacaacagtaacagtatcaagc

SEQ ID NO: 50802 - RNA, 363 nt, synthetic construct
  misc_feature 1..363: note = derived and/or modified sequence opt6 from anti-influenza_Chain
  source 1..363: mol_type = other RNA
gaagtacaattagtagaaacaggagcagaagtaaaaaaaccaggagcaagtgtaaaagtaagttgtaaagcaagtggatatacatttacaagttattatatgcattgggtaagacaagcaccaggacaaggattagaatggatgggatggataaatccaaatagtggaggaacaaattatgcacaaaaatttcaaggaagagtaacaatgacaagagatacaagtataagtacagcatatatggaactaagtagattaagaagtgatgatacagcagtatattattgtgcaagagaaggaaaatggggaccacaagcagcatttgatatatggggacaaggaacaatggtaacagtaagtagt

SEQ ID NO: 50803 - RNA, 363 nt, synthetic construct
  misc_feature 1..363: note = derived and/or modified sequence opt6 from anti-influenza_Chain
  source 1..363: mol_type = other RNA
gaagtacaattagtagaaagtggagcagaagtaaaaaaaccaggaagtagtgtaaaagtaagttgtaaagcaagtggaggaacatttagtttttatagtatgagttgggtaagacaagcaccaggacaaggattagaatggatgggaggaataataccaatgtttggaacaacaaattatgcgcaaaaatttcaaggaagagtaacaataacagcagtagaaagtacaagtacagcatatatggaagtaagtagtttaagaagtgaagatacagcagtatattattgtgcaagaggagataaaggaatatattattattatatggatgtatggggaaaaggaacaacagtaacagtaagtagt

SEQ ID NO: 50804 - RNA, 363 nt, synthetic construct
  misc_feature 1..363: note = derived and/or modified sequence opt6 from anti-influenza_Chain
  source 1..363: mol_type = other RNA
gaagtacaattagtagaaacaggagcagaagtaaaaaaaccaggaagtagtgtaaaagtaagttgtaaagcaagcggaggaacatttagaacacatgcaataagttgggtaagacaagcaccaggacaaggattagaatggatgggaggaataatagcaatatttggaacagcaaattatgcacaaaaatttcaaggaagaataacaataacagcagatgaaagtacaagtacagcatatatggaattaagtagtttaagaagtgaagatacagcagtatatttttgtgcaagaggaagtggatatcatataagtacaccatttgataattggggacaaggaacattagtaacagtaagtagt

SEQ ID NO: 50805 - RNA, 363 nt, synthetic construct
  misc_feature 1..363: note = derived and/or modified sequence opt6 from anti-influenza_Chain
  source 1..363: mol_type = other RNA
gaagtacaactagtacaatcaggagcagaagtaaaaaaaccaggaagttcagtaaaagtcagttgcaaagcatcaggaggaatatttagatcaaattcaatatcatgggtaagacaagcaccaggacaaggattagaatggatgggaggaatattcgcactatttggaacaacagattacgcacaaaaattccaaggaagagtaacaataacagcagatgaatcgagtacaacagtatacttagaattaagctcactaacaagcgaagacacagcagtatactattgcgcaagaggaagcggatacacaacaagaaattatttcgattactggggacaaggaacactagtaacagtaagttca

SEQ ID NO: 50806 - RNA, 363 nt, synthetic construct
  misc_feature 1..363: note = derived and/or modified sequence opt6 from anti-influenza_Chain
  source 1..363: mol_type = other RNA
gaagtacaactagtagaatcaggagcagaagtaaaaaaaccaggaagttcagtaaaagtatcatgcaaagcatcaggaggaatatttaactcatacgcaatatcatgggtaagacaagcaccaggacaaggattagaatggatgggaggaataatagcaatatttcacacaccaaaatacgcacaaaaattccaaggaagagtaacaataacagcagatgaatcaacaaatacagcatacatggaattaagatcactaaaaagcgaagacacagcattatactattgcgcaagaggaagcacatacgatttctcaagcggactagattactggggacaaggaacactagtaacagtaagctca

SEQ ID NO: 50807 - RNA, 363 nt, synthetic construct
  misc_feature 1..363: note = derived and/or modified sequence opt6 from anti-influenza_Chain
  source 1..363: mol_type = other RNA
caagtacaactagtacaatcaggagcagaagtaaaaaaaccaggaagctcagtaaaagtatcatgcaaaagctcaggaggaaactttaacaattacgcagtatcatgggtaagacaagcaccaggacaaggattagaatggatgggaggaataagcccaatatttggatcaacaaatcacgcacaaaaattccaaggaagagtaacaatatcagcagatatatttacaaatacagcatacatggaattaagctcactaagaagtgatgacacggcaatatactattgcgcaagaggaagaggatactatttctatcacgcaatggatgtatggggacaaggatcaacagtaacagtaagctca

SEQ ID NO: 50808 - RNA, 363 nt, synthetic construct
  misc_feature 1..363: note = derived and/or modified sequence opt6 from anti-influenza_Chain
  source 1..363: mol_type = other RNA
caagtacaattagtacaaagtggagcagaagtaaaaaaaccaggaagtagtgtaaaagtaagttgtaaagcaagtggaggaacatttaataattatgcaataaattgggtaagacaagcaccaggacaaggattagaatggatgggaggaataagtccaatatttggaagtgtaaattatgcacaaaaattacaaggaagagtaacaataacagcagatgtatttacaagtacagcatatatggaattaagtagtttaagaagtgaagatacagcagtatattattgtgcaaaaggaagtggatattattattattatggattagatgtatggggattaggaacaacagtaacagtaagtagt

SEQ ID NO: 50809 - RNA, 363 nt, synthetic construct
  misc_feature 1..363: note = derived and/or modified sequence opt6 from anti-influenza_Chain
  source 1..363: mol_type = other RNA
caagtacaattagtagaaagcggaggaggagtagtacaaccaggaaggagtttaagattaagttgtgcagcaagtggatttacatttacaaattatgcaatgcattgggtaagacaagcaccaggaaaaggattagaatgggtagcagtaataagttttgatgaagataataaaagttatgcagattatgtaaaaggaagatttacaataagtagagataatagtaataatagattatatctacaaatgaatagtttaagagcagaagatacagcagtatattattgtgcaaggggaccagaaggagtatggggaagaagtatagatagttggggacaaggaacattagtaacagtaagtagt

SEQ ID NO: 50810 - RNA, 363 nt, synthetic construct
  misc_feature 1..363: note = derived and/or modified sequence opt6 from anti-influenza_Chain
  source 1..363: mol_type = other RNA
caagtccaattagtacaatcaggaggagacctagtacaaccaggaggatcactaagactatcatgcgcagcatcaggatttacatttagcagatactcaatgaattgggtaagacaagcaccaggaatgggattagaatgggtagcatacataagcgatacatcaagaacaatatattacgcagactcagtaaaaggaagattcacaatatcaagagataacgccaaaaatagcttatacttacaaatgaaatcactaagagacgaagacacagcagtatactattgcgcaagagatccagatacaccattcgtaagagcattcgatagctggggacaaggaacattagtaacagtaagctca

SEQ ID NO: 50811 - RNA, 363 nt, synthetic construct
  misc_feature 1..363: note = derived and/or modified sequence opt6 from anti-influenza_Chain
  source 1..363: mol_type = other RNA
caagtacaattagtagaaagtggaggaggattagtacaaccaggaggaagtttaagattaagttgtgtagcaagtggatttacatttagtagatttagtatgaattgggtaagacaagcaccaggaatgggattagaatgggtaagttatataagtgatacaggaagaacaatatattatgcagatagtgtaaaaggaagatttacaataagtagagataatgataaaaatacattatatttacaaatgaaaagtttaagagatgaagatagtgcattttattattgtgcaagagatccagatacaccatttgtaagagcatttgatagttggggacaaggagtattagtaacagtaagtagt

SEQ ID NO: 50812 - RNA, 363 nt, synthetic construct
  misc_feature 1..363: note = derived and/or modified sequence opt6 from anti-influenza_Chain
  source 1..363: mol_type = other RNA
caagtacaattacaagaaagcggaccagatctagtaaaaccaggagcaagtgtaaaaatgagctgtaaagcaagcggatactcatttacatactatcatatgcactgggtaaaacaaacacacggaaaatcactagaatggataggaagaatatatccatataacggaggaacaaactatagtcaaagatttaaaggaaaagcagtatttacagtagatatgagctcaagcacagcatatatggaactaagaagtttaacatcagaagatagcgcagtatattactgtgcaagagacgcaaactatgaaggagactggtattttgacgtatggggacaaggaacaacagtaacagtatcaagc

SEQ ID NO: 50813 - RNA, 366 nt, synthetic construct
  misc_feature 1..366: note = derived and/or modified sequence opt6 from anti-influenza_Chain
  source 1..366: mol_type = other RNA
caaggacaactagtgcaatcaggagcagaagtaaaaaaaagcggaagctcagtaaaagtatcatgcaaaacatcaggaggaacatttaactcacacgcaatatcatgggtaagacaagcaccaggacaaggattagaatggataggaggaataataccaatgtttggaacaacaaattacgcacaaaaactaaaaggaagaatagcaataacagcagatcaattaccaacaacagcatacttagaattaagctcactaagaagcgaagacacagcagtatactattgcgcaagaggacaaagatactattacgatagagatggaatggacgtatggggacaaggaacaatggtaacagtatcaagt

SEQ ID NO: 50814 - RNA, 366 nt, synthetic construct
  misc_feature 1..366: note = derived and/or modified sequence opt6 from anti-influenza_Chain
  source 1..366: mol_type = other RNA
caagtacacttagtacaaagcggagcagaagtaaaaaaaccaggatcaagcgtaagattaagctgtagcgcaagcggaggaccattctcaggatttgcaataagctggctaagacaagcaccaggtcaaggactagaatggttaggaggaatatcggcagtattcggaacagcaacatatgcacaaaaatttcaaggaagagtaacaataacagcagaccaattcacaagcacaagccatatggatttatcaagattaacatatgacgatacagcagtatattactgtgcaagaagcggaggatatctaccacaaaataactggatagatccatggggacaaggaacactagtaatagtaagctca

SEQ ID NO: 50815 - RNA, 366 nt, synthetic construct
  misc_feature 1..366: note = derived and/or modified sequence opt6 from anti-influenza_Chain
  source 1..366: mol_type = other RNA
caagtacaattagtacaatcaggagcagaagtaaaaaaagcaggaagttcagtaaaagtaagttgtcaaagtagtggagtaacatttagtatgtatgcagtaagttgggtaagacaagcaccaggacaaggattagaatggatgggaggaataataccattatttggaacaacaacatatgcacaaaaatttgaaggaagattaacaataacagcagatacaagtacaaatatggcatatttagaattaagaagtttaagaagtgaagatacagcagtatatttttgtgcaagagcaggaacaacagtaacaagatttaattggtttgatccatggggacaagggacattagtaacagtatcaagt

SEQ ID NO: 50816 - RNA, 366 nt, synthetic construct
  misc_feature 1..366: note = derived and/or modified sequence opt6 from anti-influenza_Chain
  source 1..366: mol_type = other RNA
caagtacaattagtacaaagcggagcagaagtaaaaaaaccaggatcaagcttaaaagtaagctgtaaagcaagcggagtaacattctcaatgtatacaataagctgggtaagacaagcaccaggacaaggactagaatggatgggaggaataataccattattcggaacagcaaattatgaacaaaaatttcaaggaagagtaacaataacagcagacacaagcacaaacacagcatatatggaattatcaagcttaagatcagaagatacagcagtatattactgtgcaagagcagggacaacattaacaagatttaactggttcgatccatggggacaaggaacactagtaacagtaagttca

SEQ ID NO: 50817 - RNA, 366 nt, synthetic construct
  misc_feature 1..366: note = derived and/or modified sequence opt6 from anti-influenza_Chain
  source 1..366: mol_type = other RNA
atggcagacaacatgacaacaacacaaatagaatggagaatgaaaaaaatggcaataggatcaagcacacactcaagctcggtattaatgaaagacatacaatcacaattcgaacaactaaaactaagatgggaaagctacccaaacttagtaaaatcaacagactaccaccaaaaaagagaaacaataagactagcaacagaagaactatacctactaagcaaaagaatagacgacagcatactattccacaaaacagtaatagcaaactcatcaataatagcagacatgatagtaagcctaagcctactagaaacactatacgaaatgaaagacgtagtagaagtatacagcagacaatgccta

SEQ ID NO: 50818 - RNA, 366 nt, synthetic construct
  misc_feature 1..366: note = derived and/or modified sequence opt6 from anti-influenza_Chain
  source 1..366: mol_type = other RNA
gaagtacaattagtacaaagtggaggaggactagtacaaccaggaggaagtttaagattagcatgtgtagtaagcggatttacagtaacaagtaattatataacatgggtaagacaagcaccaggaaaaggattagaatgggtaagtgtaatatatagtcatggaagagcatattatagtgcaagtgtaaatggaagatttacaataagtagacatacaagtaaaaatacagtatatttagaaatgaatagtttaagaccagaagatacagcagtatattattgtgcaggaggaggattagtaggaggatatgatgaatatttttttgattattggggacaaggaacattagcaacagtaagtagt

SEQ ID NO: 50819 - RNA, 366 nt, synthetic construct
  misc_feature 1..366: note = derived and/or modified sequence opt6 from anti-influenza_Chain
  source 1..366: mol_type = other RNA
caagtacaattagtacaatcaggagcagaagtaaaaaaaccaggagcatcagtaaaagtatcatgtaaagcatcaggatacacattcacaggatattacatgcactgggtaagacaagcaccaggacaaggactagaatggatgggatggataaatccaaattcaggagacacaaactacgcacaaaaatttcaaggaagagtaacaatgacaagagacacatcaataacaacagcatatatggaactatcatcactaagatcagacgacacagcagtatattactgtgcaagagactcaccatattcatcatcatggtcatttttcgactactggggacaaggaccattagtaacagtatcatca

SEQ ID NO: 50820 - RNA, 366 nt, synthetic construct
  misc_feature 1..366: note = derived and/or modified sequence opt6 from anti-influenza_Chain
  source 1..366: mol_type = other RNA
gaagtacaattagtagaaagtggaggaggattagtacaaccaggaggaagtttaagattaagttgtgcagcaagtggatttatatttagaaattattggatgagttgggtaagacaagcaccaggaaaaggattagaatgggtagcaaatataaaacaagatggaagagaaaaatattatgtagatagtttaagaggaagagtaaatataagtagagataatgcagaaaatagtttatatttacatatgaatagtttaagagtagaagatacagcagtatatttttgtgcaagagcaagaatggtagtagtaacaggagatggatttgatgtatggggacatggaacaatggtaacagtaagtagt

SEQ ID NO: 50821 - RNA, 366 nt, synthetic construct
  misc_feature 1..366: note = derived and/or modified sequence opt6 from anti-influenza_Chain
  source 1..366: mol_type = other RNA
gaagtacaattattagaaagtggaggaggattagtacaaccaggaggaagtctaagattaagctgtgcagcaagcggattcgcattctcaagctatggaatgagttgggtaagacaagcaccaggaaaaggactagaatgggtaagcgcattctcaggatcaggaacaagtacatattatgcagatagtgtaaaaggaagatttacaataagtagagataaaagtaaaaatacactatatttacaaatgaatagtttaagagcagaagatacagcaatatattactgtgcaaaaccaccaggaccatacatagtagtagcaggactatttgaaaattggggaagaggaacattagtaacagtatca

SEQ ID NO: 50822 - RNA, 366 nt, synthetic construct
  misc_feature 1..366: note = derived and/or modified sequence opt6 from anti-influenza_Chain
  source 1..366: mol_type = other RNA
gaagtacaattagtagaaagtggaggaggagtagtacaaccaggaagaagtttaagattaagttgtgcagcatcaggatttagttttagcaattatgcaatgcattgggtaagacaagcaccaggaaaaggattagaatgggtagcattaataagttttgatggaagtgataaatattatgcagatagtgtaaaaggaagatttacaatgagtagagataatagtaaaaatacattatatttacaaatgaatagtttaagagcagaagatacagcagtatattattgtgcaagagatgaaccatattgtggaggagattgttttgcatttgatgtatggggacaaggaacaatggtaacagtaagt

SEQ ID NO: 50823 - RNA, 366 nt, synthetic construct
  misc_feature 1..366: note = derived and/or modified sequence opt6 from anti-influenza_Chain
  source 1..366: mol_type = other RNA
caagtacaactacaacaaagcggaccaggattagtaaaaccaagccaaacattaagcctaacatgtacagtaagcggaggaccggtatcaggaggaggatatagctggaactggataagacaaagaccaggacaaggactagaatgggtaggatttatgtttcactcaggatcaccaagatacaatccaacactaaaaagtagaataacaatatcagtagatacaagcaaaaatctagtatcattaaaattaagcagtgtaacagcagcagacacagcagtatacttttgcgcaagagtaggacaaatggataaatattacgcaatggatgtatggggacaaggaacaacagtaacagtaagctca

SEQ ID NO: 50824 - RNA, 366 nt, synthetic construct
  misc_feature 1..366: note = derived and/or modified sequence opt6 from anti-influenza_Chain
  source 1..366: mol_type = other RNA
caagtacaattagtacaaagcggaggaggattagtaaaaccaggaggaagtttaagattaagttgtgcagcaagtggatttacatttagtagttatagtatgaattgggtaagacaagcaccaggaaaaggactagaatgggtaagtagtataagtagtagtagtagttatatatattatgtagatagtgtaaaaggaagatttacaataagtagagacaatgcaaaaaatagcttatatttacaaatgaatagtttaagagcagaagatacagcagtatattattgtgcaagaggaggaggaagttatggagcatatgaaggatttgattattggggacaaggaacattagtaacagtaagtagt

SEQ ID NO: 50825 - RNA, 366 nt, synthetic construct
  misc_feature 1..366: note = derived and/or modified sequence opt6 from anti-influenza_Chain
  source 1..366: mol_type = other RNA
caagtacaattagtacaaagcggaggaggagtagtacaaccaggaagaagcctaagattaagctgtgcagcaagcggattcaatttctcaagctatggaatgcactgggtaagacaagcaccaggaaaaggactagaatggttaagcgtaatatggagcggaggatcaaacaaatactatgcagatagcgtaaaaggaagatttacaataagcagagacgatagcaaaaacacagtatatctacaaatgaatagcttaagagatgaagatacagcagtatattactgtgcaagagcacatacagcactaacaagatttagatggctagatccatggggacaaggaatattagtaacagtaagctca

SEQ ID NO: 50826 - RNA, 366 nt, synthetic construct
  misc_feature 1..366: note = derived and/or modified sequence opt6 from anti-influenza_Chain
  source 1..366: mol_type = other RNA
caagtacaattagtacaaagcggaggaggagtagtacaaagaggaagaagtttaagattaagttgtgcagcaagtggatttacatttagaacatatggaatgcattgggtaagacaagcaccaggaaaaggattagaatgtgtagcattaataagttatgatggaacaaataaatattatgcagatagtgtaaaaggaagatttactataagtagagataatagtaaagatacattatatttacaaatgaatagtttaagagcagaagatacgggagtatattattgtgcaagtttagattatgattttagttattattatcatagagatgtatgggggccaggaacaacagtaacagtaagtagt

SEQ ID NO: 50827 - RNA, 366 nt, synthetic construct
  misc_feature 1..366: note = derived and/or modified sequence opt6 from anti-influenza_Chain
  source 1..366: mol_type = other RNA
caagtacaattagtagaaagtggaggagggttagtacaaccaggaggaagtttaagattaagttgtgcagcaagtggatttacatttagtgattattggatggtatgggtaagacaagcaccaggaaaaggattagtatgggtaagtagaataagtagtgatggatcaacaacaagttatgcagatagtgtaaaaggaccatttacaataagcagagataatgcaaaaaatacattatatttacaaatgaatagtttaagagcagaagatacagcagtatattattgtgcaagagtagcaacaccatattattatgaaagcggatttgattattggggacaaggagcattagtaacagtaagtagt

SEQ ID NO: 50828 - RNA, 369 nt, synthetic construct
  misc_feature 1..369: note = derived and/or modified sequence opt6 from anti-influenza_Chain
  source 1..369: mol_type = other RNA
caattccaactagtacaatcaggaccagaagtaaaaaaaccaggaacatcagtaaaagtatcatgcaaagcatcaggatacacatcaacaacatacggaatatcatgggtaagacaagtaccaggacaaggcctagaatggatgggatggataaacccatacaacggaaacccacactacggacaaaaattccaaggaagagtaacactaacaagagacacatcaacaaacacagcatacctagaaatactatcactaagatcagacgacacagcagtatactactgcgcaagagacggatggggacaacaactagtaccatactacttcgactactggggacaaggaacactagtaacagtatcatca

SEQ ID NO: 50829 - RNA, 369 nt, synthetic construct
  misc_feature 1..369: note = derived and/or modified sequence opt6 from anti-influenza_Chain
  source 1..369: mol_type = other RNA
caagtacaattagcacaaagcggagcagaagtaaaaagaccaggaagtagtgtaaaagtaagttgtacagcaagcggaggaatatttagaaaaaatgcaataagttgggtaagacaagcaccaggacaaggattagaatggatgggaggaataatagcagtatttaatacagcaaattatgcacaaaaatttcaaggaagagtaaaaataacagcagatgaaagcggaaatacagcatatatggaattaagtagtttaagaagtgatgatacagcagtatattattgtgcaagtcatccaaaatatttttatggaagtggaagttatccagatttttggggacaaggaacattagtaacagtaagtagt

SEQ ID NO: 50830 - RNA, 369 nt, synthetic construct
  misc_feature 1..369: note = derived and/or modified sequence opt6 from anti-influenza_Chain
  source 1..369: mol_type = other RNA
caagtacaattacaagaaagcggaccaggattagtaaaaccaagcgaaacactaagcctaacatgcacagtaagcagaggatcaataggacactacttctggagctggataagacaaccaccaggaaaaggactagaatggataggatacatatcatactcaggatcaacaaaatacaacccatcactaagaagcagagtaacaatatcagtagacacaagcaaaaaccaattctcactaaacctaaactcagtaacagcaacagacacagcactatactactgcgcaagagaagactacgacatactaacaggagcaggaccaggaatggaagtatggggacaaggaacaacagtaacagtatcaagc

SEQ ID NO: 50831 - RNA, 369 nt, synthetic construct
  misc_feature 1..369: note = derived and/or modified sequence opt6 from anti-influenza_Chain
  source 1..369: mol_type = other RNA
caagtacaactacaagaatcaggaccaggactagtaaaaccatcagaaacactatcattaacatgcacagtatcaggagcatcaataaactcacactactggtcatggataagacaaccaccaggaaaaggactagaatggataggatacgtatactacagcggaagcacaacatacaacccatcactaaaatcacgagtaacactatcagtagacacatcaaaaaaccaattctcactaaacctatcatcagtaacagcagcagacacagcattctactactgcgcaagacacccatacgacgtactaacaggatcaggagactggttcgacccatggggacaaggaacactagtaacagtatcatca

SEQ ID NO: 50832 - RNA, 369 nt, synthetic construct
  misc_feature 1..369: note = derived and/or modified sequence opt6 from anti-influenza_Chain
  source 1..369: mol_type = other RNA
caagtacaactagtacaatcaggagcagaagtaaaaagaccaggaagctcagtaaaagtatcatgcacagcatcaggaggaatatttagaaaaaacgcaatatcatgggtaagacaagcaccaggacaaggattagaatggatgggaggaataatagcagtatttaacacagcaaattacgcacaaaaattccaaaacagagtaaaaataacagcagatgaatcaggaaatacagcatacatggaattaagctcactaacaagtgatgacacagcagtatactattgcgcaagtcatccaaaatacttttacggaagcggaagctatccagatttctggggacaaggaacattagtaacagtaagcagt

SEQ ID NO: 50833 - RNA, 369 nt, synthetic construct
  misc_feature 1..369: note = derived and/or modified sequence opt6 from anti-influenza_Chain
  source 1..369: mol_type = other RNA
gaagtacaattagtagaaagtggagcagaagtaaaaaaaccaggaagtagcgtaaaagtaagttgtaaagcaagtggaggaacatttagaagttatgcagtaagttgggtaagacaagcaccaggacaaggattagaatggatgggaggaataatagcaatatttggaacaacaaattatgcacaaaaatttcaagatagagtaacaataacagcagatgatctaccaagtacagcatatatggaattaacaagtttaagaagtgaagatacagcagtatatttttgtgtaagaggaagaggatattatttaggaggagattatggaagtttagatagttggggacaaggaacattagtaacagtaagt

SEQ ID NO: 50834 - RNA, 369 nt, synthetic construct
  misc_feature 1..369: note = derived and/or modified sequence opt6 from anti-influenza_Chain
  source 1..369: mol_type = other RNA
gaagtacaattagtagaaagtggaggaggactagtacaaccaggaagaagtttaagattaagttgtgtaggaagtggatttaattttgatggatatgcaatgcaatgggtaagacaagtaccaggaaaaggattagaatgggtaagtggaataagttggcatagtgatagtacaggatatgcagatagtgtgagaggaagatttacaataagtagagataatgcaaaaaatagtctatatttacaaatggatagtttaagaccagaagatacagcattttattattgtggaaaaagtataggacatgtaggaggaagttatagacatccaatagattattgggggcaaggaacattagtaacagtaagt

SEQ ID NO: 50835 - RNA, 369 nt, synthetic construct
  misc_feature 1..369: note = derived and/or modified sequence opt6 from anti-influenza_Chain
  source 1..369: mol_type = other RNA
caagtacaattacaagcatcaggaccaggattagtaaaaccatcagaaacactatcactaacatgcacagtatcaggagactcaataacatcaggagcatactactggacatggataagacaacacccaggaaaaggactagaatggataggatacatatactactcaggaaacacatactataacccatcactaaaatcaagagtaacaatatcactagacacaagcaaaaaccaattctcactaaaagtaaactcagtaacagcagcagacacagcagtatactactgcgcaagagcagcatcaacatcagtactaggatacggaatggacgtatggggacaaggaacaacagtaacagtatcatca

SEQ ID NO: 50836 - RNA, 369 nt, synthetic construct
  misc_feature 1..369: note = derived and/or modified sequence opt6 from anti-influenza_Chain
  source 1..369: mol_type = other RNA
caagtacaattagtacaaagtggagcagaagtaaaaaaaccaggaagtagtgtaagagtaagttgtaaagcaagtggaagtatatttagaaattatgcaatgagttgggtaagacaagcaccaggacaaggattagaatggatgggaggaataatagcaatatttggaacaccaaaatatgcacaaaaatttcaaggaagagtaacaataacagcagatgaaagtacaagtacagtatatatggaactaagtggattaagaagtgaagatacagcaatgtattattgtgcaagaataccacattataattttggaagtggaagttattttgattattggggacaaggaacattagtaacagtaagtagt

SEQ ID NO: 50837 - RNA, 369 nt, synthetic construct
  misc_feature 1..369: note = derived and/or modified sequence opt6 from anti-influenza_Chain
  source 1..369: mol_type = other RNA
caactacaattacaagaatcaggaccaagactagtaaaaccatccgaaacactatcactaacatgctcagtatcaggagtatcaatatcatcatcaaactactactggggatggataagacaaccaccaggaaaaggactagaatggataggaacaatataccactcaggatcaacatactacaacccatcactaaaatcaagactaataatatcagtagacacatcaaaaaaccaattctacctacaactaacatcactaacagcagcagactcagcagtatactactgcgcaacaggaggaggattcggatggtcacaaacatacttcggatactggggacaaggaacactagtaacagcatcatca

SEQ ID NO: 50838 - RNA, 369 nt, synthetic construct
  misc_feature 1..369: note = derived and/or modified sequence opt6 from anti-influenza_Chain
  source 1..369: mol_type = other RNA
gaagtacaattacaacaaagcggaccagaattagtaaaaccaggagcaagcgtaaaaatgagctgtaaagcaagtggatacacattcacatcatttataatgtactgggtaaaacaaaaaccaggacaaggactagaatggctaggatatatagatccatataacgatggaacgaaatataacgaaaaatttgaaggaaaagcaacactaacatcagacaaaagttcaagtacagcatatatggaactaagcagcttaacatcagaagatagcgcagtatattactgtgcaaaaagaggaaactatggaaatggatttgcatattggggacaaggaacattagtaacagtatcagcagcaaaaacaagc

SEQ ID NO: 50839 - RNA, 369 nt, synthetic construct
  misc_feature 1..369: note = derived and/or modified sequence opt6 from anti-influenza_Chain
  source 1..369: mol_type = other RNA
caagtacaattattagaaagtggaggagatgtagtacaaccaggaacaagtttaagattaagctgtgcagcaagtggatttagtttatggacaagtggaatgcattgggtaagacaagcaccaggaaaaggattagaatgggtagcagtaatgagttatgatgaaacaaaaaaatattatgcagatagtgtaagaggaagatttagtataagtagagataatagtagaaatacattatatttacaaatgaatagcctaagagtagaagatacagcagtatatttctgtgcaaaaccaagattagattatttagattattttcatgcagcagattcatggggacaaggaacattagtaagtgtaagtagt

SEQ ID NO: 50840 - RNA, 369 nt, synthetic construct
  misc_feature 1..369: note = derived and/or modified sequence opt6 from anti-influenza_Chain
  source 1..369: mol_type = other RNA
caagtacaattagtagaatcaggagcagaagtaagaaaaccaggagaatcactaagaatatcatgcaaagcacatggagatagctttacatcatactggataggatgggtaagacaactaccaggaaaaggactagaatggatggcagtaatatacccaagagatagcgaaacaaaattctcaccagcattccatggacaagtatcaatatcagtagataaatcaacatcaacagtacacttacaatggaactcactaaaagcatctgacacagcagtatactattgcgcaagatcaccaggatactcaggatatctatatggatggttcgatccatggggacaaggaacaccagtaacagtaagctca

SEQ ID NO: 50841 - RNA, 369 nt, synthetic construct
  misc_feature 1..369: note = derived and/or modified sequence opt6 from anti-influenza_Chain
  source 1..369: mol_type = other RNA
caagtacaattagtagaatcaggaccaggattagtaaaaccatcagaaacactatcactaacatgcacagtatcaggagatagcgtaataaatagcgcatactattgggattggataagacaaccaccaggaaaaggattagaatgggtaggaagcgtatactatagtggaataacatactataacccaagtttaaaaagcagagtaacaataagcgtagatacaagcaaaaaccaattctcactaagactatcatacgtaacagcagcagatacagcactatattactgtgcaagaagaggaggaggatggcaatactattacggaatggatgtatggggacaaggaacaacagtaacagtaagctca

SEQ ID NO: 50842 - RNA, 369 nt, synthetic construct
  misc_feature 1..369: note = derived and/or modified sequence opt6 from anti-influenza_Chain
  source 1..369: mol_type = other RNA
caagtacaattagtacaaagcggagcagaagtaaaaaaaccaggagcaagcgtaaaagtaagttgtaaagcaagcggatacatattcacaggatattacatacactgggtaagacaagcaccaggacaaggactagaatggatgggaagaatagatccaaatggatcaggaacaacatatgcacaaaaatttcaaggaagagtaacattaacaatggacacaagtataacaacagcatatatggaactatcaagattaagatttgacgatacagcaatatattactgtgcaagatgggattggaatttcgatttatatctaggatggtttgacccatggggacaaggaacaccagtaacagtagcaagc

SEQ ID NO: 50843 - RNA, 369 nt, synthetic construct
  misc_feature 1..369: note = derived and/or modified sequence opt6 from anti-influenza_Chain
  source 1..369: mol_type = other RNA
gaagtacaattagtacaaagcggagcagaagtaaaaaaaccaggagcaagtgtaaaagtaagctgtaaagcaagcggatatatattcacaggatattacatacactgggtaagacaagcaccaggacaaggactagaatggatgggaagaatagatccaaatggagcaggaacaacatatgcacaaaaatttcaaggaagagtaacattaacaatggacacaagtataacaacagcatatatggaattatcaagattaagatttgacgatacagcaatatattactgtgcaagatgggattggaatttcgatttatatctaggatggtttgacccatggggacaaggaacaccagtaacagtagcaagt

SEQ ID NO: 50844 - RNA, 369 nt, synthetic construct
  misc_feature 1..369: note = derived and/or modified sequence opt6 from anti-influenza_Chain
  source 1..369: mol_type = other RNA
caagtacaattagtacaaagcggagcagaagtaaaaaaaccaggagcaagtgtaaaagtaagttgtaaagcaagtggatatacatttaatgcacatcatatgcattgggtaagacaagcaccaggacaaggactaggatggatgggatggatagatccaaataatgatggaacaatatatgcacaaaaatttcaaggaagagtaacattaacaatggatacaagtatacatacagcatatatggaattatcaggattaagatatgatgatacagcaatatattattgtgtaagatgggcatggaattttgatttttttttaggatggtttgatccatggggacaaggaacattagtaacagtagcaagt

SEQ ID NO: 50845 - RNA, 369 nt, synthetic construct
  misc_feature 1..369: note = derived and/or modified sequence opt6 from anti-influenza_Chain
  source 1..369: mol_type = other RNA
gaagtacaactagtacaatcaggagcagaagtaaaaaaaccaggagaatcattaaaaatatcatgcaaagtatcaggatatagctttacatcacaatggataggatgggtaagacaaatgccaggaaaaggattagaatggataggaatgatgtacccaggagatagcgatacaatatactcaccatcattccaaggacaagtaacaatatcagcagataactcaatatcaacagcatacttacaatggagctcactaaaagcatcagacacagcaatatactattgcgcaagcggaccaggatactcaggatatcactatggatggttcgatacatggggacaaggaacattagtaacagtaagctca

SEQ ID NO: 50846 - RNA, 369 nt, synthetic construct
  misc_feature 1..369: note = derived and/or modified sequence opt6 from anti-influenza_Chain
  source 1..369: mol_type = other RNA
gaagtacaattagtacaaagtggagcagaagtaaaaaaaccgggagaaagtttaaaaataagttgtaaagtaagtggatatagttttacaagtcaatggataggatgggtaagacaaatgccaggaaaaggattagaatggataggaatgatgtatccaggagatgcagatgcaatatatagtccaagttttcaaggacaagtaacaataagtgcagataatagtataagtacagcatatttacaatggtcaagtttaaaagcaagtgatacagcaatatattattgtgcaagtggaccaggatatagtggatatcattatggatggtttgatacatggggacaaggaacattagtaacagtaagtagt

SEQ ID NO: 50847 - RNA, 369 nt, synthetic construct
  misc_feature 1..369: note = derived and/or modified sequence opt6 from anti-influenza_Chain
  source 1..369: mol_type = other RNA
gaagtacaactagtacaatcaggagcagaagtaaaaaaaccaggagaatcactaaaaatatcatgcaaagtatcaggatatagctttacatcacaatggataggatgggtaagacaaatgccaggaaaaggattagaatggataggaatgatgtacccaggagaaagcgaaacaatatactcaccatcattccaaggacaagtaacaatatcagcagataactcaatatcaacagcatacttacaatggagctcactaaaagcatcagacacagcaatatactattgcgcaagcggaccaggatactcaggatatcactatggatggttcgatacatggggacaaggaacactagtaacagtaagctca

SEQ ID NO: 50848 - RNA, 369 nt, synthetic construct
  misc_feature 1..369: note = derived and/or modified sequence opt6 from anti-influenza_Chain
  source 1..369: mol_type = other RNA
gaagtgcaattagtacaaagtggagcagaagtaaaaaaaccaggagaaagtttaaaaataagttgtaaagtaagtggatatagttttacaagtcaatggataggatgggtaagacaaatgccaggaaaagggttagaatggataggaatgatgtatccaggagatgcagatacaatatatagcccaagctttcaaggacaagtaacaataagtgcagataatagtataagtacagcatatttacaatggagtagtttaaaagcaagtgatacagcaatatattattgtgcaagtggaccaggatatagcggatatcattatggatggtttgatacatggggacaaggaacattagtaacagtaagtagc

SEQ ID NO: 50849 - RNA, 369 nt, synthetic construct
  misc_feature 1..369: note = derived and/or modified sequence opt6 from anti-influenza_Chain
  source 1..369: mol_type = other RNA
gaagtacaattagtacaatcaggagcagaagtaaaaaaaccaggagaatcactaaaaatatcatgcaaagtatcaggatatagctttacatcacaatggataggatgggtaagacaaatgccaggaaaaggattagaatggataggaatgatgtacccaggatcaagcgatacaatatactcaccatcattccaaggacaagtaacaatatcagcagataactcaatatcaacagcatacctacaatggagctcactaaaagcatcagacacagcaatatactattgcgcaagcggaccaggatactcaggatatcactatggatggttcgatacatggggacaaggaacactagtaacagtaagctca

SEQ ID NO: 50850 - RNA, 369 nt, synthetic construct
  misc_feature 1..369: note = derived and/or modified sequence opt6 from anti-influenza_Chain
  source 1..369: mol_type = other RNA
gaagtacaattagtacaaagtggagcagaagtaaaaaaaccaggagaaagtttaaaaataagctgtaaagtaagtggatatagctttacaagtcaatggataggatgggtaagacaaatgccaggaaaaggattagaatggataggaatgatgtatccaggagatagtgatgcaatatatagtccaagttttcaaggacaagtaacaataagtgcagataatagtataagtacagcatatttacaatggagtagtttaaaagcaagtgatacagcaatatattattgtgcaagtggaccaggatatagtggatatcattatggatggtttgatacatggggacaaggaacattagtaacagtaagtagt

SEQ ID NO: 50851 - RNA, 369 nt, synthetic construct
  misc_feature 1..369: note = derived and/or modified sequence opt6 from anti-influenza_Chain
  source 1..369: mol_type = other RNA
gaagtacaattagtacaaagtggagcagaagtaaaaaaaccaggagaaagtctaaaaataagttgtaaagtaagtggatatagttttacaagtcaatggataggatgggtaagacaaatgccaggaaaaggattagaatggataggaatgatgtatccaggagatacagatacaatatatagtccaagttttcaaggacaagtaacaataagtgcagataatagcataagtacagcatatttacaatggagtagtttaaaagcaagtgatacagcaatatattattgtgcaagtggaccaggatatagtggatatcattatggatggtttgatacatggggacaaggaacattagtaacagtaagtagt

SEQ ID NO: 50852 - RNA, 369 nt, synthetic construct
  misc_feature 1..369: note = derived and/or modified sequence opt6 from anti-influenza_Chain
  source 1..369: mol_type = other RNA
gaagtacaactagtacaatcaggagcagaagtaaaaaaaccaggagaatcattaaaaatatcatgcaaagtatcaggatatagctttacatcacaatggataggatgggtaagacaaatgccaggaaaaggattagaatggataggaatgatgtacccaggagaaagtgatacaatatactcaccatcattccaaggacaagtaacaatatcagcagataactcaatatcaacagcatacctacaatggagctcactaaaagcaagtgacacagcaatatactattgcgcaagcggaccaggatactcaggatatcactatggatggttcgatacatggggacaaggaacactagtaacagtaagctca

SEQ ID NO: 50853 - RNA, 372 nt, synthetic construct
  misc_feature 1..372: note = derived and/or modified sequence opt6 from anti-influenza_Chain
  source 1..372: mol_type = other RNA
caagtacaattagtacaaagcggagcagaagtaaaaaaaccaggatcaagcgtaaaagtaagctgtaaagcaagcggaggaatattcataagtcaagcaataagttgggtaagacaagcaccaggacaaggactagaatggatgggaggaataataccaatgttcggagcaacaaactatgcacaaaaatttcaaggaagagtaacaataacagcagacaaaagcacaaacacagtatatatggaactatcaagcctaacatcagaagatacagcagtatattactgtgcaagactaggaagcggaagttatcacaatggaccaaactggttcgatccatggggacaaggaacactagtaacagtaagttca

SEQ ID NO: 50854 - RNA, 372 nt, synthetic construct
  misc_feature 1..372: note = derived and/or modified sequence opt6 from anti-influenza_Chain
  source 1..372: mol_type = other RNA
caagtacaattacaagaaagcggaccaggattagtaaaaccaagcgaaacattaagcctaaactgtgcagtaagtggaggatcaatatcaaactattactggagctggataagacaaccaccaggaaaaggactagaatggataggatatatatcatacaatggaagaccaaaatacaatccatcactaacaagcagagtaacaatatcagtagatacatcaaaagatcaatttagcttagaattaagatcagtaacagcagcagacacagcactatactattgcgcaagagaaacaagattcggagaattactatcaccatatgacgcattcgaaatatggggacaaggaacaatggtaacagtaagttca

SEQ ID NO: 50855 - RNA, 372 nt, synthetic construct
  misc_feature 1..372: note = derived and/or modified sequence opt6 from anti-influenza_Chain
  source 1..372: mol_type = other RNA
caagtacaattacaagaaagcggaccaggattagtaaaaccaagcgaaacactatcattaacatgtacagtaagtggaggatcagtatcaagcgaaacatattactggagctggataagacaaccaccaggaaaaggactagaatggataggatatatatattacataggaaatacagattacagaccatcactaaaaagtagagtaacaatatcactagatacaagcaaaaatcaatttagcttaaaattaagctcagtaacagcagcagacacagcagtatactattgcgcaagaggagcatattacgatagctcaggatatccagcattctatatatggggacaaggaacaatggtaacagtaagctca

SEQ ID NO: 50856 - RNA, 372 nt, synthetic construct
  misc_feature 1..372: note = derived and/or modified sequence opt6 from anti-influenza_Chain
  source 1..372: mol_type = other RNA
caagtacaattacaagaatcaggaccaggactagtaaaaccatcagaaacactatcactaacatgcgcagtatcaggagtatcaatatcaaacatagacttctactggggatggataagacaaccaccaggaaaaggactagaatggataggaaacatatactacacaggaataacattctacaacccatcactatcatcaagagtagcaatatcaatagacacatcaaaaaaccaattctcactaacactaacatcagtaacagcagcagacacagcaatgtactactgcgcaagacactacggagactcagaagcaataaacgacgcattcgacatatggggacaaggaacaatgttaacagtatcatca

SEQ ID NO: 50857 - RNA, 372 nt, synthetic construct
  misc_feature 1..372: note = derived and/or modified sequence opt6 from anti-influenza_Chain
  source 1..372: mol_type = other RNA
caagtacaattagtagaaagcggagcagaagtaaaaaaatttggagcaagcgtaaaagtaagctgtaaagcaagtggatacacactaatagactattacatgcactgggtaagagtagcaccaggacaaggactagaatggatgggatggataaatccaataaacggaggaacaaattatgcacaaaaatttcaaggaagagtaacaatgacaagagacacaagcataaacacagcatatatggatctatcaagtttaagatcagacgatacagcaatgtattactgtacaagaggaagaccaataggaagaaactgggaaccaagagataaagattactggggacaaggaacaccagtaacagtaagttca

SEQ ID NO: 50858 - RNA, 372 nt, synthetic construct
  misc_feature 1..372: note = derived and/or modified sequence opt6 from anti-influenza_Chain
  source 1..372: mol_type = other RNA
caagtacaactagtacaaagcggagcagaagtaaaaaaaccaggatcaagcgtaacagtaagttgtaaaacaagcggacacacattcataagctatgcaataagctggctaagacaagcaccaggacaaggactagaatggatgggaggaatagtaccaatattcggaacagtaaactatacacaaaaatttcaaggaagattaacaataacagcagacgaaagtacaagcacagcatatatggatctatcaagattaacatttgaagatacagcaatatatttctgtgcaagagaagcaggatatcactcaagctttagcggagtatatttcgattactggggacaaggaacactattaacagtaagctca

SEQ ID NO: 50859 - RNA, 372 nt, synthetic construct
  misc_feature 1..372: note = derived and/or modified sequence opt6 from anti-influenza_Chain
  source 1..372: mol_type = other RNA
gaagtacaattacaacaaagcggaccagaattagtaaaaccaggagcaagcgtaaaaataagctgtaaagcaagcggatacacattcacagactataacatgcactgggtaaaacaatcactaggaaaatcactagaatggataggatatatatatccaaataacggaggaacaggatataaccaaaaatttgaatcaaaagcaacactaacagtagacaatagctcaagcacagcatatatggaactaagaacactaacatcagaagacagcgcagtatattactgtgtaagaagcggagcatattactttaactatctagtaccatatttcgattactggggacaaggaacaacattaacagtaagctca

SEQ ID NO: 50860 - RNA, 372 nt, synthetic construct
  misc_feature 1..372: note = derived and/or modified sequence opt6 from anti-influenza_Chain
  source 1..372: mol_type = other RNA
gaagtacaattacaacaaagcggaccagaattagtaaaaccaggagcaagcgtaaaaataagctgtaaagcaagcggatacacattcacaggatataacatgcactgggtaaaacaatcacacggaaaatcactagaatggataggaaaaatatatccaaataacggagtaacaggatataaccaagaatttagatcaaaagcaacactaacagtagacaatagctcaagcacagcatatatggaactaagaagtttaacatcagaagatagcgcaatatatttctgtgtaagaagcggagcatattacgtaaactatctagtaccatatttcgattactggggacaaggaacaacattaacagtaagctca

SEQ ID NO: 50861 - RNA, 375 nt, synthetic construct
  misc_feature 1..375: note = derived and/or modified sequence opt6 from anti-influenza_Chain
  source 1..375: mol_type = other RNA
caagtacaattagtacaatcaggagcagaagtaaaaaaaccaggaagctcagtaaaagtatcatgtaaagcatcaggagtaacatcaagtaattacccaataacatgggtaagacaagcaccaggacaaggattagaatggatgggaggagtattaccactatttggagtaacaaattatgcacaaaaattccaaggaagagtaacaatatcagcagataaatcaacaaacacagcatacatggaattaagttcactaagaagcgaagacacagcagtatattattgcgcaagaggaaaaagaccaggatactgtagtggaggagtatgctcaagcgattactggggacaaggaacattagtaacagtaagttca

SEQ ID NO: 50862 - RNA, 375 nt, synthetic construct
  misc_feature 1..375: note = derived and/or modified sequence opt6 from anti-influenza_Chain
  source 1..375: mol_type = other RNA
caagtacaactacaagaatcaggaccaggactagtaaaaccctcacaaacactatcactaacatgcacagtatcaggaggatcaatatcatcaggaacatactactggtcatggataagacaccacccaggaaaaggactagaatggataggatacatataccactcaggatcagcatactacaacccatcactagaatcaagagtaacaatgtcagtagacacatcaaaaaaccaattctcattaaaactatcatcagtaacagcagcagacacagcaatatactactgcgcaagagcagaaaacctactatcaccatacctagcagaaggattcgacccatggggacaaggaacattagtaacagtatcatca

SEQ ID NO: 50863 - RNA, 375 nt, synthetic construct
  misc_feature 1..375: note = derived and/or modified sequence opt6 from anti-influenza_Chain
  source 1..375: mol_type = other RNA
gaagtacaattagtacaaagtggagcagaagtaaaaaaaccaggagaaagtttaaaaataagttgtcaagcaagtggatatagttttacaagtagatggataggatgggtaagacaaatgccaggaaaaggattagaatgggtaggatttatatatccaagtgatagtgatgtaagatatagcccaagttttagaggacaagtaacaataagtgcagataaaagtataagtacagcatatttacaatggagtagtttaaaagcaagtgatacagcaatgtatttttgtgcaagattaggaggaaataaagattatggagattatttatggtattttgatttatggggaagaggagcattagtaacagtaagtagt

SEQ ID NO: 50864 - RNA, 375 nt, synthetic construct
  misc_feature 1..375: note = derived and/or modified sequence opt6 from anti-influenza_Chain
  source 1..375: mol_type = other RNA
caagtacaattggtagaaagtggaggaggagtagtacaaccaggaagaagtttaagattaagttgtgcagcaagtggatttacatttagtagttatggaatgcattgggtaagacaagcaccaggaaaaggattagaatgggtagcagtaatatggtatgatggagataataaatattatggagatagcgtaaaaggaagatttacaataagtagagataatagcaaaaatacattatttttacaaatgaatagtttaagagcagaagatacagcagtatattattgtgcaaaagatacagcagatcatggagattatgtagatttaggattttttgatgcatggggacaaggaacattagtaacagtaagtagt

SEQ ID NO: 50865 - RNA, 375 nt, synthetic construct
  misc_feature 1..375: note = derived and/or modified sequence opt6 from anti-influenza_Chain
  source 1..375: mol_type = other RNA
gaagtacaattagtacaatcaggagcagaactaaaaatgccaggagaatcactaaaaatatcatgcaaagcatcaggatatacatttacaaattactggataggatgggtaagacaaacaccaggaaaaggactagaatggatgggaataatattcccaccagatagccaaacatcatactcaccatcattccaaggacaagtaacattctcagtagataactcgatatcagtagcatacatacaatggagctcactaaaagcatcagacacagcaatatactattgcgcaagatcaggaatattcgattggtcagcaccattagtagaagcattcgatatatggggacaaggaacagtagtaacagtaagctca

SEQ ID NO: 50866 - RNA, 375 nt, synthetic construct
  misc_feature 1..375: note = derived and/or modified sequence opt6 from anti-influenza_Chain
  source 1..375: mol_type = other RNA
gaagtacaattagtacaaagtggagcagaagtaaaaaaaccaggagaaagtttaaaaataagttgtaaaggaagtggatatagttttagtgattattggataggatgggtaagacaaatgccaggagaaggattagaatggatgggaataatatatccagcaagttcagaaataagatatagtccaagttttcaaggattagtaacaataagtgcagataaaagtataaatacagcatcattacaatggtcaagtttaaaagcaagtgatacagcaatatattattgtgcaagacatgcaagttgtagtgcaagatcatgttattggggaccagtagattattggggacaaggaacattagtaacagtatcaagt

SEQ ID NO: 50867 - RNA, 375 nt, synthetic construct
  misc_feature 1..375: note = derived and/or modified sequence opt6 from anti-influenza_Chain
  source 1..375: mol_type = other RNA
caagtacaattagtagaatcaggaggaggagtagtacaaccaggaagatcactaagattatcatgtgcagcatcagaaataacatttataacatatgcaatgcactgggtaagacaagcaccaggaaaaggattagaatgggtagcattaatatcagatgacggaagtaataaattttatgcagattcagtaaaaggaagatttacaatatcaagagataatagtaaaaatacattatatttacaaatgaatagtttaagagcagaagacacagcagcatattactgtgcaagagaaggagtatattttgactcaggaacatacagaggatattttgattattggggacaagaaacattagtaacagtatcatca

SEQ ID NO: 50868 - RNA, 375 nt, synthetic construct
  misc_feature 1..375: note = derived and/or modified sequence opt6 from anti-influenza_Chain
  source 1..375: mol_type = other RNA
caagtacaactacaagaatcaggaccaggattagtaaaaccatcacaaacactatcactaacatgcacagtatcaggaggatcaatatcatcaggaaactactactggaactgggtaagacaacacccaggaaaaggactagaatggataggatacatatactacagaggatcaacattctacaacccatcactaaaaagcagagtaacaatatcaatagacacaagcaaaaaccaattctcactaagactatcatcagtaacagcagcagacacagcagtatactactgcgcaaaagacacaagatcatcactagacaactaccaatacggaatggacgtatggggacaaggaacaacagtaacagtatcatca

SEQ ID NO: 50869 - RNA, 375 nt, synthetic construct
  misc_feature 1..375: note = derived and/or modified sequence opt6 from anti-influenza_Chain
  source 1..375: mol_type = other RNA
gaagtacaattattagaaagcggaggaggattagtacaaccaggaggaagtttaagattaagttgtgcagcaagtggattttcatttagtacatatgcaatgagttgggtaagacaagcaccaggaaaaggattagaatgggtaagtggaataagtggaagtggagaaagtacatattatgcagatagtgtaaaaggaagatttacagtaagtagagataatagtaaaaatacattatatttacaaatgaatagtttaagagcagaagatacagcagtatattattgtgcaaaacaaggagatcatatagcatggttattaagaggaataaattttgattattggggacaaggagtattagtaacagtaagtagt

SEQ ID NO: 50870 - RNA, 375 nt, synthetic construct
  misc_feature 1..375: note = derived and/or modified sequence opt6 from anti-influenza_Chain
  source 1..375: mol_type = other RNA
caagtacaattagtagaatcaggaggaggagtagtacaaccaggaagatcactaagactatcatgtgcagcatcaggatttgcatttcataatagagcaatgcattgggtaagacaagcaccaggaaaaggactagaatgggtagcactaatatactttgacggaagtaaacaatattatgcagactcagtaaaaggaagattcacaatatcaagagataatagtaaaaatacagtatttctacaaatgaatagtctaagaccagaagacacagcagtatactattgcgcagtaccaggaccaatatttggaatattcccaccatggtcatattttgatcactggggacaaggaatattagtaacagtatcatca

SEQ ID NO: 50871 - RNA, 375 nt, synthetic construct
  misc_feature 1..375: note = derived and/or modified sequence opt6 from anti-influenza_Chain
  source 1..375: mol_type = other RNA
gaagtacaattagtagaatcaggaggaggagtagtacaaccaggaagatcactaagactatcatgtgcagcatcaggatttgcatttcataatagagcaatgcattgggtaagacaagcaccaggaaaaggactagaatgggtagcattaatatactttgacggaagtaaacaatattatgcagattcagtaaaaggcagatttacaatatcaagagataatagtaaaaatacagtatttttacaaatgaatagtttaagaccagaagacacagcagtatattattgtgcagtaccaggaccaatatttggaatatttccaccatggtcatattttgatcattggggacaaggaatattagtaacagtatcatca

SEQ ID NO: 50872 - RNA, 375 nt, synthetic construct
  misc_feature 1..375: note = derived and/or modified sequence opt6 from anti-influenza_Chain
  source 1..375: mol_type = other RNA
gaagtacaattagtacaaagcggaggaggagtagtacaaccaggaaaaagtttaagattaagttgtgcagcaagtggactaacattttcaagttatgcagtacactgggtaagacaagcaccaggaaaaggactagaatgggtaacactaatatcatatgatggagcaaatcaatactatgcagatagcgtaaaaggaagatttacaataagtagagataatagtaaaaatacagtatatttacaaatgaatagtttaagaccagaagatacagcagtatattactgtgcagtaccaggaccagtatttggaatatttccaccatggtcatattttgataattggggacaaggaatattagtaacagtatcaagt

SEQ ID NO: 50873 - RNA, 375 nt, synthetic construct
  misc_feature 1..375: note = derived and/or modified sequence opt6 from anti-influenza_Chain
  source 1..375: mol_type = other RNA
caagtacaattagtagaaagcggaggaggggtagtacaaccaggaaaaagtttaagattaagctgtgcagcaagcggactaacattctcaagttatgcagtacactgggtaagacaagcaccaggaaaaggactagaatgggtaacattaatatcatatgatggagcaaaccaatactatgcagatagcgtaaaaggaagatttacaataagtagagacaatagcaaaaacacagtatatctacaaatgaatagcttaagaccagaagatacagcagtatattactgtgcagtaccaggaccagtattcggaatatttccaccatggtcatactttgacaattggggacaaggaatattagtaacagtatcaagc

SEQ ID NO: 50874 - RNA, 375 nt, synthetic construct
  misc_feature 1..375: note = derived and/or modified sequence opt6 from anti-influenza_Chain
  source 1..375: mol_type = other RNA
caagtacaattagtagaaagcggaggaggagtagtacaaccaggaaaaagcccaagattaagttgtgcagcaagcggaccaacattctcaagctatgcagtacactgggtaagacaagcaccaggaaaaggactagaatgggtaacattaatatcatatgatggagcaaaccaatactatgcagattcagtaaaaggaagatttacaataagcagagacaatagcaaaaacacagtatatctacaaatgaatagcctaagaccagaagatacagcagtatattactgtgcagtaccaggaccagtattcggtatatttccaccatggtcatactttgacaattggggacaaggaatattagtaacagtatcaagc

SEQ ID NO: 50875 - RNA, 375 nt, synthetic construct
  misc_feature 1..375: note = derived and/or modified sequence opt6 from anti-influenza_Chain
  source 1..375: mol_type = other RNA
gaagtacaattagtagaatcaggaggaggagtagtacaaccaggaaaatcattaagattatcatgtgcagcatcaggattaacatttagttcatatgcagtacattgggtaagacaagcaccaggaaaaggattagaatgggtaacattaataagttatgacggagcaaatcaatattatgcagattcagtaaaaggaagatttacaatatcaagagataatagtaaaaatacagtatatttacaaatgaatagtttaagaccagaagatacagcagtatattattgtgcagtaccaggaccagtatttggaatatttccaccttggtcatattttgataattggggacaaggaatattagtaacagtatcatca

SEQ ID NO: 50876 - RNA, 375 nt, synthetic construct
  misc_feature 1..375: note = derived and/or modified sequence opt6 from anti-influenza_Chain
  source 1..375: mol_type = other RNA
caagtacaattagtacaaagtggagcagaattaaaaagaccaggagcaagtgtaaaagtaagttgtaaaacaagtggatatagttttaataattatggaataaattgggtaagacaagcaccaggacaaggattagaatggatgggatggataagtgcatatacaggaaatacacattatgcaaaaaattttgaaggaagagtaacattaacaacagatacaagtacaagtacagcatatatggaagtaagaagcttaagaagtgatgatagtgcagtatatttttgtgcaagagcaatgatacaaggagtagtaacattatatttaagaccaggagattattggggacaaggaacattagtaacagtaagtagc

SEQ ID NO: 50877 - RNA, 375 nt, synthetic construct
  misc_feature 1..375: note = derived and/or modified sequence opt6 from anti-influenza_Chain
  source 1..375: mol_type = other RNA
caagtacaattagtacaaagtggagcagaagtaaaacaaccaggagcaagtgtaaaagtaagttgtaaagcaagtggatatacatttaatgcatattatatacattgggtaagacaagcaccaggacaaggactagaatggatgggatggataaatccaaattttggaggaacacattatgcaagaaaatttcaaggaagagtaacaatgacaagagatgcaagtataaatacagcatatatggaattagatagattaataagtgatgatacagcagtatattattgtgtaagatggagagcagcagcagtaataatggatcaattttataaaatggatgtatggggacaaggaacattagtaacagtaagtagt

SEQ ID NO: 50878 - RNA, 375 nt, synthetic construct
  misc_feature 1..375: note = derived and/or modified sequence opt6 from anti-influenza_Chain
  source 1..375: mol_type = other RNA
caagtacaattagtacaatcaggaccagaattaaaaaaaccaggatcatcagtaaaattatcatgtatggcaacaggaggaacatttataaattacgcattttcatgggtaagacaagcaccaggacaaggattagaatggttaggaggaataataccagtatacggaacatcaaaccatgtagaaaaattacaaggaagagtaacaataacagcagacgcatcaacaaatacagcatatatggaattatcaggactaagatttgatgacacagcagtatacttctgcgcagcatcaacagcaacaagcggaacatactacgcaatgagaccattcgacttctggggacaaggaacactagtatcagtatcatca

SEQ ID NO: 50879 - RNA, 378 nt, synthetic construct
  misc_feature 1..378: note = derived and/or modified sequence opt6 from anti-influenza_Chain
  source 1..378: mol_type = other RNA
gaagtacaattagtagaaagtggaggaggagtagtacaaccaggaggaagtctaagattaagttgtatagcaagtgcatttaatttaggaatatttggaatgcattgggtaagacaagcaccaggaaaaggattagaatgggtagcatttataagatatgatggaggaaaaacattttatgcagatagtgtaaaaggaagatttacaataagtagagataatagtaaaaatacattatatttacaaatgaatagtttaagaacagaagatacagcattatattattgtgcaagagatgcaacagcagattattatggaccaggaagttatccaaattggttagatccatggggacaaggaacattagtaacagtaagt

SEQ ID NO: 50880 - RNA, 378 nt, synthetic construct
  misc_feature 1..378: note = derived and/or modified sequence opt6 from anti-influenza_Chain
  source 1..378: mol_type = other RNA
gaagtacaactagtagaatcaggaccagcactagtaaaaccaacacaaacactaacactaacatgctcattctcaggattcagcctaagcacaagcggaatgtcagtatcatggataagacaaccaccaggaaaagcactagaatggctagcactaatagactgggacgacgacacatactacataacatactcatcatcactaaaaacaagactaacaatatcaaaagacacatccaaatcacaagtagtactaacaatgacaaacatggacccagtagacacagcaacatactactgcgcaagaacactaagagtatcaggagactacgtaagagacttcgacctatggggaagaggaacactagtaacagtatca

SEQ ID NO: 50881 - RNA, 378 nt, synthetic construct
  misc_feature 1..378: note = derived and/or modified sequence opt6 from anti-influenza_Chain
  source 1..378: mol_type = other RNA
caagtacaattacaagaaagcggaccaggcctagtaaaaccaagcgaaacattatcattaacatgtacagtaagtggaggatcaataaatagctattactggaactggataagacaaccacccggaaaaggattagaatggataggatatatatatcactcaggatcaacaaattacaatccatcactaaaaagcagagtaacaatatcagtagatacaagcaaaaatcaatttagcttacaattaagctcagtaacagcagcagacacagcagtatactattgcgcaagattaagaacagactatggagatccagatagcgtatactattacggaatggatgtatggggacaaggaacaacagtaacagtaagctca

SEQ ID NO: 50882 - RNA, 378 nt, synthetic construct
  misc_feature 1..378: note = derived and/or modified sequence opt6 from anti-influenza_Chain
  source 1..378: mol_type = other RNA
caagtacatctagtacaatcaggagcagaagtaagaaaaccaggagactcagtaaaagtatcatgcaaaacatcaggatatacatttagcacatacccagtagcatgggtaagacaagtaccaggacaaggattagaatggatgggatggataagcacatacaatggaaatacaaatttcgcacaaaatttccaaggaagagtaacactaacaacagatacaacaacaaatacagcatacatggaagtgagatcgctaaaattcgatgacacagcagtatactattgcgcaagagtagaaggaagctatagagatttctggaacaatcaaaatagatttgacccatggggacaaggaacattagtaacagtatcaagc

SEQ ID NO: 50883 - RNA, 378 nt, synthetic construct
  misc_feature 1..378: note = derived and/or modified sequence opt6 from anti-influenza_Chain
  source 1..378: mol_type = other RNA
gaagtacaattagtagaaagcggagcagaagtaaaaaaaccaggagcaagtgtaaaagtaagttgtaaagcaagtggatatacatttacaagttttgatataaattgggtaagacaagcaccaggacaaggattagaatggatgggatggatgacaccaacaagtggaaaaacaggatatgcacaaaaatttcaaggaagaataacaatgacaagaaatacaagtataaatacagcatatatggaattaagtagtttaagaagtgaagatacagcagtatatttttgtgcaagaggaccagaaagaagaacaacaatatttgatgtaatattagattggtttgatccatggggacaaggaacattagtaacagtaagt

SEQ ID NO: 50884 - RNA, 378 nt, synthetic construct
  misc_feature 1..378: note = derived and/or modified sequence opt6 from anti-influenza_Chain
  source 1..378: mol_type = other RNA
caagtacaattagtacaaagcggagcagaagtaaaaaaaccaggatcaagtgtaaaagtaagctgtaaagcaagtggaggatttttctcaagctatgcaataagctgggtaagacaagcaccaggacaaggactagaatggatgggaggagtaataccaatattcagaacagcaaattatgcacaaaactttcaaggaagagtaacaataacagcagacgaattcacaagctatatggaactatcaagcttaagatcagacgatacagcagtatattactgtgcaagactaaattaccatgactcaggaacatactataacgcaccaagaggatggttcgatccatggggacaaggaacactagtaacagtaagctca

SEQ ID NO: 50885 - RNA, 378 nt, synthetic construct
  misc_feature 1..378: note = derived and/or modified sequence opt6 from anti-influenza_Chain
  source 1..378: mol_type = other RNA
caagtacaattagtacaaagtggagcagaagtaaaaaaaccaggaagtagtgtaaaagtaagttgtaaagcaagtggaggagcatttagtaattatgcaataagttgggtaagacaagcaccaggacaaggattagaatggatgggaggaataataccaatatttggaacaacaaattatgcacaaaaatttcaaggaagagtaacaataacagcagataaatttacaacaatagcatatatggaattaagaagtttaaggagtgaagatacagcagtatattattgtgcaaggcatggaggagtatattattatggaagtgcaagtagtggatggtttgatccatggggacaaggaacattagtaacagtaagtagt

SEQ ID NO: 50886 - RNA, 378 nt, synthetic construct
  misc_feature 1..378: note = derived and/or modified sequence opt6 from anti-influenza_Chain
  source 1..378: mol_type = other RNA
caagtacaattattagaatcaggaggaggagtagtaagaccaggaagatcattaagattagcatgtgcaggatcaggatttacattttcagcatatgcaatgcattgggtaagacaagcaccaggaaaaggattagaatgggtagcacatacaagttatgatggaagagatagttattatgtagattcagttaaaggaagatttacaatatcaagagatgatagtaaaaatacattatatttacaaatgaatagtttaagaccagaagatacagcagtatattattgtgcaaaagtaggaccatatacaggatatgatgattataattattatggaatggatgtatggggacatggaacaacagtaacagtatcatca

SEQ ID NO: 50887 - RNA, 378 nt, synthetic construct
  misc_feature 1..378: note = derived and/or modified sequence opt6 from anti-influenza_Chain
  source 1..378: mol_type = other RNA
caagtacaattagtagaaagtggaggaggagtagtacaaccaggaggaagcttaagattaagttgtgcagcaagtggatttaattttgatgaatatgtaatgtattgggtaagacaatcaccaggaaaaggattagaatgggtaagtttaataggagcagatggaagaggaacatataatagtgatagtgtaaaaggaagatttacaataagtagagataatagaaaaaatagtttatatttacaaatgaatagtttaagaagtgatgatacagcattatattattgtgcaaaagtagaaagaagtttttatgatggaagtggatatggagatgcattagaaatatggggacaaggaacaatggtaacagtaagtagt

SEQ ID NO: 50888 - RNA, 381 nt, synthetic construct
  misc_feature 1..381: note = derived and/or modified sequence opt6 from anti-influenza_Chain
  source 1..381: mol_type = other RNA
gaagtacaactattagaaagtggaggaggattagtacatccaggaggaagtttaagattaagttgtgcagcaagtggatttacatttagtaattatgcaatgagttgggtaagacaagcaccaggaaaaggattagaatgggtaagtagtataaatagtggaggaggagcaacatattatgcagattcagtaaaaggaagatttacaataagtagagataatagtaaaaatacattaagtttacaaatgaatagtttaagagcagaagatacagcagtatattattgtgcaaaagaaggaggaaatacaatatttggattagtaacaatggcatattattttgatagttggggacaaggaacattagtaacagtaagtagc

SEQ ID NO: 50889 - RNA, 381 nt, synthetic construct
  misc_feature 1..381: note = derived and/or modified sequence opt6 from anti-influenza_Chain
  source 1..381: mol_type = other RNA
caaccacaactacaagaatcaggaccaggactagtaagaccatcagaaacactatcactaacatgcacagtatcaggagactcagtaacaagaggaggattctactggggatggataagacaaccaccaggaaaaggactagaatggataggatcaatatactacaactacaacatataccactcaccatcactaaaatcaagagtatcactatcagtagacacatcaaaaaaccaagtatcactaaaattagcatcagtaacagcagcagacacagcagtatactactgcgcaagacactacccatactacgacctaccaacaggattctactcacaattcgacttctggggacaaggaacaccagtaacagtatcatca

SEQ ID NO: 50890 - RNA, 381 nt, synthetic construct
  misc_feature 1..381: note = derived and/or modified sequence opt6 from anti-influenza_Chain
  source 1..381: mol_type = other RNA
tggtggcaattagtacaaagtggagcagaagtaaaaaaaccaggaagtagtgtaaaagtaagttgtaaagcaagtggaggaacatttagtagttatgatataagttgggtaagacaagcaccaggacaaggattagaatggatgggaggaataataccaatatatggaacagcaaattatgcacaaaaatttcaaggaagagtaacaataacagcagatgaaagtacaagtacagcatatatggaattaagtagtttaagaagtgaagatacagcagtatattattgtgcaagagcaggaggagatagtagtggatattatggagcattaggaagattttttcaacactggggacaaggaacattagtaacagtaagtagt

SEQ ID NO: 50891 - RNA, 381 nt, synthetic construct
  misc_feature 1..381: note = derived and/or modified sequence opt6 from anti-influenza_Chain
  source 1..381: mol_type = other RNA
gaagtacaattagtacaaagcggaggagcagtagtacaaccaggaagaagcctaagattaagttgtgcagcaagcggattcacattctcaatatatgcaatgcactgggtaaggcaaacaccaggaaaaggactagaatgggtagcattaatatcatacgatggaaataacaaatactatgcagatagcgtaaaaggaagatttacaataagcagagacaattacaaaaacacactatatctacaaatgaaaggattaagagcagaagatacagcactatattactgtgcaagaagaataacagaaaaaggatactataacgatagcggaagaccaaactggttcgatccatggggacaaggaacattagtaacagtaagc

SEQ ID NO: 50892 - RNA, 381 nt, synthetic construct
  misc_feature 1..381: note = derived and/or modified sequence opt6 from anti-influenza_Chain
  source 1..381: mol_type = other RNA
caagtacaactacaacaatcaggaccaagattagtaaaaccatcacaaacactatcactaacatgcgcaatatcaggagatagtgtaagcggagactcaggaacatggaattggataagacaaagcccaagcagaggactagaatggctaggaagaacatactatagatcaaaatggtacaatgactatgcagaaagcgtaaaatcacgaatagtaataaaagcagacacaagtaaaaacgaattttcactacaactaaatagcgtaacaccagaagatacagcaatatattactgtgcaagagcaggagtaaaaatattcggactaatagtaggagcactagataactggggaagaggaacattagtaacagtaagctcg

SEQ ID NO: 50893 - RNA, 381 nt, synthetic construct
  misc_feature 1..381: note = derived and/or modified sequence opt6 from anti-influenza_Chain
  source 1..381: mol_type = other RNA
caagtacaactacaacaatggggagcaggattattaaaaccatcagaaacattatcattaacatgtacagtatcaggaggaagtttaacagattattcatggaattggataagacaaccaccaggaaaaggattagaatggataggagatacattacataatggatatacaaattataatccaagtttaagaggaagagtaagtataagtatagacacaagcaaaaatcaagtatcattaagattaacaagtgtaacagcagcagatacagcattatattactgtgcaagaggaagtggcggatatggaggatttgattatttcggaaaattaagaacatgggatttctggggacaaggaacattagtaacagtaagttca

SEQ ID NO: 50894 - RNA, 381 nt, synthetic construct
  misc_feature 1..381: note = derived and/or modified sequence opt6 from anti-influenza_Chain
  source 1..381: mol_type = other RNA
caagtacaattagtacaaagcggagcagaagtaagaaaaccaggagaaagtttaagaataagctgtagaggaagcggatataattttccaaaatattggataggatgggtaagacaaatgccaggaaaaggattagaatggatgggaatgatatatccaggagattcagacgtaagatataatccaagttttcaaggacaagtaacaataagtgcagatgaaagtataaatacagcatatttacaatggtcaagtttaagaacaagtgatacagcaagatattactgtgcaagacatttaggacaacaattagtatcaaatacatattattattatggaatggacgtatggggacaaggaacaacagtaacagtatcaagt

SEQ ID NO: 50895 - RNA, 384 nt, synthetic construct
  misc_feature 1..384: note = derived and/or modified sequence opt6 from anti-influenza_Chain
  source 1..384: mol_type = other RNA
caaatacaactacaagaatcaggaccaggattagtaaaaccatcacaaacactatcactaacatgcgcaatatcaggagactcagtatcatcaaacaacgcagtatggaactggataagacaatcaccatcaagaggactagaatggctaggaagaacatactacagatcaaaatggtacaacgactacgcagaatcagtaaaatcaagaataacagtaaacccagacacaagcaaaaaccaattctcactacacctaaaatcagtaacaccagaagacacagcagtattctactgcgtaagatcaggacacataacagtattcggagtaaacgtagacgcattcgacatgtggggacaaggaacaatggtaacagtatcatca

SEQ ID NO: 50896 - RNA, 384 nt, synthetic construct
  misc_feature 1..384: note = derived and/or modified sequence opt6 from anti-influenza_Chain
  source 1..384: mol_type = other RNA
caagtacaattacaagaaagcggaccaggattagtaaaaccaagccaaacactaagcctaacatgtgcaataagtggagactcagtatcaagcaataacgcagtatggaactggataagacaatcaccatcaagaggactagaatggttaggaagaacatattacagaagcaaatggtataacgattacgcagaatcagtaaaaagcagaataacagtaaatccagatacaagcaaaaatcaattttcattacacttaaaatcagtaacaccagaagacacagcagtattctattgcgtaagatcaggacatataacagtatttggagtaaacgtagacgcattcgatatgtggggacaaggaacaatggtaacagtaagctca

SEQ ID NO: 50897 - RNA, 384 nt, synthetic construct
  misc_feature 1..384: note = derived and/or modified sequence opt6 from anti-influenza_Chain
  source 1..384: mol_type = other RNA
caagtacaactacaacaatcaggaccaggcctagtaaaaccatcacaaacactatcactaacatgcgcaatatcaggagacagagtatcatcaaactcagcagtatggaactggataagacaatcaccatcaagaggactagaatggctaggaagaacatactacagatcaaaatggtactacgactacgcagaatcagtaaaatcaagaatagtaatagacccagacacaagcaaaaaccaagtatcactacaattaaactcagtaacacccgaagactcagcaatatactactgcgcaagaggaggacacataacagtattcggactaaacatagacgcatacgacatatggggacaaggagcaaaagtaacagtaagcagc

SEQ ID NO: 50898 - RNA, 384 nt, synthetic construct
  misc_feature 1..384: note = derived and/or modified sequence opt6 from anti-influenza_Chain
  source 1..384: mol_type = other RNA
caagtacaactacaacaatcaggaccaggactagtaaaaccatcacaaacactatcactaacatgcgcaatatcaggagacagagtaagcagcaactcagcagtatggaactggataagacaatcaccatcaagaggactagaatggctaggaagaacatactacagatcaaaatggtactacgactacgcagaatcagtaaaatcaagaatagtaatagacccagacacatcaaaaaaccaagtatcactacaactaaactcagtaacaccagaagattcagcaatatattactgcgcaagaggaggacacataacagtattcggactaaacatagacgcatacgacatatggggacaaggagcaatggtaacagtatcatca

SEQ ID NO: 50899 - RNA, 384 nt, synthetic construct
  misc_feature 1..384: note = derived and/or modified sequence opt6 from anti-influenza_Chain
  source 1..384: mol_type = other RNA
caagtacaactacaacaatcaggaccaggactagtaaaaccaagtcaaacattatcactaacatgcgcaatatcaggagacagagtatcatcaaactcagcagtatggaactggataagacaatcaccatcaagaggactagaatggctaggaagaacatactacagatcaaaatggtactacgactacgcagaatcagtaaaatcaagaatagtaatagacccagacacaagtaaaaaccaagtatcactacaattaaactcagtaacaccagaagactcagcaatatactactgcgcaagaggaggacacataacagaattcggactaaacatagacgcatacgacatatggggacaaggagcaatggtaacagtatcatca

SEQ ID NO: 50900 - RNA, 384 nt, synthetic construct
  misc_feature 1..384: note = derived and/or modified sequence opt6 from anti-influenza_Chain
  source 1..384: mol_type = other RNA
caagtacaattacaacaaagcggaccaggattagtaaaaccaagccaaacattaagcctaacatgtgtaataagtggagacacagtatcaagcaatagagcaacatggaactggatgagacaatcaccattaagaggactagaatggttaggaagaacatattacagaagcaaatggtataacgattacgcagtatcagtaaaaagcagagtagtaataaatccagatacaagcaaaaatcaagtatcattacaattaaacacagtaacaccagatgactcaggagtatacttttgcgcaagaggaggacatataacagtatttggagtaaacatagacgcattcgatatatggggactaggaacgaaagtaacagtaagctca

SEQ ID NO: 50901 - RNA, 384 nt, synthetic construct
  misc_feature 1..384: note = derived and/or modified sequence opt6 from anti-influenza_Chain
  source 1..384: mol_type = other RNA
caagtagaattacaacaaagcggaccaggattagtaaaaccaagtcaaacattaagcctaacatgtgcaataagtggagactcagtatcaagcaatagtgcaacatggaactggataagacaatcaccatcaagaggactagaatggctaggaagaacatattacagaagcaaatggtataacgattacgcagactttctaaaaagaagaataacaataaatccagatacatcaaacaatgaagtatcattaagattaacaagcgtaacaccagatgacacagcattatactattgcgcaagaggaggacatataacagtatttggagtaaacatagacgcattcgatgtatggggacaaggaacaatggcaacagtaagctca

SEQ ID NO: 50902 - RNA, 384 nt, synthetic construct
  misc_feature 1..384: note = derived and/or modified sequence opt6 from anti-influenza_Chain
  source 1..384: mol_type = other RNA
caagtacaactacaacaatcaggaccaggattagtaaaaccatcacaaacactatcactaacatgcgcaatatcaggagactcagtatcatcaaactcagcaacatggaactggataagacaatcaccatcaagaggactagaatggctaggaagaacatactacagatcaaaatggtacaacgactacgcagacttcctaaaaagaagaataaccataaacccagacacatcaaacaacgaagtatcactaagactaacatcagtaacaccagacgacacagcactatactactgcgcaagaggaggacacataacagtattcggagtaaacatagacgcattcgacgtatggggacaaggaacaatggtaacagtatcatca

SEQ ID NO: 50903 - RNA, 384 nt, synthetic construct
  misc_feature 1..384: note = derived and/or modified sequence opt6 from anti-influenza_Chain
  source 1..384: mol_type = other RNA
caagtacaactacaacaatcaggaccaggattagtaaaaccatcacaaacactatcactaacatgcgcaatatcaggagactcagtatcatcatacaacgcagtatggaactggataagacaatcaccatcaagaggactagaatggctaggaagaacatactacagatcaggatggtacaacgactacgcagaatcagtaaaatcaagaataacaataaacccagacacaagcaaaaaccaattctcactacaattaaactcagtaacaccagaagacacagcagtatactactgcgcaagatcaggacacataacagtattcggagtaaacgtagacgcattcgacatgtggggacaaggaacaatggtaacagtatcatca

SEQ ID NO: 50904 - RNA, 384 nt, synthetic construct
  misc_feature 1..384: note = derived and/or modified sequence opt6 from anti-influenza_Chain
  source 1..384: mol_type = other RNA
caagtacaactacaacaatcaggaccaggactagtaaaaccatcacaaacactatcactaacatgcgcaatatcaggagactcagtatcatcaaacaacgcagtatggaactggataagacaatcaccatcaagaggactagaatggctaggaagaacatactacagatcaaaatggtacaacgactacgcagaatcagtaaaatcaagaataacaataaacccagacacatcaaaaaaccaattctcactacaactaaactcagtaacaccagaagacacagcagtatactactgcgcaagatcaggacacataacagtattcggagtaaacgtagacgcattcgacatgtggggacaaggaacaacagtaacagtatcatca

SEQ ID NO: 50905 - RNA, 384 nt, synthetic construct
  misc_feature 1..384: note = derived and/or modified sequence opt6 from anti-influenza_Chain
  source 1..384: mol_type = other RNA
agaggacaattagtacaaagtggaggaggagtagtacaaccaggaagaagtttaagattaagttgtgcagcaagtggatttgtatttaatgtatttggaatacattgggtaaggcaagcaccaggaaaaggattagaatggttagcaacaataagttatgatggattaaataaatattatgcagatagtgtaaaaggaagaataacaataagcagagataatagtaaaaatacattatatttacaaatgaatagtttaagagcagaagatacagcagtatattattgtgtaagagatagcgaagaaagtacatattatggagattatatgtgggtatataattggtttgatttatggggacaaggaacattagtaacagtaagt

SEQ ID NO: 50906 - RNA, 384 nt, synthetic construct
  misc_feature 1..384: note = derived and/or modified sequence opt6 from anti-influenza_Chain
  source 1..384: mol_type = other RNA
caagtacaactacaacaatggggatcaggactactaaaaccatcagaaacactatcactaacatgcgcagtatacggaggatcattcagagacgactactggacatggataagacaaccaccaggaaaaggactagaatggataggagaaataaaccactcaggaagaacaaactacaacccatcactaaaatcaagagtaacaatatcagtagacacatcattaaaacaattctcactaaaagtaatatcagtaacagcagcagacacagcagtatactactgcgcaagaggaacatcacacgtatcaagatacttcgactggctaccaccaacaaactggttcgacccatggggacaaggaacacaagtaacagtatcatca

SEQ ID NO: 50907 - RNA, 384 nt, synthetic construct
  misc_feature 1..384: note = derived and/or modified sequence opt6 from anti-influenza_Chain
  source 1..384: mol_type = other RNA
caagtacaactacaacaatggggagcaggactattaaaaccaagcgaaacattatcattaagctgtgcagttttcggaggatcattctcagactattactggacatggataagacaaccaccaggaaaaggactagaatggataggagaaataaaacactcaggaagaacaaattacaatccatcactagaaagcagagtaacaatatcagtagatacaagcaaaaatcaatttagcttaaaattaagctcagtaacagcagcagacacagcaatatactattgcgcaagaggaacagatccagatacagaaggatattgcagaagcggaagctgtagcgcattcgatttctggggacaaggaacattagtaacagtaagctca

SEQ ID NO: 50908 - RNA, 384 nt, synthetic construct
  misc_feature 1..384: note = derived and/or modified sequence opt6 from anti-influenza_Chain
  source 1..384: mol_type = other RNA
caagtacaattacaacaatggggagcaggactattaaaaccaagtgaaacattaagcttaacatgtggagtatacggaggatcattatcagactattactggagctggataagacaaccaccaggaaaaggactagaatggataggagaaataaatcactcaggaggaacaaattacaatccatcactaaaaagaagagtcacaatatcagtagatacatcaaaaaaacaatttagcttaaaaatgaacagtgtaacagcagcagacacagcagtatactattgcgcaagaggaacagatccagatacagaagtatattgcagagcaggaaactgtgcagcattcgatttctggggacaaggaacactagtaacagtaagttca

SEQ ID NO: 50909 - RNA, 384 nt, synthetic construct
  misc_feature 1..384: note = derived and/or modified sequence opt6 from anti-influenza_Chain
  source 1..384: mol_type = other RNA
caagtacaactacaagaatcaggaccaggattagtaaaaccatcacaaacactatcactaacatgcacagtatcaggagactcaatatcatcagtagaccactactggtcatggataagacaacacccagtaaaaggactagaatggataggattcatgtactactcagcatcaacatactacaacccatcactaaaatcaagagtaacaatatcaacagacacaagcaaaaaccaattctcactaagactatcatcagtaacagcagcagacacagcagtatactactgcgcaagaggaacatgcgcaggagactgctcactacactactactactacggactagacgtatggggacaaggaagaacagtaacagtatcatca

SEQ ID NO: 50910 - RNA, 384 nt, synthetic construct
  misc_feature 1..384: note = derived and/or modified sequence opt6 from anti-influenza_Chain
  source 1..384: mol_type = other RNA
gaagtagcattagtagaaagcggagcagaagtaaaaaaaccaggaagtagtgtaaaagtaagttgtaaagcaagtggacatatatttagtggatatgcaataagctgggtaagacaagcaccaggacaaggattagaatggatgggaggaataataccaatatttggaacaacaaattatgcacaaaaatttcaaggaagagtaacaataacagcagatcaaagtacaagtacagcatatatggatttaagtaatttaagaagtgaagatacagcagtatattattgtgcaagagtaaaagatggatattgtacattaacaagttgtccagtaggatggtattttgacttatggggaagaggaacattagtaacagtaagtagt

SEQ ID NO: 50911 - RNA, 384 nt, synthetic construct
  misc_feature 1..384: note = derived and/or modified sequence opt6 from anti-influenza_Chain
  source 1..384: mol_type = other RNA
gaagtacaattagtagaaagtggagcagaagtaaaaaaaccaggaagtagtgtaaaagtaagttgtaaagcaagcggacatatatttagtggatatgcaataagttgggtaagacaagcaccaggacaaggattagaatggatgggaggaataataccaatatttggaacaacaaattacgcacaaaaatttcaaggaagagtaacaataacagcagatcaaagtacaagtacagcatatatggatttaagtaatttaagaagtgaagatacagcagtatattattgtgcaagagtaaaagatggatattgtacattaacaagttgtccagtaggatggtattttgatttatggggaagaggaacattagtaacagtaagtagt

SEQ ID NO: 50912 - RNA, 384 nt, synthetic construct
  misc_feature 1..384: note = derived and/or modified sequence opt6 from anti-influenza_Chain
  source 1..384: mol_type = other RNA
caagtacaattagtacaaagcggagcagaagtaagaaaaccaggagcaagtgtaaaagtaagttgtaaagcaagtggatatacatttacaagacatgggataagttgggtaagacaagcaccaggacaaggattagaatggatgggatggataagtgcatatacaggagatacagattatgcacaaaaatttcaaggaagagtaacaatgacaacagatacaagtacaaatacagcatatatggaattaagaagtttaagaagtgatgatgcagcagtatattattgtgcaagattaagattacaaggagaagtagtagtaccaccaagtcaaagtaattggtttgatccatggggacaaggaacattagtaacagtaagtagt

SEQ ID NO: 50913 - RNA, 384 nt, synthetic construct
  misc_feature 1..384: note = derived and/or modified sequence opt6 from anti-influenza_Chain
  source 1..384: mol_type = other RNA
caagtacaattagtagaaagcggaccaggactaatgaaaccaagcgaaacattaagcctaacatgtacagtaagcggaggatcagtatcaaactattactggagctggataagacaaccaccaggaaaaggattagaatggataggatatgtattttactcaggatcaagcaattacaatccatcactaaataacccatcattaaaaagcagagtaacaatatcaatagacacaagcaataaccaattctcactaaaattatcaagcgtaacagcagcagatacagcagtatattactgtgcaagaggaagagtaaatagcggatacgattggggaccaaatttcgatagctggggacaaggagcattagtaacagtaagctca

SEQ ID NO: 50914 - RNA, 384 nt, synthetic construct
  misc_feature 1..384: note = derived and/or modified sequence opt6 from anti-influenza_Chain
  source 1..384: mol_type = other RNA
caagtacaattagtacaaagcggagcagaagtaaaaaaaccaggatcaagcgtaaaagtaagctgtaaagcaagcggaggaacattctcatactatgcaataagctgggtaagacaagcaccaggacaaggactagaatggatgggaggaataataccaatagtaggaacagcacactatacacaaaaatttcaaggaagagtaacaataacagcagacgaaagcacaagcacagcatatatggaactatcaagcttaagatcagaagatacagcagtatatttctgtgcaagagcagcagacgaaagcgtagaatcactaacaataaaagcatttagaacaaactatcactggggacaaggaacactagtaacagtaagctca

SEQ ID NO: 50915 - RNA, 387 nt, synthetic construct
  misc_feature 1..387: note = derived and/or modified sequence opt6 from anti-influenza_Chain
  source 1..387: mol_type = other RNA
gaagtacaattagtagaaagtggaggaggagcagtacaaccaggagaaagtttaaaattaccatgtgcagcaagtggatttacatttagtaattatggaatgcattgggtaagacaagcaccaggaaaaggattagaatgggtagcagtaataagttatgatggaagtaataaatattatgcagatagtgtaaaaggaagatttacaataagtagagataatagtaaagatacattatatttacaaatgaatagtttaagagcggaagatacagcattattttattgtgcaaaagaaagaccattaagattattaagatattttgattggctaagtggaggagcaaatgattattggggacaaggaacattagtaacagtatcaagt

SEQ ID NO: 50916 - RNA, 387 nt, synthetic construct
  misc_feature 1..387: note = derived and/or modified sequence opt6 from anti-influenza_Chain
  source 1..387: mol_type = other RNA
gaagtacaattagtagaaagtggaggaggagcagtacaaccaggagaaagtctaaaattaagttgtgcagcaagcggatttacatttagcaattatggaatgcattgggtaagacaagcaccaggaaaaggactagaatgggtagcagtaataagttatgatggaagtaataaatattatgcagatagcgtaaaaggaagatttacaataagtagagataatagtaaagatacattatatttacaaatgaatagtttaagagcagaagatacagcattattttattgtgcaaaagaaagaccattaagattattaagatatttcgattggttaagtggaggagcaaatgattattggggacaaggaacattagtaacagtaagtagt

SEQ ID NO: 50917 - RNA, 387 nt, synthetic construct
  misc_feature 1..387: note = derived and/or modified sequence opt6 from anti-influenza_Chain
  source 1..387: mol_type = other RNA
caagtacaactagtagaatcaggaggaggagtagttcaaccaggaagatcactaagattatcatgtgcagtatcaggattcacattctcatcatacgcaatgcactgggtaagacaagcaccaggaaaaggactagaatgggtagcagtaatatcatacgacggatcaaaccaatactacgcagactcagtaaaaggaagattcacaatatcaagagacaactcaaaaaacacactatacctacaaatgaactcattaagagcagaagacacagcactatactactgcgcaaaagacccaagactaagacacctattatacttcccattcacatcaatgatatacttcgactactggggacaaggaacactagtaacagtatcatca

SEQ ID NO: 50918 - RNA, 387 nt, synthetic construct
  misc_feature 1..387: note = derived and/or modified sequence opt6 from anti-influenza_Chain
  source 1..387: mol_type = other RNA
caagtacaattagtacaatcaggaggaggagtagtacaaccaggaagatcactaagactatcatgcgtagcatcaggattcacattctcaacatacgcaatgcactgggtaagacaagcaccaggaagaggactagaatgggtagcagtaatatcatacgacgcaaactataaatactacgcagactcagtaaaaggaagattctcaatatcaagagacaactcacaaaacacactacacttagaaatgaacacactaagaacagaagacacagcactatactactgcgcaaaagactcacaactaagatcactactatatttcgaatggctatcacaaggatatttcgaaccatggggacaaggaacattagtaacagtaacatca

SEQ ID NO: 50919 - RNA, 387 nt, synthetic construct
  misc_feature 1..387: note = derived and/or modified sequence opt6 from anti-influenza_Chain
  source 1..387: mol_type = other RNA
caagtacaattagtacaaagtggaggaggagtagtacaaccaggaagatcactaagactatcatgcgtagcatcaggatttacatttagcacatacgcaatgcattgggtaagacaagcaccaggaagaggattagaatgggtagcagtaataagctatgacggaaactataaatattacgcagactcagtaaaaggaagattctcaatatcaagagataactcaaactcaacattacacttagaaatgaacacactaagaacagaagacacagcattatactattgcgcaaaagatagccaactaagaagcctactatatttcgaatggctaagccaaggatatttcgatccatggggacaaggaacattagtaacagtaacatca

SEQ ID NO: 50920 - RNA, 387 nt, synthetic construct
  misc_feature 1..387: note = derived and/or modified sequence opt6 from anti-influenza_Chain
  source 1..387: mol_type = other RNA
caagtacaattagtacaaagcggagcagaagtaaaaaaaccaggatcaagcgtaacagtaagttgtaaagcaagcggaggaacattctcaaactatggaataagctgggtaagacaagcaccaggacaaggactagattggatgggaggaataataccattattcggaacagcaaactatgcacaaaaatttcaaggaagagtaacaataacagcagacgaaagcacaagttcaagcaatatggaattatcaagtttaagatcagaagatacagcagtctattactgtgcaagagacgtacacaattatgatttcttaacaggatacccattacatctatatggaatggacgtatggggacaaggaacaacagtaacagtatcaagc

SEQ ID NO: 50921 - RNA, 387 nt, synthetic construct
  misc_feature 1..387: note = derived and/or modified sequence opt6 from anti-influenza_Chain
  source 1..387: mol_type = other RNA
caagtacaactacaagaatcaggaccaggattagtaaaaccatcagaaacactatcactaatatgcgcagtatcaggagcatcaatatcatcatcatactggtcatggataagacaaccaccaggaaaaggactagaatggataggatacatatactactcaggagtaacaaaatacaacccatcactaaaatcaagagtaacactatcagtagacacaagcaaaaaccacttctcattaaaactatcatacgtaacagcagcagacacagcagtatactactgcgcaagaaacctaccagacatagcagtagtaacagcagtacaagacgcaacaccagtatggttcgacccatggggaccaggaaccctagtatcagtatcatca

SEQ ID NO: 50922 - RNA, 387 nt, synthetic construct
  misc_feature 1..387: note = derived and/or modified sequence opt6 from anti-influenza_Chain
  source 1..387: mol_type = other RNA
gaagtacaattagtagaaagtggaggaggattagtacaaccaggaagatcattaagattaagttgtgcagcaagtggatttacatttagcgatttttggatgagttgggtaagacaggcaccaggaaaaggattagaatgggtagcaaatatagatcaagatggaaatgaaagattttatgcagatagtgtaaaaggaagatttacaataagcagagataatgcaaaaaatagtttatatttacaaatgacaagtttaagagcagatgatacagcagtatattattgtgcaagagatggaagagaaggatatttttatggaagtggaagtttttataatttaaaaggattaaattggggacaaggaacattattaacagtaagtagt

SEQ ID NO: 50923 - RNA, 387 nt, synthetic construct
  misc_feature 1..387: note = derived and/or modified sequence opt6 from anti-influenza_Chain
  source 1..387: mol_type = other RNA
gaagtattaatggtagaaagcggaggaggattagtacaaccagggggaagtgtaagattaagttgtgtagcaagcggatttagttttagtagtcattggatgacatgggtaagacaagcaccaggaaaaggattagaatgggtagcaaatatagaagacgatggaggagataaatattatgtagatagtgtaaaaggaagatttataataagtagagataatgcgaaaaatagtgtatatttacaaatgaatagtttaagagcagaagatacagcagtatatttttgtgcaagaggaagtggaagtagtgatagaagtgattatgatccacattattattattatttagatgtatggggaaaaggagcaacagtaacagtaagtagt

SEQ ID NO: 50924 - RNA, 387 nt, synthetic construct
  misc_feature 1..387: note = derived and/or modified sequence opt6 from anti-influenza_Chain
  source 1..387: mol_type = other RNA
gaagtacaattagtagaaagtggaggagatctagtacaaccaggaagaagtttaaaattaagttgtacaggaagtggatttacatttggagattatggagtaacatgggtaagacaagcaccaggaaaaggattagaatgggtaggatttataaggacaagaccatggggaggaacagcagatacagcagcaagtgtaaaaggaagatttacaataagtagagatgatagtaaaagtttagcatatttacaaatgaacagtttaaaaacagaagatacagcagtatattattgttgtagagatgcaccaccaaatgtagaagtagcaagtatgacaaattggtattttgatttatggggaagaggaacattagtaacagtaagtagt

SEQ ID NO: 50925 - RNA, 387 nt, synthetic construct
  misc_feature 1..387: note = derived and/or modified sequence opt6 from anti-influenza_Chain
  source 1..387: mol_type = other RNA
gaagtacaattagtacaaagtggaagtgaagtaaaaaaaccaggagaaagtttaaaaataagttgtaaaggaagcggatatagttttagtaattattggataggatgggtaagacatatgccaggaaaaggattagaatggatgggaataatatatccaggagatagtgatacaagatatagtccaagttttcaaggacaagtaacaatgagtgcagataaaagtagtagtacagtatatttacaatggagtagtttaaaagcaagtgatacagcaatatattattgtgcaagaagaggaggacatagttttggatatggaagtggaggagatacacatagtgaatttgatagttggggacaaggaacattagtaacagtaagtagc

SEQ ID NO: 50926 - RNA, 387 nt, synthetic construct
  misc_feature 1..387: note = derived and/or modified sequence opt6 from anti-influenza_Chain
  source 1..387: mol_type = other RNA
caagtacaactactagaaacaggaggaggattagtaaaaccaggacaaagtttaaaattaagctgtgcagcaagcggattcacattcacaagctatgcaatgcactgggtaagacaaccaccaggaaaaggattagaatgggtagcagtagtatcatacgatggaaattacaaatactatgcagatagcgtacaaggaagatttacaataagcagagacaatagcaaaaacacattatatctacaaatgaatagcttaagagcagaagatacagcagtatattactgtgcaaaagactcacgactaagatcactattatactttgaatggctatcacaaggatactttaacccatggggacaaggaacaacattaacagtatcaagc

SEQ ID NO: 50927 - RNA, 387 nt, synthetic construct
  misc_feature 1..387: note = derived and/or modified sequence opt6 from anti-influenza_Chain
  source 1..387: mol_type = other RNA
caagtacaattagtagaaagcggagcagaagtaaaaaaaccaggagcaagcgtaaaattaagttgtacagcaagtggatacaatttcgcagcatattacatacactgggtaagacaagcaccaggacaaggactagaatggatgggatggagcaatccaaatacaggaggagcaaactatgcacaagactttcaaggaagagtaacaatgacagcggtaacaagtacaagcacagcatatatggaactatcaagattaacatcagacgatacagcactatatttctgtgcaagagtaccaagagatagattactaacactatattacgaaagctcaacatatggatttgactattggggacaaggaacattagtaacagtatcaagc

SEQ ID NO: 50928 - RNA, 387 nt, synthetic construct
  misc_feature 1..387: note = derived and/or modified sequence opt6 from anti-influenza_Chain
  source 1..387: mol_type = other RNA
caagtacaattagtagaaagtggaggagggctagtacaaccaggaggaagtttaagattaagttgtacagtaagtggatttacatttaatagttatgcaatgaattgggtaagacaagcaccaggaaaaggattagaatgggtaagtggaataagaggaagtggagaaaatacatattatgcagaaacagtaaaaggaagatttacaataagcagagataatagtaaaaatacattatatctagaaatgaatagtttaagagcagaagatacagcagtatattattgtgcaagaaaatggggaagaatgacagtatttggagtagcaacagatcaattatattattttgattattggggacaaggaacattagtaacagtaagtagt

SEQ ID NO: 50929 - RNA, 387 nt, synthetic construct
  misc_feature 1..387: note = derived and/or modified sequence opt6 from anti-influenza_Chain
  source 1..387: mol_type = other RNA
caagtacaattagtagaatcaggaccaggattagtaaaaccatcacaaacactatcactaacatgcacagtatcaggaggatcaatatcaaacggaggataccactggtcatggataagacaacacccaggaaaaggactagaatggataggaaacatatactacagaggatcaacattctacgacccatcactaaaatcaagagtaacaatatcagtagacacatcaaaatcacaattctcactaaaattaacatcagtaacagcagcagacacagcagtatactactgcgcaagaatgccactagcaaactacgacctactaacaggactatacataggagcattcgacttatggggacaaggaacaatggtaacagtatcatca

SEQ ID NO: 50930 - RNA, 387 nt, synthetic construct
  misc_feature 1..387: note = derived and/or modified sequence opt6 from anti-influenza_Chain
  source 1..387: mol_type = other RNA
caagtacaattagtagaaagtggagcagaagtaaaaaaaccaggagcaagtgtaagagtaagttgtaaaggaagtggatatacatttacagcatatcatatgcattgggtaagacaagcaccaggacaaggatttgaatgggtaggatggataaatccaaatagtggagcaacatattatacaagtacatttgaaggaagagtaacaatgacaagagatacaagtataacaacagcatatatggaattaagtagtttaagaagtgatgatacagcagtatattattgtgcaacagatatagtagtagaaagagatgcaagtttaggaggatttaatagttatggaatggatgtatggggacaaggaacaacagtaacagtaagtagt

SEQ ID NO: 50931 - RNA, 390 nt, synthetic construct
  misc_feature 1..390: note = derived and/or modified sequence opt6 from anti-influenza_Chain
  source 1..390: mol_type = other RNA
caagtacaattacaacaatggggagcaggattattaaaaccaagtgaaacattaagtttaacatgtgcagtatacggaggatcattcagtgtatcaggatattactggagttggataagacaaccaccaggaagaggactagaatggataggagaaatatcacacggaggaagtacaaattacaatccatcactaaaaagtagagtaacaatatcagtagatacaacaaaaaatcaatttagcttaagattaagtagtgtaacagcagcagacacagcagtatattattgcgcaagaggaacagatccagatacagaagtatattgcagagtaggaaactgtgcagcatttgattactggggacaaggaagtctagtaacagtaagttca

SEQ ID NO: 50932 - RNA, 390 nt, synthetic construct
  misc_feature 1..390: note = derived and/or modified sequence opt6 from anti-influenza_Chain
  source 1..390: mol_type = other RNA
caagtacaactactagaaagcggaccaggattagtaaaaccaagccaaacattactactaacatgtacagtaagcggagcatcaatatcaacaggaggaaattactggtcatggataagacaacatccaggaaaagatctagaatggataggatatatattttactcaggaacaacaaaatacaatccatcagtagataacccaagcctaaaatcaagagtaacaatgtcagtagacacaagcgaaaaccaattctcactaaaactatcaagcgtaacagcagcagatacagcagtatatttctgtgcaagaggatcaccaaatagtggatacgattggggaccacatttcgattactggggacaaggaacattagtaacagtatcatca

SEQ ID NO: 50933 - RNA, 390 nt, synthetic construct
  misc_feature 1..390: note = derived and/or modified sequence opt6 from anti-influenza_Chain
  source 1..390: mol_type = other RNA
gaagtacaattagtagaaagcggaggacatttagtacaaccaggaagaagcttaagactaagctgtgcagcaagcggattcacattcgaagactatgcaatgaattgggtaagacaagcaccaggaaaaggactagaatgggtaagtgtaatatcatgggatagcggaagaataggatatgcagatagcgtaaaaggaagatttacaataagcagagacaatgcaaaaaactcaagctatctacaaatgaatagcttaagaccagaagatacagcattatattactgtgtaagagacatgctagcatactatagcgataactcaggaaaaaaatataacgtatacggaatggatgtatggggacaaggaacaacagtaacagtaagctca

SEQ ID NO: 50934 - RNA, 390 nt, synthetic construct
  misc_feature 1..390: note = derived and/or modified sequence opt6 from anti-influenza_Chain
  source 1..390: mol_type = other RNA
gaagtacaattagtagaaagtggaggaggattagtacaaccaggaagaagtttaagattaagctgtgcagtaagtggatttatatttgaagattatgcaataaattgggtgagacaagcaccaggaaaaggattagaatgggtaagtataataagttgggatagtggaagaataggatatgcagatagtgtgagaggaagatttacaataagtagagataatgcaaaaaatagtagttttttacaaatgaatagtttaagaccagaagatacagcagtatattattgtgtaaaagatatgttagcatattattatgatggaagtggaataaggtataatttatatggaatggatgtatggggacaaggaacaacagtgacagtaagtagt

SEQ ID NO: 50935 - RNA, 390 nt, synthetic construct
  misc_feature 1..390: note = derived and/or modified sequence opt6 from anti-influenza_Chain
  source 1..390: mol_type = other RNA
gaagtacaattagtagaaagtggaggaggattagtacaaccaggaagaagtttaagattaagctgtgcagtaagtggatttatatttgaagattatgcaataaattgggtaagacaagcaccaggaaaatgtttagaatgggtaagtataataagttgggatagtgggagaataggatatgcagatagtgtaagaggaagatttacaataagtagagataatgcaaaaaatagtagttttttacaaatgaatagtttaagaccagaagatacagcagtatattattgtgtaaaagatatgttagcatattattatgatggaagtggaataagatataatttatatggaatggatgtatggggacaaggaacaacagtaacagtaagtagt

SEQ ID NO: 50936 - RNA, 396 nt, synthetic construct
  misc_feature 1..396: note = derived and/or modified sequence opt6 from anti-influenza_Chain
  source 1..396: mol_type = other RNA
caaataacattaaaagaaagcggaccaacattagtaaaaccgacacaaacattaacattaacatgtgtatttagcggattctcactatcaataacaggagtaagagtaggatggataagacaaccaccaggaaaagcactagaatggttagcattaatatcatgggatgacgaaaaacattactcaccatcactacaaagcagactaacaataacaaaagatacaagcaaaaatcaagtagtattaacaatgacaaatttagatccagtagacacagcaacatactattgcgcaagatcaacagatagaggacacgtactaagatactttggatggatgttaccaggagacgcattcgatgtatggggacaaggaacaatggtaacagtatcatca

SEQ ID NO: 50937 - RNA, 396 nt, synthetic construct
  misc_feature 1..396: note = derived and/or modified sequence opt6 from anti-influenza_Chain
  source 1..396: mol_type = other RNA
caagtacaactacaagaaagcggaccaggattagtaaaaccaagcgaaacactatcattaacatgtacagtaagctcaggaccaatgtcagactattactggagctggataagacaaccaccaggaaaaggactagaatggataggacatgtatcagtatcacacggaggaagaacaaaaagcaatccatcagtaatgagtagagtaacaatatcagtagaaacaagcaaaaatcaatttagcttaaaattaacatcagtaacagcagcagacacagcagtgtactattgcgcaagattaaactattacgatagatcaggatatcactcaccagatggaccaagcaataactggttcgatccatggggacaaggaacattagtaacagtaagctca

SEQ ID NO: 50938 - RNA, 396 nt, synthetic construct
  misc_feature 1..396: note = derived and/or modified sequence opt6 from anti-influenza_Chain
  source 1..396: mol_type = other RNA
caagtacaattagtacaatcaggagcagaagtaaaaaaaccaggagcaagcgtaaaagtatcatgcaaaacatcaggatacacattcacagcatacacaatacactgggtaagacaagcaccaggacaaagactagaatggatgggatggataaacgcaggaaacggacacacaaaatactcacaaagattcaaaggaagagtaacaataacaagagacacaagcgcaagaacaacatacatggaactaagaagcctaacatcagaagacacagcattatacttctgcgcaagaggaccagaaacatactactacgacaaaacaaactggctaaattcacacccagacgaatacttccaacactggggacacggaacacaagtaacagtatcatca

SEQ ID NO: 50939 - RNA, 399 nt, synthetic construct
  misc_feature 1..399: note = derived and/or modified sequence opt6 from anti-influenza_Chain
  source 1..399: mol_type = other RNA
caagtacaattagtacaaagcggaagtgaagtaaaaaaaccaggagcaagcgtaaaagtaagctgtaaagcaagtggatacacattcacaaactatgacataaactggataagacaagcaccaggacaaggactagaatggatgggatggataaatccaaatagcggaacaacaggatcagcacaaagatttcaaggaagagtaacaataacagtagacacaagcataacaacagtatatatggaactatcaagtttaagatcggacgatacagcaatatattactgtgcaagaggaagagaattattaagactacaacactttctaacagactcacaatcagaaagaagagattgctttgacccatggggacaaggaacactagtaacagtatcaagc

SEQ ID NO: 50940 - RNA, 402 nt, synthetic construct
  misc_feature 1..402: note = derived and/or modified sequence opt6 from anti-influenza_Chain
  source 1..402: mol_type = other RNA
gaagtacaattagtagaaagcggaggcggattagtaaaaccaggaggaagcctaagattaagttgtgcagcaagtggactatcatttttaaatgcatggatgagctgggtaagacaagcaccaggaaaaggactagaatgggtaggaagaataaaaagtaatacagatggaggaacaacagactatgcagcaccagtaaaaggaagatttacaataagtagagacgatagtaaaaatacactatatttacaaatgagtagtttaaaaacagaagatacagcagtatattactgtacaacagacggaccatatagcgatgactttagaagtggatatgcagcaagatatagatatttcggaatggatgtatggggacaaggaacaacagtaacagtaagtagt

SEQ ID NO: 50941 - RNA, 402 nt, synthetic construct
  misc_feature 1..402: note = derived and/or modified sequence opt6 from anti-influenza_Chain
  source 1..402: mol_type = other RNA
gaagtacaattagtagaaagcggaggaggattagtaaaaccaggaggaagtttaagattaagttgtgcagcaagcggattcagctttttaaatgcatggatgagttgggtaagacaagcaccaggaaaaggactagaatgggtaggaagaataaaaagtaatacagatggaggaacaacagattatgcagcaccagtaaaaggaagatttacaataagcagagacgatagtaaaaatacattatatttacaaatgagtagtttaaaaacagaagatacagcagtatattactgtacaacggacggaccatatagtgatgactttagaagtggatatgcagcaagatatagatattttggaatggatgtatggggacaaggaacaacagtaacagtaagtagt

SEQ ID NO: 50942 - RNA, 402 nt, synthetic construct
  misc_feature 1..402: note = derived and/or modified sequence opt6 from anti-influenza_Chain
  source 1..402: mol_type = other RNA
gaagtacaattagtagaaagcggaggaggattagtaaaaccaggaggaagcctaagactaagctgtgcagcaagcggactaacattcttaaacgcatggatgagctgggtaagacaagcaccaggaaaaggactagaatgggtaggaagaataaaaagtaatacagatggaggaacaacagactatgcagcaccagtaaaaggaagatttacaataagcagagacgatagcaaaaacacactatatctacaaatgagtagcttaaaaacagaagatacagcagtatattactgtacaacagacggaccatatagcgatgactttagatcaggatatgcagcaagatatagatatttcggaatggatgtatggggacaaggaacaacagtaacagtaagctca

SEQ ID NO: 50943 - RNA, 402 nt, synthetic construct
  misc_feature 1..402: note = derived and/or modified sequence opt6 from anti-influenza_Chain
  source 1..402: mol_type = other RNA
gaagtacaattagtagaaagcggaggaggattagtaaaaccaggaggaagtttaagattaagttgtgcagcaagtggatttagttttagtaatgcatggatgagttgggtaagacaagcaccaggaaaaggattagaatgggtaggaagaataaaaagtaatacagatggaggaacaacagattatgcagcaccagtaaaaggaagatttacaataagtagagatgatagtaaaaatacattatatttacaaatgagtagtttaaaaacagaagatacagcagtatattactgtacaacagacggaccatatagtgatgactttagaagtggatatgcagcaagatatagatattttggaatggatgtatggggacaaggaacaacagtaacagtaagtagt

SEQ ID NO: 50944 - RNA, 402 nt, synthetic construct
  misc_feature 1..402: note = derived and/or modified sequence opt6 from anti-influenza_Chain
  source 1..402: mol_type = other RNA
gaagtacaattagtagaaagtggaggaggattagtaaaaccaggaggaagtttaagactaagttgtgcagcaagtggattaacatttagtaatgcatggatgagttgggtaagacaagcaccaggaaaaggattagaatgggtaggaagaataaaaagtaatacagatggaggaacaacagattatgcagcaccagtaaaaggaagatttacaataagtagagacgatagtaaaaatacattatatttacaaatgagtagtttaaaaacagaagatacagcagtatattactgtacgacagacggaccatatagtgatgactttagaagtggatatgcagcaagatatagatattttggaatggatgtatggggacaaggaacaacagtaacagtgagtagt

SEQ ID NO: 50945 - RNA, 402 nt, synthetic construct
  misc_feature 1..402: note = derived and/or modified sequence opt6 from anti-influenza_Chain
  source 1..402: mol_type = other RNA
gaagtacaattagtagaaagcggaggaggattagtaaaaccaggaggaagtttaagattaagctgtgcagcgtcaggatttacatttagtaatgcatggatgagctgggtaagacaagcaccaggaaaaggattagaatgggtaggaagaataaaaagtaatacagatggaggaacaacagactatgcagcaccagtaaaaggaagatttacaataagtagagacgatagtaaaaatacactatatttacaaatgagtagtctaaaaacagaagatacagcagtatattattgtacaacagacggaccatatagtgatgactttagaagtggatatgcagcaagatatagatattttggaatggatgtatggggacaaggaacaacagtaacagtaagtagt

SEQ ID NO: 50946 - RNA, 402 nt, synthetic construct
  misc_feature 1..402: note = derived and/or modified sequence opt6 from anti-influenza_Chain
  source 1..402: mol_type = other RNA
gaagtacaattagtagtaagtggaggaggattagtaaaaccaggaggaagtttaagattaagttgtgcagcaagtggattaagttttctaaatgcatggatgagttgggtaagacaagcaccaggaaaaggattagaatgggtaggaagaataaaaagtaatacagatggaggaacaacagattatgcagcaccagtaaaaggaagatttagtataagtagagatgatagtaaaaatatgttatttttacatatgagtagtttaagaacagaagatacagcagtatattattgtgcaacagatggaccatatagtgatgattttagaagtggatatgcagcaagatatagatattttggaatggatgtatggggacaaggaacaacagtaacagtaagtagt

SEQ ID NO: 50947 - RNA, 402 nt, synthetic construct
  misc_feature 1..402: note = derived and/or modified sequence opt6 from anti-influenza_Chain
  source 1..402: mol_type = other RNA
gaagtgcaattagtagtaagtggaggaggattagtaaaaccaggaggaagtttaagattaagttgtgcagcaagtggattatcatttttaaatgcatggatgagctgggtaagacaagcaccaggaaaatgtttagaatgggtaggaagaataaaaagtaatacagatggaggaacaacagattatgcagcaccagtaaaaggaagatttagtataagtagagatgatagtaaaaatatgttatttttacatatgagtagtttaagaacagaagatacagcagtatattattgtgcaacagatggaccatatagtgatgattttagaagtggatatgcagcaagatataggtattttggaatggatgtatggggacaaggaacaacagtaacagtaagtagt

SEQ ID NO: 50948 - RNA, 402 nt, synthetic construct
  misc_feature 1..402: note = derived and/or modified sequence opt6 from anti-influenza_Chain
  source 1..402: mol_type = other RNA
gaagtacaattagtagtaagtggaggaggattagtaaaaccaggaggaagtttaagattaagttgtgcagcaagtggattaagttttctaaatgcatggatgagttgggtaagacaagcaccaggaaaaggattagaatgggtaggaagaataaaaagtaatacagatggaggaacaacagattatgcagcaccagtaaaaggaagatttagtataagtagagatgatagtaaaaatatgttatttttacatatgagtagtttaagaacagaagatacagcagtatattattgtgcaacagatgggccatatagtgatgattttagaagtggatatgcagcaagatatagatattttggaatggatgtatggggatgtggaacaacagtaacagtaagtagt

SEQ ID NO: 50949 - RNA, 402 nt, synthetic construct
  misc_feature 1..402: note = derived and/or modified sequence opt6 from anti-influenza_Chain
  source 1..402: mol_type = other RNA
gaagtacaattagtagaaagcggaggaggattagtaaaaccaggaggaagcctaagattaagctgtgcagcaagcggattcacatttttaaacgcatggatgagctgggtaagacaagcaccaggaaaaggattagaatgggtaggaagaataaaaagcaatacagatggaggaacaacagactatgcagcaccagtaaaagggagatttacaataagcagagacgatagtaaaaatacactatatctacaaatgagtagtttaaaaacagaagatacagcagtatattactgtacaacagacggaccatatagtgatgactttagaagtggatatgcagcaagatatagatatttcggaatggatgtatggggacaaggaacaacagtaacagtaagtagt

SEQ ID NO: 50950 - RNA, 402 nt, synthetic construct
  misc_feature 1..402: note = derived and/or modified sequence opt6 from anti-influenza_Chain
  source 1..402: mol_type = other RNA
gaagtacaattagtagaaagtggaggaggattagtaaaaccaggaggaagtttaagattaagctgtgcagcaagcggattcacattcttaaacgcatggatgagctgggtaagacaagcaccaggaaaatgtctagaatgggtgggaaggataaaaagcaatacagatggaggaacaacagactatgcagcaccagtaaaaggaagatttacaataagcagagacgatagtaaaaacacactatatctacaaatgtcaagcctaaaaacagaagatacagcagtatattactgtacaacagacggaccatatagtgatgactttagaagtggatatgcagcaagatatagatatttcggaatggatgtatggggacaaggaacgacagtaacagtaagctca

SEQ ID NO: 50951 - RNA, 402 nt, synthetic construct
  misc_feature 1..402: note = derived and/or modified sequence opt6 from anti-influenza_Chain
  source 1..402: mol_type = other RNA
gaagtacaattagtagaaagcggaggaggattagtaaaaccaggaggatcattaagattaagctgtgcagcaagcggattcacattcttaaacgcatggatgagctgggtaagacaagcaccaggaaaaggattagaatgggtaggaagaataaaaagtaatacagatggaggaacaacagactatgcagcgccagtaaaaggaagatttacaataagcagagacgatagcaaaaacacactatatctacaaatgagcagcttaaaaacagaagatacagcagtatattactgtacaacagacggaccatatagcgatgactttagatcaggatatgcagcaagatatagatatttcggaatggatgtatggggatgtggaacaacagtaacagtaagctca

SEQ ID NO: 50952 - RNA, 414 nt, synthetic construct
  misc_feature 1..414: note = derived and/or modified sequence opt6 from anti-influenza_Chain
  source 1..414: mol_type = other RNA
caagtacaattacaagaaagtggaggaggattagtacaaccaggagaaagtttaagattaagctgtgtaggaagtggaagtagttttggagaaagtacattaagttattatgcagtaagttgggtaagacaagcaccaggaaaaggattagaatggttaagtataataaatgcaggaggaggagatatagattatgcagatagtgtagaaggaagatttacaataagtagagataatagtaaagaaacattatatttacaaatgacaaatttaagagtagaagatacaggagtatattattgtgcaaaacatatgagtatgcaacaagtagtaagcgcaggatgggaaagagcagatttagtaggagacgcatttgatgtatggggacaaggaacaatggtaacagtaagcagt

SEQ ID NO: 50953 - RNA, 465 nt, synthetic construct
  misc_feature 1..465: note = derived and/or modified sequence opt6 from anti-influenza_Chain
  source 1..465: mol_type = other RNA
ctatcaagaataaaccacttcgaaaaaatacaaataatcccaaaatcatcatggtcagaccacgaagcatcatcaggagtatcctcagcatgcccataccaaggaacaccatcattcttcagaaacgtagtatggctaataaaaaaaaacaacacatacccaacaataaaaagatcatacaacaacacaaaccaagaagacctactaatactatggggaatacaccactccaacgacgcagcagaacaaacaaaactataccaaaacccaaccacatacatatcagtaggcacatcaacactaaaccaaagactagtaccaaaaatagcaacaagatcaaaagtaaacggacaaaacggacgaatggacttcttctggacaatactaaaaccaaacgacgcaataaacttcgaatcaaacggaaacttcatagcaccagaatacgcatacaaaatagtaaaaaaa

SEQ ID NO: 50954 - RNA, 564 nt, synthetic construct
  misc_feature 1..564: note = derived and/or modified sequence opt6 from anti-influenza_Chain
  source 1..564: mol_type = other RNA
aacgtaccagaatggagctacatagtagaaaaagcaaacccagcaaacgacctatgctaccccggaaacttcaacgactacgaagaactaaaacacctattatcaagaataaaccacttcgaaaaaatacaaataataccaaaatcatcatggtcagaccacgaagcatcatcaggagtctcatcagcatgcccataccaaggaacaccatcattctttagaaacgtagtatggctaataaaaaaaaacaatacatacccaacaataaaaagatcatacaacaacacaaaccaagaagacctactaatactatggggaatccaccactcaaacgacgcagcagaacaaacaaaactataccaaaacccaacaacatacatatcagtaggaacatcaacactaaaccaaagactagtaccaaaaatagcaacaagatcaaaagtaaacggacaaaacggcagaatggacttcttctggacaatactaaaaccaaacgacgccataaacttcgaatccaacggaaacttcatagcaccagaatacgcatacaaaatagtaaaaaaa

SEQ ID NO: 50955 - RNA, 609 nt, synthetic construct
  misc_feature 1..609: note = derived and/or modified sequence opt6 from anti-influenza_Chain
  source 1..609: mol_type = other RNA
atgcttagatcactagtcctaaacgaaaaactaagagcaagagtactagaaagagcagaagaattcctcctaaacaacaaagcagacgaagaagtatggttcagagaactagtactatgcatactaacatcaaacagctcattcatatccgcatacaaaagcatgaactacatactagacaaaatactatacatggacgaaaaagaaatatcaatcttattacaagaatcaggctacagattctacaacctaaaagcaaaatacctatacagagcaaaaaacctatacggaaaagtaaaaaaaacaataaaagaaatagcagataaagaccaaatgcaagccagagaattcatagcaacacatatatacggaataggatacaaagaagcatcacacttcctaagaaatgtaggatacctagacctagcaataatagacagacacatattaagattcataaacaaccttggaataccaataaaactaaaatcaaaaagagaatacctactagcagaatcactactaagatcaatagcaaacaacctaaacgtacaagtaggactactagacctattcatattcttcaaacaaacaaacacaatagtaaaa

SEQ ID NO: 50956 - RNA, 615 nt, synthetic construct
  misc_feature 1..615: note = derived and/or modified sequence opt6 from anti-influenza_Chain
  source 1..615: mol_type = other RNA
ggattattcggagcaatagcaggattcatagaaggaggatggacaggaatggtagacggatggtacggataccaccaccaaaacgaacaaggaagtggatacgcagcagacctcaaaagtacacaaaacgcaatagacgaaataacaaacaaagtaaacagcgtaatagaaaaaatgaacacacaattcacagcagtaggaaaagaattcaaccacctagaaaaaagaatagaaaacttaaacaaaaaaatagacgacggattcctagacatatggacatacaacgcagaactactagtattactagaaaacgaaagaacactagactaccacgacagtaacgtaaaaaacctatacgaaaaagtaagaagccaactaaaaaacaatgcaaaagaaataggaaacggatgcttcgaattctaccacaaatgcgacaacacatgcatggaatcagtaaaaaacggaacatacgactacccaaaatactcagaagaagcaaaactaaacagagaagaaatagacggagtaaaactagaaagtacacgaatataccaaatcctagcaatatattcaacagtagcatcaagtttagtattagtagtaagcctaggagcg

SEQ ID NO: 50957 - RNA, 639 nt, synthetic construct
  misc_feature 1..639: note = derived and/or modified sequence opt6 from anti-influenza_Chain
  source 1..639: mol_type = other RNA
gaaatagttctaacacaatcaccaggaacactatcactatcaccaggcgaaagagcaacattatcatgcagagcatcacaacgagtctcatcatacttagcatggtaccaacaaaaaccaggacaagcaccaagactcttaatatacggagcatcaacaagagcagcaggaataccagaccgtttctcaggatccggatcaggcacagacttcacattaacaatatcaagattagaaccagaagactcagcagtatactactgccaacaatacggaagaacaccattaacattcggaggcggaacaaaagtagaaataaaaagagcagcagcaccatcagtatttatattcccaccatcagacgaacaactaaaatcaggaaccgcatcagtagtatgcttactaaacaacttctacccaagagaagcaaaagtacaatggaaagtagacaacgcactacaatcaggaaactcacaagaatcagtaacagaacaagactcaaaagactcaacatactcactatcctccacattaaccctatcaaaagcagactacgaaaaacacaaagtatacgcatgcgaagtaacacaccaaggactctcatcaccagtaacaaaatcattcaacagaggagaatgc

SEQ ID NO: 50958 - RNA, 639 nt, synthetic construct
  misc_feature 1..639: note = derived and/or modified sequence opt6 from anti-influenza_Chain
  source 1..639: mol_type = other RNA
gacatacaaatgacacaatccccatcctctttatcagcatcactaggaggaaacgtcacaataacatgcaaagcatcacaagacataaataaatatatagcatggtaccaacacaaaccaggaaaaggaccaagattagtaatacactacacatccacactacaaccaggcataccatcaagattctccggatcaggatcaggaacagactactcattctcaatatcaaacctagaaccagaagacatagccacatactactgtctccaatatgacatattatacaccttcggaggaggaaccaaactagaaataaaaagagcagacgcagcaccaacagtatcaatattcccaccatcatcagaacaattaacatcaggaggagcctcagtagtatgcttcttaaacaacttttacccaaaagacataaacgtaaaatggaaaatagacggatcagaacgacaaaatggagtactaaattcatggacagaccaagactcaaaagactcaacatactcaatgtcatcaacactcacactaacaaaagacgaatacgaaagacacaactcctacacatgcgaagcaacacacaaaacctcaacatcaccaatagtaaaatccttcaacagaaacgaatgc

SEQ ID NO: 50959 - RNA, 642 nt, synthetic construct
  misc_feature 1..642: note = derived and/or modified sequence opt6 from anti-influenza_Chain
  source 1..642: mol_type = other RNA
gacatacaaatgacacaatcaccatcttcactatcagcatcagtcggagacagagtaacaataacatgcagagcatcacaaggcatatcctcatacctagcatggtaccaacaaaaaccaggaaaagtaccaacactattaatctacgatgcatcaacacttcgatcaggagtaccatccagattctcaggctcaggatcagcaacagacttcacactaacaatatcctcactccaaccagaagacgtagccacatactactgccaaagatacaactcagcaccacccataacattcggccaaggtacacgactagaaataaaaagagcagcagcaccatccgtattcatattcccaccctcagatgaacaactaaaatcaggcacagcatcagtagtatgcctattaaacaacttctacccccgcgaagcaaaagtacaatggaaagtagataacgcactccaatcaggaaactcacaagaatcagtaacagaacaagactcaaaagactcaacatactcattatcatcaacactaacattatcaaaagccgactacgaaaaacacaaagtatacgcatgcgaagtaacacaccaaggattatcctcaccagtaactaaatcattcaacagaggagaatgc

SEQ ID NO: 50960 - RNA, 642 nt, synthetic construct
  misc_feature 1..642: note = derived and/or modified sequence opt6 from anti-influenza_Chain
  source 1..642: mol_type = other RNA
gaaatagtattaacacaatcacccggaacattaagcctaagcccaggagaaagagcaacattaagctgtagagcaagtcaaagcgtaagttcaagctatctagcatggtatcaacaaaaaccaggacaagcaccaagactactaatatacggagcatctagcagagcaacaggaataccagatagatttagcggaagcggatcaggaacagatttcacattaacaatatcaagattagaaccagaagatttcgcagtatattactgccaacaatacggaagctctccaagaacatttggaggaggaacaaaagtagaaataaaaagagcagcagcaccaagcgtatttatattcccaccctcagacgaacaattaaaatcaggcacagcatcagtagtatgcttactcaacaacttttacccaagagaagcaaaagtacaatggaaagtagataacgcactacaaagcggaaactcacaagaatcagtaacagaacaagatagcaaagactcaacatattcattaagctcaacattaacattatcaaaagcagactacgaaaaacataaagtatacgcatgcgaagtaacacaccaaggattaagctcaccagtaacaaaatcatttaacagaggcgaatgc

SEQ ID NO: 50961 - RNA, 642 nt, synthetic construct
  misc_feature 1..642: note = derived and/or modified sequence opt6 from anti-influenza_Chain
  source 1..642: mol_type = other RNA
tcctacgtattaacacaaccaccatcagtatcagtagccccaggagaaacagcaacagtaacatgcggaggaaacaacataggctcaaaatcagtacactggtaccaacaaaaacccggtcaagcaccagtagtagtaatctactacgacggagacagaccatcaggaataccagaaagattctcaggatcaaactcaggagacacagcaacactaacaatatccagagtagaagcaggagacgaagcagactactactgtttagtatgggactacacaagcgtacattacgtatttggaacaggaacaaaagtaacagtactaggacaaccaaaagcaaacccaacagtaacattattcccaccaagctcagaagaactacaagcaaataaagcaacactagtatgcctaatatcagacttctatccaggagcagtaacagtagcatggaaagcagacggatcaccagtaaaagcaggagtagaaactacaaaaccatcaaaacaatcaaacaataaatacgcagcatcatcatacctatcattaacaccagaacaatggaaatcacacagaagttactcatgtcaagtaacacacgaaggatcaacagtagaaaaaacagtagcaccaacagaatgctca

SEQ ID NO: 50962 - RNA, 642 nt, synthetic construct
  misc_feature 1..642: note = derived and/or modified sequence opt6 from anti-influenza_Chain
  source 1..642: mol_type = other RNA
gacatacaaatgacacaaacatcatcaagcctatcagcatcattaggcgaccgagtaacaatatcctgccgagcatcacaagacataagaaactacctaaactggtaccaacaaaaacccgacggaacagtaaaacttctaatatactacacatcaagattacattcaggagtaccatcaagattctcagactcaggatcaggaacagactactccctaacaatatcaaacctagaacaagaagacctagcaacatacttctgccaacaaacatacacattaccatggacattcggaggaggaacaaaactagaaataaaaagagcagatgcagcaccaacagtatcaatattcccaccatcatcagaacaactaacatcaggaggagcatcagtagtctgcttcctaaacaacttctacccaaaagacataaacgtaaaatggaaaatagacggatcagaaagacaaaacggagtactcaattcctggacagaccaagactcaaaagactcaacatactcaatgtcatcaacactaacactaacaaaagacgaatacgaaagacacaactcatacacatgcgaagcaacacacaaaacatctacctcaccaatagtaaaatccttcaatagaaacgaatgc

SEQ ID NO: 50963 - RNA, 645 nt, synthetic construct
  misc_feature 1..645: note = derived and/or modified sequence opt6 from anti-influenza_Chain
  source 1..645: mol_type = other RNA
gacggagtaaaaccactaatattaagagactgctcagtagcaggatggctactaggaaacccaatgtgcgacgaattcataaacgtaccagaatggtcatacatagtagaaaaagcaaacccagcaaacgacttatgctacccaggaaactttaacgactacgaagaactaaaacacctactatcaagaataaaccacttcgaaaaaatacaaataataccaaaatcatcatggagcgaccacgaagcatcatcaggagtatcatcagcatgcccataccaaggaacaccatcattcttcagaaacgtagtatggttaataaaaaaaaacaacacatacccaacaataaaaagatcatataacaacacaaaccaagaagacctactaatactatggggaatacaccacagcaacgacgccgcagaacaaacaaaactataccaaaacccaacaacatacatatcagtaggaacaagcacactaaaccaaagactcgtaccaaaaatagcaacacgaagcaaagtaaatggacaaaacggaagaatggacttcttctggacaatattaaaaccaaacgacgcaataaacttcgaatcaaacggaaacttcatagcaccagaatacgcatacaaaatagtaaaaaaa

SEQ ID NO: 50964 - RNA, 645 nt, synthetic construct
  misc_feature 1..645: note = derived and/or modified sequence opt6 from anti-influenza_Chain
  source 1..645: mol_type = other RNA
gacatacaaatgacacaatcaccatcaacactatcagcatcagtaggcgacagagtaaccataacatgcagagcatcacaaacaataaacaactatctagcatggtaccaacaaaaaccaggaaaagcaccaaaactactaatatataaagcatcatcactagaatcaggagtaccatcacgattcagcggatcaggatcaggaacagaatttacactaaccatatcttcactacaaccagacgacttcgcaacatactactgccaagaatacaacaacgacagcccactaacattcggaggaggaacaaaagtagaaataaaaagaacagtagcagcaccatcagtattcatattcccaccatcagacgaacaactaaaatcaggaacagcatctgtagtatgcctactaaacaacttctacccaagagaagcaaaagtacaatggaaagtagacaacgcattacaaagtggaaactcacaagaatcagtaacagaacaagactcaaaagactcaacatactcattatcatcaacactaaccttatcaaaagcagactacgaaaaacacaaagtatacgcatgcgaagtaacacaccaaggactctcatcaccagtaacaaaatcattcaacagaggagaatgc

SEQ ID NO: 50965 - RNA, 645 nt, synthetic construct
  misc_feature 1..645: note = derived and/or modified sequence opt6 from anti-influenza_Chain
  source 1..645: mol_type = other RNA
tcagtactaacacaaccaccatcagcatcaggatcaagaggacaatcaataacaatatcatgcaccggatcaacatcagacataggctcatacaactacgtatcatggtaccaacaacaccccggaacagcaccaaaagtaatcctatacgaagtatcacaaagaccatcaggcgtaccagacagattctcaggatccaaatcaggaaacaccgcattcctaacagtatcaggactacaagccgaagacgaagcagactactactgcgcatcatacgccggaaacaacatatacgtattcggatcaggaacaaaagtaacagtactcggacaaccaaaagcaaacccaacagtaaccctatttcccccatcatcagaagaactacaagcaaacaaagcaacactagtatgcctaatatcagacttctacccaggagcagtaacagtcgcatggaaagcagactcatcaccagtaaaagcaggagtagaaacaacaacaccatcaaaacaaagcaacaacaaatacgccgcatcatcatacttatcactaacaccagaacaatggaaatcacacaaatcatactcatgccaagtaacacacgaaggatcaacagtagaaaaaacagtagccccaacagaatgctca

SEQ ID NO: 50966 - RNA, 645 nt, synthetic construct
  misc_feature 1..645: note = derived and/or modified sequence opt6 from anti-influenza_Chain
  source 1..645: mol_type = other RNA
tcagcactaacacaaccaccatcagcatcaggatcaagaggacaatcaataacaatatcatgcacaggatcaacatcagacataggctcctacaactacgtatcatggtaccaacaacacccaggaacagcaccaaaagtcatactatacgaagtatcacaaagaccatcaggagtaccagacagattctcaggatcaaaatcaggaaacacagcatttttaacagtaagcggactacaagcagaagacgaagcagactactactgcgcatcatacgcaggaaacaacatatacgttttcggatcaggaacaaaagtaacagtactaggacaaccaaaagcaaacccaacagtaacactattcccaccatccagcgaagaactacaagcaaacaaagcaacactagtatgcctaatatcagacttctacccaggagcagtaacagtagcatggaaagcagactcctcccccgtaaaagcaggagtagaaacaacaacaccatccaaacaaagtaacaacaaatacgcagcatcatcatatctatcactaacaccagaacaatggaaatcacacaaatcatatagctgccaagtaacacacgaaggatcaaccgtagaaaaaacagtagcaccaacagaatgttca

SEQ ID NO: 50967 - RNA, 648 nt, synthetic construct
  misc_feature 1..648: note = derived and/or modified sequence opt6 from anti-influenza_Chain
  source 1..648: mol_type = other RNA
caatcagtcttaacacaaccaccatcagaatcagtatcaccaggacaaacagcatccgtaacatgctccggacacaaattaggagacaaatacgtatcatggtaccaacaaaaaccaggacaatcaccagtattattaatataccaagacaacagacgaccatcaggaataccagaaagattcatcggcagcaactcaggaaacacagcaacactaacaatatcaggaacacaagcactagacgaagcagattattactgccaagcatgggactcatcaacagcagtattcggaggaggaacaaaactaacagtactaggagcagcagcaggacaaccaaaagcagcaccatcagtaacattattcccaccatcatcagaagaattacaagcaaacaaagcaacactagtatgtctaatatcagacttctacccaggcgccgtaacagtagcatggaaagcagactcatcaccagtaaaagccggagtagaaacaacaacaccatcaaaacaaagcaacaacaaatacgccgcatcatcatacctatcactaacaccagaacaatggaaatcacaccgatcatactcatgccaagtaacacacgaaggatcaacagtcgaaaaaacagtagcaccaacagaatgctca

SEQ ID NO: 50968 - RNA, 648 nt, synthetic construct
  misc_feature 1..648: note = derived and/or modified sequence opt6 from anti-influenza_Chain
  source 1..648: mol_type = other RNA
caatcagcattaacacaaccagcatcagtatcaggatcaccaggacaatcaataacaatatcatgcacaggaacatcatcagacgtaggatcatacaacctcgtaagctggtaccaacaacatccaggaaaagccccaaaactaatgatatacgaagtaagcaaaagaccttccggagtatcaaacagattctccggatcaaaatcaggaaatacagcatcattaacaatatcaggattacaagcagaagacgaagcagactactactgccacctatacgtaggaagttcaaactgggtcttcggaggaggaaccaaactagcagtactaggacaaccaaaagcagcaccatcagtaacactatttccaccatcatcaaaagaactacaagcaaacaaagcaacactagtatgcccaatatcagacttctacccaggcgcagtaacagtagcatggaaagcagacagctcaccagtaaaagcaggagtcgaaactacaacaccatcaaaacaatcaaacaacaaatacgcagcatcatcatacctatcactaacaccagaacaatggaaatcacacaaatcatactcatgccaagtaacacatgaaggatcaacagtagaaaaaacagtagcaccaaccgaatgtagc

SEQ ID NO: 50969 - RNA, 648 nt, synthetic construct
  misc_feature 1..648: note = derived and/or modified sequence opt6 from anti-influenza_Chain
  source 1..648: mol_type = other RNA
gaaatagtactaacacaatcaccagcaacactatcagtatcaccaggagaaagagcaacattatcatgtagagcatcacaatccgtagactcaaacttagcatggtaccaacaaaaaccaggacaagcaccaagactattagtatactcagcctcaacaagagcaacaggaataccagcaagattctcaggatcaggatcaggcacagaatttacactagcaataagctcactacaatcagaagatttcgcagtatactactgccaacactacacaaactggccacccagactaacattcggaggaggatccaaagtcgaaataaaaagaacagtagcagcaccatcagtattcatattcccaccatcagacgaacaactaaaatcaggaacagcatccgtcgtatgcctattaaacaacttctacccacgagaagcaaaagtacaatggaaagtagacaacgcattacaatcaggaaactcacaagaatcagtaacagaacaagacagcaaagactcaacttattcactatcctcaacattaacattatccaaagcagattacgaaaaacacaaagtatacgcatgcgaagtaacacaccaaggtctatcctcaccagtaacaaaatccttcaacagaggtgaatgc

SEQ ID NO: 50970 - RNA, 648 nt, synthetic construct
  misc_feature 1..648: note = derived and/or modified sequence opt6 from anti-influenza_Chain
  source 1..648: mol_type = other RNA
gaaatagtactaacacaatccccagcaacactatcagtatcaccaggtgaaagagcaacactatcatgccgagcatcacaatcagtatcacacaacctagcctggtaccaacaaaaacccggacaagcaccaagactattagtatactcagcatccacaagagcaacaggaataccagcaagattctcaggatcaggatcaggaacagaatttacactagcaatatcatcactacaatcagaagacttcgcagtatactactgccaacactacacaaattacccaccaagactaacattcggcggaggatcaaaagtagaaataaaacgaacagtagcagcaccatccgtattcatattcccaccctcagacgaacaactaaaatcaggaacagcatcagtagtatgcctactaaacaacttctacccacgagaagcaaaagtacaatggaaagtagataacgcactacaatccggaaactcacaagaatcagtaacagaacaagactcaaaagactcaacttactcattatcatcaacattaaccctatcaaaagctgactacgaaaaacacaaagtatacgcatgcgaagtaacacaccaaggactatcatcacctgtaacaaaatcattcaacagaggtgaatgc

SEQ ID NO: 50971 - RNA, 648 nt, synthetic construct
  misc_feature 1..648: note = derived and/or modified sequence opt6 from anti-influenza_Chain
  source 1..648: mol_type = other RNA
gaaatagtaatgacacaatcacccgccacactatcagtatcaccaggcgaacgcgcaacattatcctgcagagcatcacaatcagtagactcaaacctagcctggtaccaacaaaaaccaggacaagcaccaagactattagtatactccgcatcaacaagagcaacaggcattccagcaagattctcaggatcaggatcaggaacagaatttacattagcaatatcatcactacaatcagaagacttcgccgtctactattgccaacattacacaaactggccaccaagattaacattcggaggaggatccaaagtagaaataaaaagaacagtcgcagcaccaagcgtattcatattcccaccatcagacgaacaattaaaatcaggaacagcctcagtagtatgcctactaaacaacttctacccaagagaagcaaaagtacaatggaaagtagacaacgcactccaatcaggaaattcacaagaatcagtaacagaacaagacagcaaagactcaacatacagcctatcctcaacactaacattatcaaaagcagactacgaaaaacacaaagtatacgcatgcgaagtaacacaccaaggactaagctcaccagtaacaaaaagtttcaacagaggagaatgc

SEQ ID NO: 50972 - RNA, 648 nt, synthetic construct
  misc_feature 1..648: note = derived and/or modified sequence opt6 from anti-influenza_Chain
  source 1..648: mol_type = other RNA
gaaatcgtactaacacaatcaccagcaacattatcagtatcaccaggagaaagagcaacattatcctgcagagcatcccaatcagtatcctcaaacctagcatggtaccaacaaaaacccggacaagcaccaagactactagtatactcagcatcaacaagagcaacaggaataccagcaagattctcaggatccggatctggaacagaattcacattagcaataagctcattacaatcagaagacttcgctgtatactactgtcaacactacaccaactggccaccaagattaacattcggaggaggatcaaaagtagaaataaaaagaacagtagcagcacccagcgtattcatattcccaccatcagatgaacaactaaaatcaggcacagcatcagtcgtatgcctactaaacaacttctacccaagagaagcaaaagtacaatggaaagtagacaacgcactccaatcaggaaactcacaagaatccgtaaccgaacaagactcaaaagactcaacatactcattatcctcaacattaaccttatcaaaagcagactacgaaaaacacaaagtatacgcatgcgaagtaacacatcaaggactatcatcaccagtaacaaaatcattcaacagaggagaatgc

SEQ ID NO: 50973 - RNA, 648 nt, synthetic construct
  misc_feature 1..648: note = derived and/or modified sequence opt6 from anti-influenza_Chain
  source 1..648: mol_type = other RNA
gaaatagtactaacacaaagcccagcaaccttaagcgtaagcccaggagaaagagcaacattaagttgtcgagcaagccaaagcgtagaccataacttagcatggtaccaacaaaaaccaggacaagcaccaaggctattagtatatagcgcaagcacaagagcaacaggaataccagccagattctcaggatcaggatcaggaacagaatttacactagcaataagctcactacaaagtgaagactttgcagtttactattgccaacactatacaaattggccaccaagactaacattcggaggaggaagcaaagtagaaataaaaagaacagtagcagccccatccgtattcatattcccaccatctgacgaacaactaaaatcaggaacagcatctgtagtatgcttactaaataacttttacccaagagaagcaaaagtacaatggaaagtagataacgcactacaaagcggaaactcacaagaaagcgtaacagaacaagactcaaaagactcaacttatagtttatcatcaacattaacattaagcaaagcagactacgaaaaacacaaagtatacgcatgcgaagtaacacaccaaggactatcatcaccagtaacaaaatcatttaacagaggcgaatgc

SEQ ID NO: 50974 - RNA, 648 nt, synthetic construct
  misc_feature 1..648: note = derived and/or modified sequence opt6 from anti-influenza_Chain
  source 1..648: mol_type = other RNA
gaaatagtactaacacaatcaccagcaaccctatcagtatcaccaggagaaagagcaacactatcatgccgagcatcacaatcagtatcacacaacctagcatggtaccaacaaaaaccaggacaagcacccagactattagtatattcagcatcaacacgagcaacaggaataccagcaagattctcaggttcaggatcaggcacagaatttacactagcaatatcatccctacaatcagaagatttcgcagtctactactgccaacactatacaaactggccaccaagactaacattcggaggcggaagcaaagtagaaataaaaagaacagtagcagcaccatcagtattcatattcccaccctcagacgaacaattaaaatcaggcacagcatcagtagtatgtttactaaacaacttctacccacgagaagcaaaagtccaatggaaagtagacaatgcactacaatctggaaactcacaagaatcagtaacagaacaagattcaaaagactcaacatactcactatcatccacactaacactatcaaaagccgactacgaaaaacacaaagtatacgcatgcgaagtaacacaccaaggactatcatcaccagtaaccaaatcattcaacagaggagaatgc

SEQ ID NO: 50975 - RNA, 648 nt, synthetic construct
  misc_feature 1..648: note = derived and/or modified sequence opt6 from anti-influenza_Chain
  source 1..648: mol_type = other RNA
gaaatagtactaacacaatcaccagcaacactatcagtatcaccaggagaaagagcaacattatcatgcagagcaagccaatcagtatcccacaacttagcctggtaccaacaaaaaccaggacaagcaccaagactattagtctactcagcatcaacacgagcaacaggcataccagcaagattctcaggatcaggctcaggaacagaatttacactagcaatatcttcactacaatcagaagacttcgcagtatactactgtcaacactacacaaacttcccaccacgactaacattcggaggaggatcaaaagttgaaataaaaagaacagtagcagccccatcagtattcatattcccaccatcagacgaacaactaaaatcaggcacagcatcagtagtatgcctactaaacaatttctacccaagagaagcaaaagtacaatggaaagtagacaacgcactacaatcaggaaactcacaagaatcagtaactgaacaagactcaaaagactcaacatactcactatcctcaacactaaccctatccaaagcagactacgaaaaacacaaagtctacgcatgcgaagtaacacaccaaggactatcctcacccgtcacaaaatcattcaacagaggagaatgc

SEQ ID NO: 50976 - RNA, 648 nt, synthetic construct
  misc_feature 1..648: note = derived and/or modified sequence opt6 from anti-influenza_Chain
  source 1..648: mol_type = other RNA
gaaatagtactaacacaaagtcctgcaacattatcagtttcaccaggagaaagagcaaccttatcatgtagagcaagccaaagtgtagactcaaacctagcatggtaccaacaaaaaccaggacaagcccccagactcttagtatatagcgcaagcacacgagcaacaggaataccagcaagattctcaggatccggctcaggaacagaatttacattagccataagctcactacaaagcgaagactttgcagtatactattgccaacactatacaaattttccaccaagactaacattcggaggagggtcaaaagtagaaataaaaagaacagtcgcagcaccaagcgtattcatattcccaccatcagacgaacaattaaaatcaggaacagcatcagtagtatgcttattaaataatttttacccaagagaagcaaaagtacaatggaaagtagataacgcattacaatcaggaaactcacaagaatcagtaacagaacaagattcaaaagactcaacatatagcttaagctcaaccttaacattatcaaaagcagattacgaaaaacataaagtatacgcctgcgaagtaacacaccaaggattatcatcaccagtaacaaaatcatttaacagaggagaatgc

SEQ ID NO: 50977 - RNA, 648 nt, synthetic construct
  misc_feature 1..648: note = derived and/or modified sequence opt6 from anti-influenza_Chain
  source 1..648: mol_type = other RNA
gaaatcgtattaacacaatcaccagccacactctcagtatcaccaggagaaagagcaacactatcatgcagagcatcacaatcagtcgactcaaacttagcatggtaccaacaaaaaccaggacaagcaccaagacttctagtatattcagcatccacaagagcaacaggaataccagcaagattctcaggatcaggatcaggaactgaatttacactagcaatatcatcactacaatcagaagactttgcagtatactactgccaacactacacaaactacccaccaagactaacattcggtggcggatcaaaagttgaaataaaacgaacagtagcagcaccaagcgtattcatattcccaccatccgacgaacaactaaaatcaggaactgcatcagtagtatgcctactaaacaacttctacccaagagaagcaaaagtacaatggaaagtagacaacgcactacaatcaggaaactcacaagaatcagtaaccgaacaagactccaaagactcaacatactcactatcatcaacactaacactatcaaaagcagactacgaaaaacacaaagtatacgcatgcgaagtaacacaccaaggattatcatctccagtaacaaaatccttcaacagaggagaatgc

SEQ ID NO: 50978 - RNA, 648 nt, synthetic construct
  misc_feature 1..648: note = derived and/or modified sequence opt6 from anti-influenza_Chain
  source 1..648: mol_type = other RNA
gaaacaacattaacacaatcaccagcaacactatcagtatcaccaggagaaagagcaacactatcatgtcgagcatcacaagtaataagccacaacctagcatggtaccaacaaaaaccaggacaagcaccaagattactaatatacggcgcatcaacaagagcatcaggcataccagcaagattctcaggatcaggatcaggaacagactatacactcacaataacatcactacaatcagaagacttcgcagtatactactgtcaacactactcaaactggccaccaagactaacattcggaggcggaacaaaagtagaaataaaaagaacagtagcagcaccaagcgtattcatatttccaccatcagacgaacaattaaaatcaggaacagcatcagtagtatgcttactaaacaacttctatccacgagaagcaaaagtacaatggaaagtagacaacgcactacaatcaggaaactctcaagaaagcgtaacagaacaagactccaaagactccacctactccctaagctcaacactaacactaagcaaagcagactacgaaaaacataaagtatacgcatgcgaagtaacacaccaaggattatcatcaccagtaacaaaatcattcaacagaggagaatgc

SEQ ID NO: 50979 - RNA, 648 nt, synthetic construct
  misc_feature 1..648: note = derived and/or modified sequence opt6 from anti-influenza_Chain
  source 1..648: mol_type = other RNA
gaaatagtactaacacaaagcccagcaaccttaagcgtaagcccaggagaaagagcaacattaagttgtagagcctcacaagtaatatcacataacttagcatggtaccaacaaaaaccaggacaagcaccaagactattaatatatggagcaagcacaagagcatcaggcataccagcaagattctcaggatcaggatcaggaacagactatacactaacaataacatcactccaatcagaagactttgcagtttactattgccaacactattcaaattggccaccaagactcacattcggaggaggaactaaagtcgaaataaaaagaacagtcgcagcaccatcagtattcatatttccaccatcagacgaacaactaaaatcaggaacagcatcagtagtatgcttactaaataacttttatccaagagaagcaaaagtacaatggaaagtagataacgcactacaatcaggaaattcacaagaatcagtaaccgaacaagacagcaaagactctacatattccttaagctcaacccttacattaagcaaagcagattacgaaaaacataaagtatacgcatgcgaagtaacacaccaaggcttaagctcaccagtaacaaaatcatttaacagaggagaatgc

SEQ ID NO: 50980 - RNA, 648 nt, synthetic construct
  misc_feature 1..648: note = derived and/or modified sequence opt6 from anti-influenza_Chain
  source 1..648: mol_type = other RNA
gaaatagtcctaacacaatcacccgcaacactatcagtatcaccaggagaaagagcaacactatcatgcagagcatcacaagtaatatcacacaacttagcatggtaccaacaaaaaccaggccaagcacccagactactaatatacggagcatcaacaagagcatcaggaataccagctagattctcaggatcaggatcaggcacagactacacactaacaataacatcactccaaccagaagatttcgcagtatactactgccaacactactcaaactggccacccagattaacattcggaggcggaacaaaagttgaaataaaaagaacagtagcagccccatccgtatccatatttccaccatcagacgaacaactaaaatcaggaacagcctcagtagtatgcctactaaacaacttctacccacgagaagcaaaagtacaatggaaagtagataacgcactacaatcaggaaactcacaagaatcagtaacagaacaagactcaaaagactcaacatactcactatcatcaacactaacattatcaaaagccgactacgaaaaacacaaagtatacgcatgcgaagtaacacaccaaggattatcatcaccagttacaaaatcatttaacagaggagaatgc

SEQ ID NO: 50981 - RNA, 648 nt, synthetic construct
  misc_feature 1..648: note = derived and/or modified sequence opt6 from anti-influenza_Chain
  source 1..648: mol_type = other RNA
gaaatagtaatgacacaaagcccagcaacattaagcgttagcccaggagaaagagcaacattaagttgtagagcaagtcaagtaataagccataaccttgcatggtaccaacaaaaaccaggtcaagcacccagactattaatatatggagcaagcacaagagcatcaggaataccagcaagattctcaggctcaggatcaggcacagactatacactaacaataacatcattacaaagcgaagactttgcagtatactattgccaacactatagcaattggccaccaagactaacattcggtggaggaacaaaagtagaaataaaaagaacagtagcagccccatcagtattcatattcccaccatcagacgaacaattaaaatcaggaacagcatcagtcgtatgcttactaaacaacttttacccacgagaagcaaaagtacaatggaaagttgataatgcactacaatcaggaaactcacaagaaagcgtaacagaacaagattcaaaagactcaacatattcattaagctcaacattaacattaagtaaagcagattacgaaaaacataaagtatacgcatgcgaagtaacacaccaaggactaagctcaccagtaacaaaatcatttaatagaggcgaatgt

SEQ ID NO: 50982 - RNA, 648 nt, synthetic construct
  misc_feature 1..648: note = derived and/or modified sequence opt6 from anti-influenza_Chain
  source 1..648: mol_type = other RNA
gaaatagtactaacacaatcacccgcaacactaagcgtaagcccaggcgaaagagcaacactatcatgcagagcatcacaagtaatatcacacaacctagcatggtaccaacaaaaacccggacaagcaccaagactactaatatacggagcatcaacaagagcaagcggaataccagcaagattctcaggatcaggatcaggaacagactacacactaacaataacatcattacaaagcgaagacttcgcagtatactactgccaacactactcaaacttcccaccaagactaacattcggaggtggaacaaaagtagaaataaaaagaacagtagcagcaccatcagtattcatattcccaccatcagacgaacaactaaaatcaggcacagcatcagtagtatgcttactaaacaatttctacccaagagaagcaaaagtccaatggaaagtagataatgcactacaatcaggaaactcacaagaatcagtaacagaacaagactcaaaagactcaacatactcactaagctcaacattaacactaagtaaagcagactatgaaaaacacaaagtatacgcatgtgaagtaacacaccaaggactaagttcacctgtaacaaaatcattcaacagaggcgaatgc

SEQ ID NO: 50983 - RNA, 648 nt, synthetic construct
  misc_feature 1..648: note = derived and/or modified sequence opt6 from anti-influenza_Chain
  source 1..648: mol_type = other RNA
gaaatagtattaacacaaagcccagcaacattatcagtatctccaggagaaagagcaacactatcatgcagagcatctcaagtaatatcacacaacctagcatggtatcaacaaaaaccaggacaagcaccaagactactaatttacggagcatccacacgagcatcaggaataccagcaagattctcaggatcaggctcaggaacagactacactctaaccataacctcactacaatcagaagatttcgcagtatactactgccaacactactcaaactacccaccacgactaacattcggaggcggaacaaaagtcgaaataaaaagaacagtagcagcaccatcagtattcatattcccaccatcagacgaacaactaaaatcaggaacagcatccgtagtatgcctattaaacaacttctacccaagagaagccaaagtacaatggaaagtagacaacgcactacaaagtggaaactcacaagaaagcgtaacagaacaagattcaaaagactcaacatactccctatcatcaacactaacactatcaaaagcagactacgaaaaacacaaagtatacgcctgcgaagtaacacaccaaggattatcatcaccagtaaccaaatcattcaacagaggagaatgc

SEQ ID NO: 50984 - RNA, 648 nt, synthetic construct
  misc_feature 1..648: note = derived and/or modified sequence opt6 from anti-influenza_Chain
  source 1..648: mol_type = other RNA
gaaatagtactaacacaatcaccagcaacattatcagtaagcccaggagaaagagtaactctatcatgcagagcatcccaatcagtagccaataacctagcctggtaccaacaaaaaccaggacaatccccaagactattaatatacggagcatccacacgagacacaggcataccagcaagattctcaggctcaggatccggaacagaatttacattaacaataagttcactacaatcagaagacttcgcagtatactactgccaacaatacaacaactggccaccaatgtacacattcggacaaggaacaaaactcgaaataaaaagaacagtagcagcaccaagcgtattcatattcccaccatcagacgaacaattaaaatccggaacagcatcagtcgtatgcctactaaacaatttctacccaagagaagcaaaagtacaatggaaagtagacaatgcactacaatcaggaaattcacaagaatccgtaacagaacaagactcaaaagactcaacctatagcctatcatcaacattaacattatccaaagcagactacgaaaaacacaaagtatacgcatgcgaagtaacacaccaaggattatcatcaccagtaacaaaatcattcaacagaggcgaatgc

SEQ ID NO: 50985 - RNA, 648 nt, synthetic construct
  misc_feature 1..648: note = derived and/or modified sequence opt6 from anti-influenza_Chain
  source 1..648: mol_type = other RNA
gacatagtaatgacacaatcaccatcaaccctatccgcaagcgtaggcgacagagtaacaataacatgcagagcatcacaatcaataggaaactggctagcctggtaccaacaaaaaccaggaaaagcaccaaaactattaatatacaaagtatccacactagaatcaggagtaccatcaagattctcaggatccggatcaggcacagaattcacattaacaataaactcactacaaccagacgacttcgcaacatactactgccaacgatacacatcaaactcacaaggattcaccttcggacaaggaaccaaactagaaataaaaagaaccgtcgcagccccatccgtattcatattcccaccttcagacgaacaattaaaatcaggaacagcatctgtcgtatgcctactaaataacttctatccaagagaagcaaaagtacaatggaaagtcgacaacgcactacaatccggaaactcacaagaatctgtaacagaacaagactcaaaagactcaacatactcactatcatctacactaacactatccaaagcagactacgaaaaacacaaagtatacgcatgcgaagtaacacaccaaggactatcatcaccagtaacaaaatcattcaacagaggagaatgc

SEQ ID NO: 50986 - RNA, 648 nt, synthetic construct
  misc_feature 1..648: note = derived and/or modified sequence opt6 from anti-influenza_Chain
  source 1..648: mol_type = other RNA
gacatacaactaacacaatccccactaagccctccagtaacactaggacaaccagcatcaatatcctgcagatcatcacaaagcctactatacacagacggattcacatacctatcatggtaccaccaaagaccaggacaatcaccaagaagactaatatacaaaatatcaaaccgagactcaggagtaccagacagatttagtggatcaggatcaggaacagacttcacactaaaaatatcaagagtagaagcagaagatgtaggagtatactactgcatgcaagcaacacactggccactaaccttcggagaaggaacaaaagtagaaataaaaccaaaagcagcaccaagcgtaacattatttccaccatcatcagaagaattacaagcaaacaaagcaacactagtatgcctaatatcagacttctacccaggagccgtaaccgtagcatggaaagcagactcatcaccagtaaaagcaggagtagaaacaacaacaccatcaaaacaaagcaacaacaaatacgccgcctcatcatacctatccttaacaccagaacaatggaaatcacacaaatcatactcatgccaagtaacccacgaaggaagcacagtagaaaaaacagtagcaccaacagaatgttca

SEQ ID NO: 50987 - RNA, 648 nt, synthetic construct
  misc_feature 1..648: note = derived and/or modified sequence opt6 from anti-influenza_Chain
  source 1..648: mol_type = other RNA
gaaatagtactaacacaaagcccaggaacactaagcctaagccctggagaacgagcaacattaagctgtcgagcaagccaatcagtaagatcaaacaatttagcatggtatcaacataaaccaggacaagcaccaagattattaatattcggagcatcaagtagagcaacaggaataccagatagatttagcggatcaggaagtggtaccgatttcacactaacaatatcaagattagaaccagaagatttcgcagtatattactgtcaacaatacggaagttcacccgcactaacattcggaggaggaacaaaagtagaaataaaaagaacagtcgcagcaccaagcgtattcatattcccaccatcagacgaacaattaaaatcaggaacagcatcggttgtatgcctactaaacaacttctacccaagagaagcaaaagtacaatggaaagttgataacgcattacaaagcggaaattctcaagaaagcgtaacagaacaagactcaaaagactcaacatatagcttaagctcaaccttaaccttaagcaaagcagattacgaaaaacataaagtatacgcatgcgaagtaacacaccaaggattatcttcaccagtaacaaaatcatttaacagaggagaatgc

SEQ ID NO: 50988 - RNA, 648 nt, synthetic construct
  misc_feature 1..648: note = derived and/or modified sequence opt6 from anti-influenza_Chain
  source 1..648: mol_type = other RNA
caatcagtcctaacacaacccccatcagcatcaggatcaagaggacaatccataacaatatcatgcacaggatcaacatcagacataggatcatacaactatgtctcatggtaccaacaacacccaggaacagcacccaaagtaatactatacgaagtatcacaaagaccatccggagtaccagacagattttcaggatcaaaatcaggaaacacagcattcctaaccgtatcaggactacaaacagacgacgaagcagactactactgcgcaagctacgcaggaaacaacatatatgtattcggatcaggaacaaaagtaaccgtactaggacaaccaaaagcaaacccaacagtaacactattcccaccatcatcagaagaactacaagcaaataaagcaacactagtatgcctaatatcagacttctacccaggagcagtaacagtagcatggaaagcagactcatcaccagtaaaagccggagtagaaacaacaacaccatcaaaacaatccaacaacaaatacgcagcatcatcatacctatcactaaccccagaacaatggaaatcccacaaatcatactcatgtcaagtaacacacgaaggatcaacagtcgaaaaaacagtagcaccaacagaatgcagc

SEQ ID NO: 50989 - RNA, 651 nt, synthetic construct
  misc_feature 1..651: note = derived and/or modified sequence opt6 from anti-influenza_Chain
  source 1..651: mol_type = other RNA
caaccagtcctaacacaacctccatcagcaagcggctcaccaggacaaagagtaacaatatcatgctcaggatcatcatcaaacataggatcatacacagtaaactggtaccaacaactaccaggaaccgcaccaaaattattaatctactcactaaaccaaagaccatccggagtaccagacagattctcaggttctaaatcaggaacatcagcatcactagcaatatcaggactacaatcagaagacgaagcagtttattactgcgcagcatgggacgactcactatcagcacatgtagtattcggaggaggaacaaaattaactgtactaggacaaccaaaagcagcaccatcagtaacactattcccaccatcatcagaagaattacaagcaaacaaagcaacactagtatgcttaatatcagacttctacccaggagcagtaacagtagcatggaaagcagactcatcacccgtcaaagcaggagtagaaacaacaacaccctcaaaacaatccaacaacaaatacgcagcatcatcctacctatcactaacacccgaacaatggaaatcacacagatcctactcatgccaagtaacacacgaaggatcaacagtagaaaaaacagtagcaccaacagaatgttcc

SEQ ID NO: 50990 - RNA, 651 nt, synthetic construct
  misc_feature 1..651: note = derived and/or modified sequence opt6 from anti-influenza_Chain
  source 1..651: mol_type = other RNA
caacccgtattaacacaaccaccatcagcatcaggaacaccaggacaaagagtaacaatatcatgctcaggatcctcatcaaacataggatcaaacacagtatcatggtaccaacaagtaccaggaacagcaccaaaactactaatctatggaaacaacgaaagaccatcaggtgtaccagacagattctcaggatcaaaatcagcaacatcagcatccttagcaatctcaggactccaatcagaagacgaagccgactactactgcgcagcatgggacgactcactaaacggattttgggtattcggaggaggaacaaaattaacagtattaggccaaccaaaagcagcaccatcagtaactctattcccaccatcatccgaagaactacaagcaaacaaagcaacattagtatgcctaatatcagacttctacccaggagcagtaacagtcgcctggaaagctgactcatcaccagtaaaagcaggagtagaaacaacaacaccatcaaaacaaagtaacaataaatacgcagcatcatcatacctatcactaacaccagaacaatggaaatcacacaaatcatactcatgccaagtaacacacgaaggatcaacagtagaaaaaacagtagcaccaacagaatgctcc

SEQ ID NO: 50991 - RNA, 651 nt, synthetic construct
  misc_feature 1..651: note = derived and/or modified sequence opt6 from anti-influenza_Chain
  source 1..651: mol_type = other RNA
tcatacgtactaacacaaccaccatcagtatcaggaacaccaggacaaagagtaataatatcctgctctggttactcatcaaacatcggatcaaacaccgtaaactggtaccaacaattccctggaacagcaccaagactactaatctacgcaaataaccaaagaccaccaggagtaccagacagattttcaggatcaaaatccggaacatcagcatcactcgcaatatcaggacttcaatccgacgacgaatcagactactactgcgcagcatgggacgactcactaaacggccactgggtattcggaggaggcacaaaactaacagtactaggacaaccaaaagctgcaccatccgtaacactattcccaccatcatcagaagaactacaagcaaataaagcaacactcgtatgcctaatctcagacttctacccaggagcagttacagttgcatggaaagctgactcatcacccgtcaaagcaggagtagaaacaacaacaccatcaaaacaatcaaacaacaaatatgcagcatcatcttacctatcattaacaccagaacaatggaaatcccacagatcatactcatgccaagtaacacatgaaggatcaacagtcgaaaaaacagtagcaccaacagaatgctca

SEQ ID NO: 50992 - RNA, 654 nt, synthetic construct
  misc_feature 1..654: note = derived and/or modified sequence opt6 from anti-influenza_Chain
  source 1..654: mol_type = other RNA
tcatacgtactaacacaaccaccatcagtatcagtagccccaggacaaacagcaagaataacatgcggaggaaacaacataggatcaaaatcagtacactggtaccaacaaaaaccaggacaagcaccagtactagtagtatacgacgactcagacagaccatcaggaataccagaaagattctcaggatcaaacagcggaaacacagcaacattaacaatctcaagagtagaagcaggagacgaagcagactattactgccaagtatgggactcatcatcagaccacgcagtattcggaggcggaacacaattaacagtactaggcgcagcagcaggacaaccaaaagcagcaccatcagtaacactattcccaccatcatcagaagaactacaagcaaataaagcaacactagtatgcctaatatcagacttttacccaggagcagtaacagtagcatggaaagccgacagttcaccagtaaaagcaggagtagaaacaacaacaccaagcaaacaatcaaacaacaaatacgcagcatcatcatacttatcactaacaccagaacaatggaaatcacacagaagctattcatgccaagtaacacacgaaggaagtacagtagaaaaaacagtagcaccaacagaatgcagc

SEQ ID NO: 50993 - RNA, 654 nt, synthetic construct
  misc_feature 1..654: note = derived and/or modified sequence opt6 from anti-influenza_Chain
  source 1..654: mol_type = other RNA
caatcagtagtaacacaaccaccatcagtatcagtagcaccaggacaaaccgctcgaattacatgcggaggaaacaatataggatcaaaatcagtacattggtaccaacaaaaaccaggacaagcaccagtattagtagtatacgacgactcagacagaccatcaggaataccagaacgattctctggaagcaacagcggaaacacagcaacactaacaatatcaagagttgaagcaggagacgaagcagactactattgccaagtatgggacagctcaagcgaccactacgtattcggaacaggaacaaaagtaacagtattaggagcagcagcaggacaaccaaaagcagcaccatcagtaacactattcccaccatcatcagaagaactacaagcaaacaaagcaacactcgtatgcctaatatcagacttctatcccggcgcagtaacagtagcatggaaagccgatagttcacccgtaaaagcaggagtagaaacaacaacaccatcaaaacaatcaaacaataaatacgcagcatcctcatacctatcactaacaccagaacaatggaaatcacatagaagttactcatgccaagtaacacacgaaggaagtacagtagaaaaaacagtagcaccaacagaatgcagc

SEQ ID NO: 50994 - RNA, 654 nt, synthetic construct
  misc_feature 1..654: note = derived and/or modified sequence opt6 from anti-influenza_Chain
  source 1..654: mol_type = other RNA
ctatcaagaataaaccacttcgaaaaaatacaaataataccaaaatcatcatggtcagaccacgaagcatcatcaggagtatcatcagcatgcccataccaaggaacaccctcatttttcagaaacgtagtctggctaatcaaaaaaaacaacacatacccaacaataaaaagatcatacaacaacacaaaccaagaagacttactaatcctatggggaatacaccactcaaacgacgcagcagaacaaacaaaactctaccaaaacccaaccacatacatatcagtaggaacatcaacactaaaccaaagattagtaccaaaaatagcaacccgctcaaaagtaaacggacaaaacggacgaatggactttttctggacaatactaaaaccaaacgacgccataaacttcgaatcaaacggaaacttcatagcaccagaatacgcatacaaaatagtaaaaaaaggagactcagcaatagtaaaatcagaagtagaatacggaaattgcaacacaaaatgccaaacaccaataggcgcaataaactcctcaatgccattccacaacatccacccactaacaatcggagaatgcccaaaatacgtcaaatcaaataaactagtattagccacaggattacgaaattcaccactc

SEQ ID NO: 50995 - RNA, 657 nt, synthetic construct
  misc_feature 1..657: note = derived and/or modified sequence opt6 from anti-influenza_Chain
  source 1..657: mol_type = other RNA
tcctcagaactaacacaaccaccatcagcatcaggaaccccaggacaaagagtaacaataagctgctctggatctacatcaaacataggatacaacccagtatcatggtaccaacaagtacccggcacagcaccaaaactactaatatactcaaacacagaaagaccatcaggagtaccagacagattctcaggatcaaaatcaggaacctcagcatcattagcaatatcaggactacaatccgaagacgaagcagactactactgcgcagcctgggacgacacactaaacggaccagtatttggaggaggaactaaagtaacagtcttaggacaaagaacagtagcagctccatccgtattcatatttccaccatcagacgaacaactaaaatcaggaacagcatcagtagtatgcttactcaacaacttctacccacgagaagcaaaagtacaatggaaagtagataacgcactacaatccggaaactcacaagaatcagtaacagaacaagactcaaaagactcaacatactcactatcatcaacactaacattaagtaaagccgactacgaaaaacacaaagtatacgcatgcgaagtcacacaccaaggcctatcatcaccagtaacaaaatcattcaacagaggcgaatgc

SEQ ID NO: 50996 - RNA, 657 nt, synthetic construct
  misc_feature 1..657: note = derived and/or modified sequence opt6 from anti-influenza_Chain
  source 1..657: mol_type = other RNA
gacatagtaatgacacaaagcccactatcactcccagtaacaccaggagaaccagcatcaatatcttgccgaagctcacaatcattactaagatcaaacggatacaactacctagactggtacctacaaaaacccggacaatcaccacaactactaatatacctaggatcaaaccgtgcaagcggagtaccagacagattctcaggatcaggatcaggaacagacttcacactaaaaatatcaagagtagaagccgaagacgtaggtgtatactactgcatgcaagcattacaaacaccatacacatttggacaaggaacaaaactagaaataaaaagaacagtagcagcaccatccgtattcatatttccaccatcagacgaacaattaaaatcaggaacagcctcagtagtatgcctactaaacaacttctacccaagagaagcaaaagtacaatggaaagtcgacaacgcactacaaagcggaaactcacaagaaagcgtaacagaacaagactcaaaagattcaacatacagcctatcatcaacattaacactaagcaaagccgactacgaaaaacacaaagtatacgcatgcgaagtaacacaccaaggcctatcatcaccagtaacaaaatcattcaacagaggcgaatgc

SEQ ID NO: 50997 - RNA, 660 nt, synthetic construct
  misc_feature 1..660: note = derived and/or modified sequence opt6 from anti-influenza_Chain
  source 1..660: mol_type = other RNA
tcatacgtactaacacaaccaccatcagcaagcggaacaccaggacaaagagttacaatatcatgctcaggatccacattcaacataggatcaaacgcagtagactggtatagacaactaccaggaacagcaccaaaactactaatatactccaacaaccaacgaccatcaggagtaccagacagattctccggctccagatccggaacatcagcatcactagcaataagcggactacaatcagaagatgaagcagactactactgcgcagcatgggacgacatattaaacgtaccagtattcggaggaggcacaaaactaacagtcttaggagcagcagctggacaaccaaaagcagcaccatcagtaacactattcccaccatcatcagaagaactacaagcaaacaaagcaacactagtatgcctaatatcagacttctacccaggagctgtaacagtcgcctggaaagcagactcatcaccagtaaaagcaggagtagaaacaacaacaccatcaaaacaatcaaacaacaaatatgcagcatcatcatacttatcattaacaccagaacaatggaaatcacacagatcatattcatgccaagtaacacacgaaggatcaacagtagaaaaaacagtagccccaacagaatgctca

SEQ ID NO: 50998 - RNA, 660 nt, synthetic construct
  misc_feature 1..660: note = derived and/or modified sequence opt6 from anti-influenza_Chain
  source 1..660: mol_type = other RNA
caatcagcactaacacaaccagcagcagtatcaggatcaccaggacaatcaataacaatatcatgcacaggaacatcatcagacgtaggcggatataattacgtatcatggtaccaacaacacccaggaaaagcaccaaaattaatgatatacgaagtatcaaacagaccatcaggagtctcaaacagattctcaggatcaaaatcaggaaacacagcatcactaacaatatcaggactccaagcagaagatgaagccgactactattgttcctcatacacatcatcatcaacatacgtattcggcacaggaacaaaagtaacagtactaggagcagcagcaggacaaccaaaagcagcaccatcagtaacactattcccaccatcatccgaagaactacaagcaaacaaagcaacactagtatgcctaatatcagacttctacccaggagctgtcacagtagcatggaaagcagactcatcaccagtaaaagccggagtcgaaactacaacaccatcaaaacaatcaaacaacaaatacgcagcatcatcatacctatcattaacaccagaacaatggaaatcacatagatcatactcctgccaagtaacccacgaaggatcaacagtagaaaaaacagtcgcaccaacagaatgttca

SEQ ID NO: 50999 - RNA, 660 nt, synthetic construct
  misc_feature 1..660: note = derived and/or modified sequence opt6 from anti-influenza_Chain
  source 1..660: mol_type = other RNA
tcctacgtgttaacacaaccaccatcagtatcaggaacaccaggacaaagagtcacaatatcatgctcaggatcaagatcaaacgtaggagacaactcagtatactggtaccaacacgtaccagaaatggcaccaaaattactagtatacaaaaacacacaaagaccatcaggagtaccagcaagattcagcggatcaaaatcaggaacatctgcatctttagcaataataggactacaatctggagatgaagcagactactattgcgtagcatgggatgactccgtagacggatacgtattcggatctggaacaaaagtaacagtactaggagcagcagcaggacaaccaaaagcagcaccatcagtaacattattcccaccatcaagcgaagaattacaagccaacaaagcaaccctagtatgtctaatatcagacttctacccaggtgcagtaacagtagcctggaaagcagactcatcaccagtaaaagcaggagtagaaacaacaacaccatcaaaacaaagcaacaataaatacgcagcatcatcatacctatcactaacaccagaacaatggaaatcacacagaagctattcatgccaagtaacacacgaaggatcaacagtagaaaaaacagtagcaccaacagaatgcagt

SEQ ID NO: 51000 - RNA, 660 nt, synthetic construct
  misc_feature 1..660: note = derived and/or modified sequence opt6 from anti-influenza_Chain
  source 1..660: mol_type = other RNA
tcatacgtattaacacaaccaccatcagcatcaggaacaccaggacaacgagtaacaatctcatgctcaggatcaagttcaaatataggctcaaactacgtatactggtaccaacaattaccaggaacagcaccaaaattactaatatacagagatggacaaagaccatcaggagtaccagacagattctcaggatcaaaatccggaacatcagcatcattagcaatatccggactaagatccgacgacgaagcagactactactgtgcaacatgggacgacaacctatcaggaccagtattcggaggaggaacaaaattaacagtactaggagcagcagccggtcaaccaaaagcagcaccatcagtaacactattcccaccatcatcagaagaattacaagcaaataaagctacattagtatgcctaatatcagacttctatccaggagctgtaacagtagcatggaaagcagactcatcaccagtaaaagcaggagtagaaacaaccacaccatcaaaacaatcaaacaacaaatacgcagcatcatcatacctatcattaacaccagaacaatggaaatcccacagatcatactcatgccaagtaacacacgaaggctcaacagtagaaaaaacagtagcaccaacagaatgctca

SEQ ID NO: 51001 - RNA, 660 nt, synthetic construct
  misc_feature 1..660: note = derived and/or modified sequence opt6 from anti-influenza_Chain
  source 1..660: mol_type = other RNA
caatcagcactaacacaaccagcatcagtatccggatcaccaggacaatcaataacaatatcttgcacaggaacatcatcagacgtaggaggatataactacgtatcatggtaccaacaacacccaggcaaagcaccaaaattaatgatatacgaagtatcaaaccgaccatcaggtgtatcaaacagattctcaggatcaaaatcaggaaacacagcaagcctaacaatatccggattacaagccgaagacgaagcagactactactgctcatcatacacatcatcatcaacactagtattcggtacaggaacaaaagtaacagtactaggagcagcagcaggacaaccaaaagcagcaccttcagtaacattattcccaccatcatcagaagaactacaagcaaacaaagcaacactagtctgcctaatctcagacttctacccaggagcagtaacagtcgcatggaaagccgactcctcaccagtaaaagcaggagtcgaaacaacaacaccatcaaaacaatcaaacaacaaatacgcagcatcatcatacctatcactaacaccagaacaatggaaatcacacagatcatactcatgccaagtaacacacgaaggatcaacagtcgaaaaaacagtagccccaacagaatgtagc

SEQ ID NO: 51002 - RNA, 660 nt, synthetic construct
  misc_feature 1..660: note = derived and/or modified sequence opt6 from anti-influenza_Chain
  source 1..660: mol_type = other RNA
accgtactcacacaaccaccatctgtatcaggagcaccaggacaaagagtaacaatatcctgcacaggatcatcatcaaacataggagcaggatatgacgtacactggtaccaacaattacccggaacagcaccaaaattattaatatacggaaactccaacagaccatcaggagtaccagacagattctcaggaagcaaatcaggaacatcagcaacactaggaataacaggactacaaacaggagacgaagcagactactactgcggaacatgggactcatcattaagcgcatacgtattcggaacaggaacaaaagtaacagtcttaggagccgcagctggacaaccaaaagcagcaccatcagtaacattattcccaccaagctcagaagaactacaagcaaacaaagcaacactagtatgcctaatatcagacttctacccaggtgcagtaacagtagcatggaaagccgattcatcaccagtaaaagcaggagtagaaacaacaaccccatcaaaacaatcaaacaataaatacgcagcatcatcatacctatcactaacaccagaacaatggaaaagccatagatcatactcatgccaagttacacacgaaggatcaacagtagaaaaaacagtagcaccaacagaatgctca

SEQ ID NO: 51003 - RNA, 663 nt, synthetic construct
  misc_feature 1..663: note = derived and/or modified sequence opt6 from anti-influenza_Chain
  source 1..663: mol_type = other RNA
caatctgtactaacacaacccccatcagtgagcgcagcaccaggacaaaaagtaacaatatcatgctcaggatcatcaagcaatataggaaacgactacgtatcatggtaccaacaactaccaggaacagcaccaaaactactaatttacgacaacaacaaaagaccatcaggaataccagacagattctcaggctcaaaatcaggtacatcagcaacactaggaataacaggactacaaacaggagacgaagcaaactactactgtgcaacatgggacagaagaccaacagcatacgtagtattcggaggaggaacaaaactaacagtactaggagcagcagcaggacaaccaaaagcagcaccatcagtaacactattccccccatcatcagaagaattacaagcaaacaaagcaacactagtatgcttaatatcagacttctacccaggagcagtaacagtagcatggaaagcagacagctcaccagtaaaagcaggagtagaaacaacaaccccctcaaaacaaagcaacaacaaatatgcagcatcatcatacctatcattaacaccagaacaatggaaatcacacagaagttactcatgccaagtaactcatgaaggatcaacagtagaaaaaacagtagcaccaactgaatgctca

SEQ ID NO: 51004 - RNA, 675 nt, synthetic construct
  misc_feature 1..675: note = derived and/or modified sequence opt6 from anti-influenza_Chain
  source 1..675: mol_type = other RNA
atggtaggatttacaccagtagcattagcagcattagcagcaacaggagcattagcatttccagcaggaaatgcaacagaattagaaaaaagacaaacaacaccaaatagtgaaggatggcatgatggatattattatagttggtggagtgatggaggagcacaagcaacatatacaaatttagaaggaggaacatatgaaataagttggggagatggaggaaatttagtaggaggaaaaggatggaatccaggattaaatgcaagagcaatacattttgaaggagtatatcaaccaaatggaaatagctatttagcagtatatggatggactagaaatccattagtagaatattacatagtagaaaattttggaacatatgatccaagcagtggagcaacagatttaggaacagtagaatgtgatggaagtatatatagactaggaaaaacaacaagagtaaatgcaccaagtatagatggaacacaaacattcgatcaatattggagcgtaagacaagataaaagaacaagtggaactgtacaaacgggatgtcattttgatgcatgggcaagagcaggactaaatgtaaacggagatcattattatcaaatagtagcaacagaaggatattttagcagtggatatgcaagaataacagtagcagatgtagga

SEQ ID NO: 51005 - RNA, 687 nt, synthetic construct
  misc_feature 1..687: note = derived and/or modified sequence opt6 from anti-influenza_Chain
  source 1..687: mol_type = other RNA
agatcagacaaaacacatacatgcccaccttgcccagcaccagaactattaggaggcccctcagtattcttattcccaccaaaaccaaaagacacactaatgatatctagaacacccgaagtaacatgcgtagtagtcgacgtatcacacgaagacccagaagtaaaattcaactggtacgtcgacggagtagaagtacacaacgcaaaaacaaaaccaagagaagaacaatacaattcaacataccgagtagtatcagtactaacagtactacaccaagactggctaaacggaaaagaatataaatgcaaagtatcaaacaaagcactaccagcaccaatagaaaaaacaatatcaaaagcaaaaggacaaccaagagaaccacaagtatacacactaccaccatcaagagaagaaatgacaaaaaaccaagtatcactaacctgcctagtaaaaggattttacccatcagacatagcagtagaatgggaatcaaacggacaacccgaaaataactacaaaacaacaccaccagtattagactcagacggctccttcttcctatactccaaactaacagtagacaaatcaagatggcaacaaggaaatgtattctcatgctctgtaatgcacgaagcactacacaaccactacacacaaaaatcattatcattatcacccggaaaa

SEQ ID NO: 51006 - RNA, 696 nt, synthetic construct
  misc_feature 1..696: note = derived and/or modified sequence opt6 from anti-influenza_Chain
  source 1..696: mol_type = other RNA
cacgcacaagacatactagaaaaaacacacaacggaaaactatgcgacctcgacggagtaaaaccattaatactaagagactgctcagtagcaggatggctactaggaaacccaatgtgcgacgaattcataaacgtacccgaatggtcatacatagtagaaaaagcaaacccagcaaatgacctatgctacccaggaaactttaacgactacgaagaactaaaacacctactatcaagaataaaccacttcgaaaaaatccaaataataccgaaatcatcatggtcagaccacgaagcatcatccggagtatcatcagcatgcccatatcaaggaacaccatcattcttcagaaacgtagtatggctaatcaaaaaaaacaacacatacccaacaataaaaagatcatacaacaacacaaaccaagaagacttactaatactatggggaatacaccactcaaacgacgcagcagaacaaaccaaactataccaaaacccaacaacatacatatcagtcggcacatcaacactaaaccaaagactagtaccaaaaatagcaacaagatccaaagtaaacggacaaaacggaagaatggatttcttctggacaatattaaaaccaaacgacgccataaacttcgaatcaaacggaaacttcatagcaccagaatacgcatacaaaatagtaaaaaaa

SEQ ID NO: 51007 - RNA, 699 nt, synthetic construct
  misc_feature 1..699: note = derived and/or modified sequence opt6 from anti-influenza_Chain
  source 1..699: mol_type = other RNA
atgagaccatcaatacaattcctaggactattattattctggctacacggaggacaatgcgacatacaaatgacacaatccccatcatcactatcagcatcactaggaggaaacgtcaccataacatgcaaagcatcacaagacataaataaatacatcgcatggtaccaacacaaaccaggcaaaggaccaagattagtaatacactacacatcaacactacaaccaggaataccatcaagattcagcggatcaggatcaggaaccgactactcattctcaatatcaaacttagaaccagaagacatagcaacatactactgcctacaatacgacatactatacacattcggaggcggaacaaaactagaaataaaacgagcagacgcagccccaaccgtatcaatattcccaccatcatcagaacaactaacatcaggcggagcctcagtagtatgcttcctaaacaacttctacccaaaagacataaacgtaaaatggaaaatagatggctcagaaagacaaaacggagtcctaaattcatggacagaccaagactccaaagactcaacctactcaatgtcatcaacactaacactaacaaaagacgaatacgaaagacacaactcctacacatgcgaagcaacacacaaaacatccacatcaccaatagtaaaatcattcaacagaaatgaatgc

SEQ ID NO: 51008 - RNA, 702 nt, synthetic construct
  misc_feature 1..702: note = derived and/or modified sequence opt6 from anti-influenza_Chain
  source 1..702: mol_type = other RNA
atgatgtcatcagcacaattcttaggactactactactatgcttccaaggaacacgatgcgacatacaaatgacacaaacaagttcctcattatcagcatcactaggagacagagtcacaatatcatgccgagcatcacaagacataagaaattacctaaactggtaccaacaaaaaccagacggaacagtaaaactactaatatactacacatcaagactacactcaggagtaccatcaagattctcagactccggatcaggaacagactattcattaacaatatcaaacctagaacaagaagacctagcaacatacttctgtcaacaaacatacaccctaccatggacattcggaggaggaacaaaactagaaattaaaagagcagacgcagcaccaacagtatcaatattcccaccatcatccgaacaactaacctcaggaggagcatcagtagtatgcttcctaaacaacttttacccaaaagacataaacgtaaaatggaaaatagacggatcagaaagacaaaacggcgtactaaactcatggacagatcaagactcaaaagactccacctactcaatgtcatcaacactaaccctaacaaaagacgaatacgaaagacataactcatacacatgcgaagcaacacacaaaacctcaacttcacccatagtaaaatcattcaacagaaacgaatgc

SEQ ID NO: 51009 - RNA, 702 nt, synthetic construct
  misc_feature 1..702: note = derived and/or modified sequence opt6 from anti-influenza_Chain
  source 1..702: mol_type = other RNA
atggaagcacccgcacaactactattcctattactattatggttaccagacacaacaggagaaatagtactaacacaatcaccagcaacactaagcctaagcccaggagaaagagctacactatcatgtagagcttcagaaaacatatggaacaatctagcatggtaccaacaaaaacccggacaagcaccaagactattaatttcaggagcatcaacaggcgcaacaggagtaccaagcagattccgaggatcaggatcaagaacagaatttacactaacaatatcatcattacaaagcgaagacttcgcaatatacttctgccaacaatacaactcatggccaagaacattcggaccaggaacaaaagtcgaaataaaacgaacagtagcagcaccatcagtattcatattcccaccatcagatgaacaactaaaatcaggaacagcctcagtagtctgcctactaaacaacttctacccaagagaagcaaaagtacaatggaaagtagacaacgcactacaatcaggaaactcacaagaatcagtaacagaacaagactcaaaagattccacatactcactatcatcaacactaacactatcaaaagcagactacgaaaaacacaaagtatacgcatgcgaagtcacacaccaaggactatcatcaccagtaaccaaatcattcaacagaggagaatgc

SEQ ID NO: 51010 - RNA, 705 nt, synthetic construct
  misc_feature 1..705: note = derived and/or modified sequence opt6 from anti-influenza_Chain
  source 1..705: mol_type = other RNA
atggaaaccccagcacaactactattcctactactactatggctaccagacacaacaggagaaatagttctaacacaatcaccaggaacattatcactatcaccaggagaaagagcaacactatcatgcagagcatcacaatccctatcatcatcatccctagtatggtaccaacaaaaacccggccaagcaccaagattattaatatacggcgcatcatcaagagcaacaggcattccagacagattctcaggatcaggatcaggaacagacttcacactaacaatatcaagactagaaccagaagacttcgcagtatactactgtcaacaatacggaaactcaccatacacctttggacaaggaacacaagtagaaataaaacgaaccgtagcagcaccatccgtattcatatttccaccatcagatgaacaattaaaatcaggcacagcatcagtcgtatgcttactaaacaacttctacccaagagaagcaaaagtacaatggaaagttgacaacgcattacaatcaggaaactcacaagaatcagtaacagaacaagactcaaaagactcaacatattctttatcctcaacactaacactatcaaaagcagactacgaaaaacacaaagtatacgcatgcgaagtaacacaccaaggattaagctcacccgtaacaaaatcattcaacagaggagaatgt

SEQ ID NO: 51011 - RNA, 705 nt, synthetic construct
  misc_feature 1..705: note = derived and/or modified sequence opt6 from anti-influenza_Chain
  source 1..705: mol_type = other RNA
atggaaacaccagcacaactattattcttactactactatggctaccagacaccacaggagaaacagtactaacacaatcaccaggaaccctttcactatcacctggagaaagagcaacactatcctgcagagcatcccaaagcgtctcaatatcatacctagcatggtatcaaagaaaaccaggacaagcacccagactactaatatacggagcatcaagacgagctacaggaataccagatagattctcaggatcaggatcaggaacagacttcacactaactatatcaagattagaaccagaagacttcgcagtatactactgccaacaatacggatcatcaccatacacattcggtcaaggcacaaaactagaaataaaaagaacagtagcagcaccatcagtattcatctttccaccttcagatgaacaattaaaatcaggcacagcatcagtagtatgcctactaaacaatttctacccaagagaagcaaaagtacaatggaaagtagataacgcactacaatcaggaaactcacaagaaagcgtaacagaacaagactcaaaagactcaacatactcactatcatcaacactaaccctatcaaaagcagactacgaaaaacacaaagtatacgcctgcgaagtaacacatcaaggactatcatcaccagtaacaaaatcattcaacagaggagaatgc

SEQ ID NO: 51012 - RNA, 705 nt, synthetic construct
  misc_feature 1..705: note = derived and/or modified sequence opt6 from anti-influenza_Chain
  source 1..705: mol_type = other RNA
atggcatggatgatgctactattaacactactaatacactgtacaggatcatgggcacaatcagtactaactcaaccaccatcagtaagcgcagcaccaggtcaaaaagtaacaatatcatgctcaggatcaagctcaaacataggaaaaaactacgtatcttggtatcaacaactaccaggaacagcaccaaaactattaatatacgataacgataaaagaccatcaggcataccagatcgattctcaggatccaaatcaggcacatccgcaacactaggaataaccggactacaaacaggagatgaagcagactaccactgcggcgcatgggacagctcactaaacggaggagtattcggaggaggtacaaaagtaacagtcctaggacaaccaaaagcagcaccaagcgtaactttattcccaccatccagcgaagaattacaagcaaacaaagcaacactagtatgcttaatatcagacttctacccaggagcagtaacagtagcatggaaagcagatagctccccagtaaaagcaggagtagaaacaactacaccatcaaaacaatcaaacaacaaatacgcagcatcaagctatctatcactcacaccagaacaatggaaatcacaccgatcatactcatgccaagtaacacacgaaggatcaacagtagaaaaaacagtcgcaccaacagaatgcagc

SEQ ID NO: 51013 - RNA, 714 nt, synthetic construct
  misc_feature 1..714: note = derived and/or modified sequence opt6 from anti-influenza_Chain
  source 1..714: mol_type = other RNA
atgatgaaaaaaaaatcatggttcacactaatgataacaggagtaatatcactattcttctcagtatcagcattcgctggaaacgtattctgggaaccattatcatatttcaactcaagcacatggcaaaaagcagatggatactcaaatggacaaatgttcaactgcacatggagagccaacaacgtaaacttcaccaacgacggaaaattaaaattatcattaacctcaccagcaaacaacaaattcgactgcggagaatacagaagcaccaacaactacggatacggactatacgaagtatcaatgaaaccagcaaaaaacacaggaatagtatcatcattcttcacatacacaggaccatcacacggaacacaatgggacgaaatagacatagaattcctaggaaaagacacaacaaaagtacaattcaactactacacaaacggagtaggaggacacgaaaaaataataaacctaggattcgacgcatcaacatcattccacacatacgcatttgactggcaaccaggatacataaaatggtacgtagacggagtactaaaacacacagcaacaacaaacataccaagtacaccaggcaaaataatgatgaacttatggaacggaacaggagtagactcatggctaggatcatacaacggagcaaacccattatacgcagaatacgactgggtaaaatacacatcaaac

SEQ ID NO: 51014 - RNA, 729 nt, synthetic construct
  misc_feature 1..729: note = derived and/or modified sequence opt6 from anti-influenza_Chain
  source 1..729: mol_type = other RNA
caagtacaattagtacaaagcggagcagaagtaaaaaaaccaggaagtagtgtaaaagtaagttgtaaagcaagtggaggaacattctcaagctacgcaattagctgggtaagacaagcaccaggacaaggattagagtggatgggaggaataatgggaatgtttggaacaacaaattacgcacaaaaatttcaaggacgagtaacaataacagcagatgaatttacaagtgcagcatatatggaattaagaagtttaagatcagaagatacagcagtatactattgtgccagaagttcaggttattacccagaatattttcaagactggggacaaggaacattagtaactgtaagctcaggaacaggaggaagcggaggaacaggatcaggaacaggaggaagcacacaaagtgtattaacacaaccaccaagcgaatcagtaagtccaggacaaacagcaagtgtaacatgcagtggacataaattaggagataaatacgtaagttggtatcaacaaaaaccaggacaatcaccagtattattaatatatcaagataacagaagaccaagtggaataccggaaagatttataggatcaaatagtggaaatacagcaacattaacaataagtgggacacaagcactagatgaagcagattattattgccaagcatgggactcaagtacagcagtatttggaggaggaacaaaattaacagtattagga

SEQ ID NO: 51015 - RNA, 729 nt, synthetic construct
  misc_feature 1..729: note = derived and/or modified sequence opt6 from anti-influenza_Chain
  source 1..729: mol_type = other RNA
caagtacaattagtccaatcaggagcagaagtaaaaaaaccaggttcatcagtaaaagtatcatgcaaagcatcaggaggaccattcagaaattttgcaataaactgggtaagacaagcaccaggacaaggactagaatggatgggaggaataatagcagtattcggaacaacaaaatatgcacataaatttcaaggaagagtaacaataacagcagacgatagcacaaatacagcatatatggaactaggaagtctaaaatcagaagacacagcagtatactactgcgcaagaggaccacactactactcttcatacatggacgtatggggagaaggaacaacagtaacagtatcatcaggaaccggaggatcaggaggaactggatcaggaacaggaggatcaacagatatccaactaacacaatctccaagctcattatcagcaagcgtaggtgacagagtaacaataacatgcagagcatcacaaggaatatcaacatacttagcatggtatcaacaaaaaccaggaaaagtaccgaaattattaatatacgcagcctcaaccttacaatcaggagtaccatcaagattctcaggatcaggatcaggaacagactttacattaacaatatcatcactacaaccagaagacgtagcaacatactactgccaaaaatacaactcagccccaagctttggaccaggaacaaaagtagacataaaaaga

SEQ ID NO: 51016 - RNA, 729 nt, synthetic construct
  misc_feature 1..729: note = derived and/or modified sequence opt6 from anti-influenza_Chain
  source 1..729: mol_type = other RNA
atgtcatacagagtaaaaagaatgttaatgctactagtaacaggactattcctaagcttaagcacatttgcagcatcagcatcagcacaaacaggagggtcattctacgaaccattcaacaactacaacacaggactatggcaaaaagcagacggatactcaaacggaaacatgttcaactgcacatggagagcaaacaacgtgtcaatgacatcattaggagaaatgagactatcactaacatcaccatcatacaacaaattcgactgtggcgaaaacagatcagtacaaacatacggatacggactatacgaagtaaacatgaaaccagcaaaaaacgtaggaatagtttcatcattcttcacatacacaggaccaacagacggaacaccatgggacgaaatagacatagaattcctaggaaaagacacaacaaaagtacaattcaactactacacaaacggagtaggaaaccacgaaaaaatagtaaacttaggattcgacgcagcaaactcataccacacatatgcattcgactggcaaccaaactcaataaaatggtacgtcgacggacaactaaaacacacagccacaacacaaatcccacaaacaccaggaaaaataatgatgaacctatggaacggagcaggagtagacgaatggctaggatcatacaacggagtaacaccactatcaagatcactacactgggtaagatacacaaaacga

SEQ ID NO: 51017 - RNA, 735 nt, synthetic construct
  misc_feature 1..735: note = derived and/or modified sequence opt6 from anti-influenza_Chain
  source 1..735: mol_type = other RNA
caagtacaactacaacaatcaggagcagaagtaaaaaaacctggaagctcagtaaaagtatcatgcaaagtatcaggagtaatattttcaggaagtgcaataagttgggtcagacaagcaccaggacaaggattagaatggatgggaggaataagcccattatttggaacaacaaattacgcacaaaaattccaaggcagagtcacaataacagcagatcaatcaacaaatacaacatacatggaagtaaattcactcagatacgaagacacagcagtatacttttgtgcaagaggaccaaaatactatagcgaatacatggacgtatggggaaaaggaacaacagtaacagtatcaagcggaacaggaggatcgggcggaacaggatcaggaacaggaggatcaacagatatacaaatgacgcaaagtccatcaagcttaagtgcgagtgtaggagatagagtaacaataacttgtagagcaagccaaggaataagttcatacttagcatggtaccaacaaaaaccaggaaaagtaccaacactattaatctatgacgcaagcacattaaggagtggagtaccaagtaggttttcaggatcaggatcagcaacagactttacactaacaataagtagtttacaaccagaagatgtagcaacatactattgccaaagatataattcagcaccaccaataacatttggacaaggaacaagactagaaataaaaaga

SEQ ID NO: 51018 - RNA, 735 nt, synthetic construct
  misc_feature 1..735: note = derived and/or modified sequence opt6 from anti-influenza_Chain
  source 1..735: mol_type = other RNA
gaagtacaattagtagaaagtggagcagaagtaaaaaaaccaggtagttcagtaaaagtaagttgtaaagcatcaggaggaacattttcaagttacggaatatcatgggtaagacaagctccaggacaaggattagaatggatgggagatataataggaatgtttggaagtacaaattatgcacaaaattttcaaggaagactaacaataacagcagatgaaagtacttcaacagcatatatggaattatcatcactaagaagtgaagatacagcagtatattattgtgcaagaagtagcggatattatccagcatatttaccacattggggacaaggaacattagttacagtaagtagtggaacaggaggaagtggaggaacaggatcaggaacagggggatcaacagaaatagtgctaacacaaagtcctggaacattatcattatcaccaggagaaagagcaacactaagttgcagggcatcacaaagtgtaagcagcagttatttagcatggtatcaacaaaaaccaggacaagcaccaagactattaatatatggagcaagcagtagagcaacaggaataccagatagatttagtggaagtggaagtggaacagattttacattaacaataagtagactagaaccagaagattttgcagtatattattgtcaacaatatggaagtagtccaagaacatttggaggaggaacgaaagtagaaataaaaaga

SEQ ID NO: 51019 - RNA, 735 nt, synthetic construct
  misc_feature 1..735: note = derived and/or modified sequence opt6 from anti-influenza_Chain
  source 1..735: mol_type = other RNA
gaagtccaattagtagaatcaggagcagaagtaaaaaaaccaggaagttcagtaaaagtatcatgtaaagcaagtgggggaacattcagtagttatgcgataagttgggtaagacaagcaccaggacaaggactagaatggatgggaggaataataggaatgtttggaacagcgaattatgcacaaaaatttcaaggaagagtaacaataacagcagatgaatttacaagcacggcatatatggaactaagcagtttaagaagtgaagatacagcagtatactattgtgcaagaggaaattattattatgaaagcagtttagattattggggacaaggaacattagtaacagtaagtagtggaacaggaggaagcggaggaacaggaagtggaacaggtggaagtacacaaagtgtagtaacgcaacctccatcagtaagcgtagcaccaggacaaacagcaaggataacatgtggtggaaataatataggatcaaaaagtgtacattggtatcaacaaaaaccaggacaagcaccagtattagtagtatacgatgattcagatagaccaagcggaataccagaaagatttagtggaagtaacagcggaaatacagcaacattaacaataagtagagtagaagcaggagatgaagcagattattattgtcaagtatgggatagtagtagtgatcattatgtatttggaacaggaacgaaagtaacagtattagga

SEQ ID NO: 51020 - RNA, 735 nt, synthetic construct
  misc_feature 1..735: note = derived and/or modified sequence opt6 from anti-influenza_Chain
  source 1..735: mol_type = other RNA
gaagtacaattagtacaaagtggagcagaagtaaaaaaacctggagcatcagtaaaagtttcatgtaaagcatcaggatatacgtttacaggatattatgtatattgggtaagacaagcacctggacaaggattagaatggatgggatggataagcgcatataatggaaatacaaattatgcacaaaaatttcaaggaagagtaacaataacagcagataaatcaacatcaacagcatatatggaattaagctcattaagaagtgaagatacagcagtatattattgtgcaagatcaagaagcttagatgtatggggacaaggaacaacagtaacagtatcaagtggaacaggtggaagcggtggtacaggatcaggaacaggaggaagtacagacgtagtaatgacacaaagcccagactcactagcggtatcattaggagaaagagcaacaataaattgcaaaagttcacaatcagtattatatagtagcaataataaaaactatttagcgtggtatcaacaaaaaccaggacaacctccaaaattattaatatattgggcatcaacaagagaatcaggagtaccagatagatttagtggaagtggatcaggaactgactttacattaacaatatcgagtctacaagcagaagacgtagcagtatattattgtcaacaatactatagcacaccactaacttttggaggaggaacaaaagtagatataaaaaga

SEQ ID NO: 51021 - RNA, 735 nt, synthetic construct
  misc_feature 1..735: note = derived and/or modified sequence opt6 from anti-influenza_Chain
  source 1..735: mol_type = other RNA
gaagtacaattagtagaaacaggagcagaagtaaagaaaccaggatcaagtgtaaaagtaccatgtaaaagtagcggaagtccatttagaagtaatgcggtaagttgggtaagacaagcaccagggcaaggattagaatgggtaggaggaatattaggagtatttggaagtccaagttatgcacaaaaatttcaaggaagagtaacaataacagcagatgaaagtacaaatacagtgcatatggaattgagaggattgaggtcagaagatacagcagtatattattgtgcaagaggaccaacatattattatagttatatggatgtatggggaaaagggacaacagtaacagtgagctcaggaacaggaggatcaggaggaacaggaagtggaacaggaggaagtacaagttatgtattaacacaaccaccaagtgaaagtgtagcacctggacaaacagcaagaataacatgtggaggaaataacataggaagaaatagtgtacattggtatcaacaaaaaccaggacaagcaccagtgttagtagtatatgatgacagtgatcgaccaagtggaataccagaaagatttagtggaagtaaaagcggaaatacagcaacactaataataagtagagtagaagtaggagatgaggcagattactattgccaagtatggcattcaagtagtgatcattatgtatttggaacaggaacaaaagtaacagtattagga

SEQ ID NO: 51022 - RNA, 735 nt, synthetic construct
  misc_feature 1..735: note = derived and/or modified sequence opt6 from anti-influenza_Chain
  source 1..735: mol_type = other RNA
caaatgcaattagtacaaagcggcgcagaagtaaaaaaaccaggaagttcagtaaaagtatcatgtaaagcatcaggagggacatttagttcatatgcaatctcatgggtaagacaagcaccaggacaaggattagaatggatgggaggaatatttggaatgtttggaaccgcaaattatgcacaaaaatttcaaggaagagtaacaataacagcagatgaatttacatcagcagcttatatggaattaagtagtctcggaagtgaagatacagcaatgtattattgtgcaagatcaagcggatattatccacaatattttcaagattggggacaaggaactttagtaacagttagtagtggaacaggaggaagtggaggaacaggaagcggaacaggaggatcaacagaaatagtaatgacccaatcaccaggaacattaagcttaagtccaggacaaagagcaacactaagctgtagagcaagccaatcagtaagttcaagctatttagcatggtatcaacaaaaaccaggacaagctccaagattattaatgtatggagcatcaagcagagcaacaggaataccagatagattcagtggaagtggaagtggaacagattttacattaacaatatcgagattagaaccagaagattttgcagtatattattgtcaacaatacggaagtagctcattaacgtttggaggaggtacaaaattagaaataaaaaga

SEQ ID NO: 51023 - RNA, 735 nt, synthetic construct
  misc_feature 1..735: note = derived and/or modified sequence opt6 from anti-influenza_Chain
  source 1..735: mol_type = other RNA
caagtacaattagtacaaagtggagcagaagtaaaaaaaccaggaagtagtgtaaaagtaagctgtaaagcaagcggagtaacatttagttattatgcaatgagctgggtaaggcaagcaccaggacaaggattagaatggatgggaggaataagtccaatgtttggaacaacaacatatgcgcagaaatttcaaggaagagtaacaataacggcagatgattcaacaagtacagcatatatggaagtaagaagtttaagatcagaagatacagcagtatattattgtgcaagatcaagtaattattatgatagtgtatatgattattggggacaaggaacattagtgacagtaagtagcggaacaggaggaagtggaggaacagggagtggaacaggaggaagtacacaaagtgtagtaacacaaccaccaagtgaatcagtagcaccagggcaaacagcgagaataacatgtggaggacataatataggaagtaattcagttcattggtaccaacaaaaacctggacaagcaccagtactagtagtatatgataatagtgatagaccaagtggaataccagaaaggttttcaggaagtaatagtggaaatacagcaacattaacaatatcaagagtagaagcaggtgatgaagcagattactattgtcaagtatggggaagtagtagtgatcattatgtatttggaacaggaacaaaagtaacagtattagga

SEQ ID NO: 51024 - RNA, 738 nt, synthetic construct
  misc_feature 1..738: note = derived and/or modified sequence opt6 from anti-influenza_Chain
  source 1..738: mol_type = other RNA
caagtacaattagtacaaagtggaggaggattagtaaaaccaggaggatcattaagactttcatgtgctgctagtggatttacatttagcagttatagtatgaattgggtaagacaagcacctggaaaaggattagaatgggtatcgagtataagctcatcatcatcatatatatattacgtggattcagtaaaaggaagatttacaataagtagagataatgctaaaaatagcttatatttacaaatgaatagtttaagagcagaagatacagcagtatattattgtgcaagaggaggaggaagttatggagcatacgaaggattcgattattggggacaaggaacattagtaacggtatcatcaggaacaggaggatcaggaggaacaggaagtggaacaggaggaagtacagaaatagttttaacacaaagcccaggaacattaagcctaagcccaggagaaagagcaacattaagttgtagagcaagccaaagagtatcaagttacctagcatggtaccaacaaaaaccgggacaggcaccaagactattaatatatggagcatcaacaagagcagcaggaataccagatagattcagtggaagtggaagcggaacagattttacattaacaataagtagattagaaccagaagatagtgcagtgtattattgtcaacaatatggaagaacaccacttacatttggaggaggaacaaaagtagaaataaaaaga

SEQ ID NO: 51025 - RNA, 738 nt, synthetic construct
  misc_feature 1..738: note = derived and/or modified sequence opt6 from anti-influenza_Chain
  source 1..738: mol_type = other RNA
gaagtacaactagtagaaagtggagcagaagtaaaaaaaccaggatcaagtgtaaaagtaagttgtaaagcaagtggaggaccatttagaagttatgcaataagctgggtacgacaagcaccaggacaaggaccagaatggatgggtggaataataccaatatttgggacaacgaaatatgcgccaaaatttcaaggaagagtaacaataacagcagatgattttgcaggaacggtatatatggaattaagtagtttaagatcagaagatacagcaatgtattattgtgcaaaacatatgggatatcaagtaagagaaacaatggatgtatggggaaaaggaacaacagtaacagtatctagtgggacagggggaagtggaggaacaggtagtggaacagggggaagtacaagttacgtattaacacaaccaccgtcggtaagtgtagcaccaggacaaacagcaagaataacatgtggaggaaataatataggaagtaaaagtgtacattggtatcaacaaaaaccaggacaagcaccagtattggtagtatatgatgactcagatagaccaagtggaataccagaaagatttagtggaagcaatagtggaaacacagcaacattaacaatatcaagagtagaagcaggagatgaagcagattattattgtcaagtatgggatagtagtagtgatcatgcagtatttggaggaggaacacaactaacagtattaggg

SEQ ID NO: 51026 - RNA, 738 nt, synthetic construct
  misc_feature 1..738: note = derived and/or modified sequence opt6 from anti-influenza_Chain
  source 1..738: mol_type = other RNA
gaagtacaactagtagaaacaggagctgaagtgaaaaaaccaggagcaagcgtaaaagtaagttgtaaagcaagtggatatacatttacaagctattacatgcattgggtaagacaagcaccaggacaaggattagaatggatgggatggataaatccaaatagcgggggaacaaattatgcacaaaaatttcaaggaagagtaacaatgacaagagatacaagtataagcacagcatatatggaactaagtagattaagaagtgatgatacagctgtatactattgtgcaagagaaggaaaatggggaccacaagcagcatttgatatatggggacaaggaacaatggttacagtaagcagtggaactggaggatcagggggaacagggtcaggaacaggaggaagcacagaaatagtaatgacacaatcaccaggaacattaagcctaagtcctggtgaaagagcaacattatcatgtagagcaagtcaaagcgtaagctcaagttatctagcatggtatcaacaaaaaccaggacaagcaccaagattattaatatatgatgcatcaagtagagcaacagatataccagatcgatttagtggaagtggaagtggaacagattttacattaacaatatcaagactagaaccggaagattttgcagtatattattgtcaacaatatggaagctcattatggacatttggacaaggaacaaaagtagaaataaaaaga

SEQ ID NO: 51027 - RNA, 738 nt, synthetic construct
  misc_feature 1..738: note = derived and/or modified sequence opt6 from anti-influenza_Chain
  source 1..738: mol_type = other RNA
gaagtacaattagtggaatcaggaggaggattagtacaacctggaggatcattaagattaagttgtgcagcctcaggatttacatttagtatatatgcgatgtcatgggtaagacaagcaccaggaaaaggcttagaatgggtatcagcaataagctcaagtggagattcaacatattatgcagactcagttaaaggaagatttacaatatcaagagataatgcaagaaatacattatatttacaaatgaactcattaagagctgaagatacagcagtatattattgtgcaagagcttatggatacacatttgatccatggggacaaggtacattagtaacagtatcatcaggtacaggaggatcagggggtacaggatcaggaacaggaggaagtacagaaattgtattaacacaaagtccactatcactaccagtaacaccaggagaaccggcatcaatatcatgtagaagttcacaaagtctactacattcgaatggatataattatttagattggtatttacaaaaaccaggacaatcacctcaattattaatatatttaggatcaaatagagcaagtggagtaccagatagattctcaggatcaggatcaggaacagattttacattaaaaataagtagagttgaagcagaagatgtaggagtatactattgtatgcaagcactacaaacaccattaacattcggaggaggaacaaaagtagaaatcaaaaga

SEQ ID NO: 51028 - RNA, 738 nt, synthetic construct
  misc_feature 1..738: note = derived and/or modified sequence opt6 from anti-influenza_Chain
  source 1..738: mol_type = other RNA
gaagtacaactagtagaaacaggagcggaagtaaaaaaaccaggaagttcggtaaaagtgtcttgcaaagcaagtggagggacatttagaacacatgcaataagttgggtaagacaagcaccaggacaaggactagaatggatgggaggaataatagcaatatttggaacagcaaattatgcacaaaaatttcaaggaagaataacaataaccgcggatgaaagtacaagtacagcatatatggaacttagtagtctaagaagcgaagatacggcagtatatttttgtgcaagagggagtggatatcacataagtacaccatttgataattggggacaaggaacattagtaacagtaagttcaggaacaggaggaagtggaggaacaggatcaggaacaggaggaagtacaagttatgtattaactcaaccaccaagtgtaagtgtagcaccaggtcaaacagcaagaataacatgtggaggaaataatataggatcaaaaggagtacattggtaccaacaaaaaccagggcaagcaccagtactagtagtatatgatgatagtgatagaccaagcggaataccagaaagattttcaggaagcaatagtggaaacacagcaacattaacaataagtagagtggaagcaggagatgaagcagattattattgtcaagtatgggattcaagtagtgatcatgtagtatttggaggaggaactaaactaacagtactagga

SEQ ID NO: 51029 - RNA, 738 nt, synthetic construct
  misc_feature 1..738: note = derived and/or modified sequence opt6 from anti-influenza_Chain
  source 1..738: mol_type = other RNA
gaagtacaattagtacaatcaggagcagaagtaaaaaaaccaggaagttcagtaaaagtatcatgtaaagcttcaggaggaatatttagaagcaattcaatatcatgggtaagacaagcaccaggacaaggattagaatggatgggaggaatatttgcattatttggtacaacagattatgcacaaaaatttcaaggaagagtaacaataacagcagatgaatcaagcacaacagtatatctagaattaagttcattaacaagtgaagatacagcagtatattattgtgcaagaggatcaggatatacaacaagaaattattttgactactggggacaaggaacattagtaacagtaagctcaggaacaggtggaagtggaggaacaggatcaggaacaggtggaagtacagaaatagtattaacacaaagcccaggaacattatcactatcaccaggagaacgagcaacattatcatgtagagcatcacaatcagtaagtagtaattacttaggatggtatcaacaaaaaccaggacaagcaccaagactattaatttatggtgcaagtagcagagcatcaggaataccagatagattttcaggaggaggatcaggaacagattttacattaacaataagtagattagagccagaagattttgcagtatattattgtcaacaatatggatcaagtccattaacctttggaggtggaacaaaagtagaaataaaaaga

SEQ ID NO: 51030 - RNA, 738 nt, synthetic construct
  misc_feature 1..738: note = derived and/or modified sequence opt6 from anti-influenza_Chain
  source 1..738: mol_type = other RNA
gaagtacaattagtagaatcaggagcagaagtaaaaaaacccggatccagtgtaaaagtatcatgtaaagcaagcggaggaatatttaattcatacgcaataagttgggtaagacaagcaccaggacaaggattagaatggatgggaggaataatagcaatatttcatacaccaaaatacgcacaaaaatttcaaggaagagtaacaataacagcagatgaatcaacaaatacagcatatatggaattaagatcattaaaaagtgaagatactgctttatattattgtgcaagaggaagcacatatgacttttcaagcggactagattattggggacaaggtacattagtaacagtaagttcaggaacgggaggaagtggaggaacaggatcaggtacaggaggaagtacacaagcaggactaacacaacctccaagtgtaagtgtagcaccaggacaaacagcgagaataacatgtggaggaaacaatataggaagcaaaagcgtacattggtatcaacaaaaacctggacaagcaccagtattagtagtatatgatgatagcgatagaccaagtggaataccagaaagattttcaggatcaaattcaggaaatacagcaacactaacaataagtagagtagaagcaggagatgaagcagattattattgtcaagtatgggattcaagtagtgatcatgtagtatttggaggaggaacaaaactaacagtactagga

SEQ ID NO: 51031 - RNA, 741 nt, synthetic construct
  misc_feature 1..741: note = derived and/or modified sequence opt6 from anti-influenza_Chain
  source 1..741: mol_type = other RNA
caaatgcaattagttcaaagtggagcagaagtaaaaaaaccaggaagctcagtaaaagtaagttgtaaagcatcaggaggaacatttagtagttatgctataacatgggtaagacaagcaccaggacaaggattagaatggatgggaggaataataggaatgtttggtagcacaaattatgcacaaaattttcaaggaagagtgacaataacagcagatgaatcaacaagcacagcatatatggaactatcatcactaagatcagaagatacagcagtatattattgtgcaagaagtacaggatattatccagcatatttacatcattggggacaaggaacattagtaacagtaagttcaggaacaggaggaagtggaggtacaggatcaggaacaggaggaagcacacaaagtgcgctaacacaaccaagaagtgtaagcggaagtccaggacaaagtgtaacaatatcatgcacaggaacatcaagtgatgtaggaggatataattatgtatcatggtatcaacaacatcctggaaaagcaccaaaattaatgatatatgatgttagtaaaagaccatcaggagtaccagatagatttagtggaagtaaaagtggaaatacagcaagtttaacaatatcaggattacaagcagaagatgaagcagattattactgtagttcatatacgagcagtagtacacatgtatttggaacagggacaaaagtaacggtattagga

SEQ ID NO: 51032 - RNA, 744 nt, synthetic construct
  misc_feature 1..744: note = derived and/or modified sequence opt6 from anti-influenza_Chain
  source 1..744: mol_type = other RNA
gaagtgcaattagtagaaagtggagcagaagtaaaaaaaccaggatcaagtgtaaaagtatcatgtaaagcgagtggaggacctttcagaagttatgcaataagttgggtcagacaagcaccaggacaagggccagaatggatgggaggaataataccaatatttggaacaacaaaatatgcaccaaaatttcaaggaagagtaacaataacagcagatgattttgcaggaacagtatatatggaattgtcaagtctaagaagtgaagatacagctatgtattattgtgctaaacatatgggatatcaagtaagagaaacaatggatgtatggggaaaagggacaacagtaacagtaagtagtggaacaggaggaagtggaggaacaggttcaggaacaggaggatcaacaagttatgttttaacacaaccaccaagtgcaagtggaacaccaggacaacgagtaacaatatcatgttcaggatcaacatttaatataggaagtaatgcagttgattggtatagacaattaccaggaacagcaccaaaactattaatatatagtaataatcaaagaccaagtggagtgccagatagatttagcggaagtcgaagtggaacaagtgcatcattagcaatatcaggattgcaatcagaagatgaagcagattattactgtgcagcatgggatgatatattaaatgtaccagtatttggaggaggaacaaaattaacagtattagga

SEQ ID NO: 51033 - RNA, 744 nt, synthetic construct
  misc_feature 1..744: note = derived and/or modified sequence opt6 from anti-influenza_Chain
  source 1..744: mol_type = other RNA
caagtacaattagtacaaagtggagcagaagtcaaaaaaccaggatcaagcgtaaaagtaagctgtaaagcaagtggaggaccattcagaagctatgcaataagctgggtaagacaagcaccaggacaaggaccagaatggatgggaggaataataccgatattcggaacaacaaaatacgcaccaaaatttcaaggaagagttacaataacagcagacgattttgcaggaacagtatatatggaactatcaagcttaagatcagaagatacagcaatgtattactgtgcaaaacacatgggatatcaagtgagagaaacaatggacgtatggggaaaaggaacaacagtaacagtaagtagtggaacaggaggatcaggaggaacaggaagcggaacaggaggatcaacacaaagcgcactaacacaaccagcagcagtatcaggatcaccaggacaaagtataacaataagttgcacgggaacaagcagcgacgtaggaggatacaattacgtgagctggtaccaacaacatccaggaaaagcaccaaaactaatgatatatgaagtaagcaatagaccaagtggagtatcaaacagattctcaggatcaaaatcaggaaatacagcaagcttaacaataagtggattacaagcagaagacgaagcagattattattgctcaagctatacatcaagcagtacatatgtatttggaacaggtacaaaagtaacagtattaggg

SEQ ID NO: 51034 - RNA, 744 nt, synthetic construct
  misc_feature 1..744: note = derived and/or modified sequence opt6 from anti-influenza_Chain
  source 1..744: mol_type = other RNA
gaagtacaattagtggaaagtggagcagaagtgaaaaagccaggaagtagcgtaaaagtaagttgtaaagcaagtggaggaccatttagaagttacgcaataagctgggtaagacaagcaccaggacaaggaccagaatggatgggaggaataataccaatatttgggacaacaaaatatgcaccaaaatttcaaggaagagtaacgataacagcagatgattttgcaggaacggtatatatggaattaagtagtttaagatcagaagatacagcaatgtattattgcgcaaaacatatgggatatcaagtaagagaaacaatggatgtgtggggaaaaggaacaacagtaacagtaagtagcggaacaggtggaagcggaggaacaggaagtggaacaggaggaagtacaagttatgtattaacgcaaccaccaagtgtaagcggaacaccaggacaaagagtaacaataagttgtagcggatcgagaagtaatgtaggagataattcagtatattggtatcaacatgtaccagaaatggcaccaaaattattagtatataaaaatacacaaagaccaagtggagtaccagcaagatttagcggaagtaaaagtggaacatcagcaagtctagcgataattggattgcaaagtggagatgaagcagattattattgtgtagcatgggatgatagtgtagacggatatgtatttggaagtggaacaaaagtaacagtattagga

SEQ ID NO: 51035 - RNA, 744 nt, synthetic construct
  misc_feature 1..744: note = derived and/or modified sequence opt6 from anti-influenza_Chain
  source 1..744: mol_type = other RNA
gaagtacaattagttgaaagtggagcagaagtaaaaaaaccaggatcaagtgtaaaagtaagctgtaaagcaagtggaggaccatttagaagttatgcaatatcatgggtaagacaagcacctggacaaggaccagaatggatgggaggaataataccaatattcggaacaacaaaatacgcaccaaaatttcaaggaagggtaacaataacagcagatgatttcgcaggaacagtatacatggaattaagttcattaagaagtgaagatacagcaatgtattattgtgcaaaacatatgggatatcaagtaagagaaacaatggatgtatggggaaaagggacaacagtaacagtaagcagtggaacaggaggaagcggagggacaggaagtggaacaggaggatcaacaagttacgtattaacacaaccaccaagtgcaagtggaacaccagggcaaagagtaacaataagctgtagtggatcaagtagtaatataggatcaaattatgtatattggtaccaacaattaccgggaacagcaccaaaattattaatatatagagatggacaaagaccaagtggagtaccagatagatttagtggaagtaaatcaggaacaagcgcaagtttagcaataagcggactaagaagcgatgatgaagcggattattattgtgcaacgtgggacgataatttaagtggaccagtatttggaggaggaacaaaattaacagtactagga

SEQ ID NO: 51036 - RNA, 744 nt, synthetic construct
  misc_feature 1..744: note = derived and/or modified sequence opt6 from anti-influenza_Chain
  source 1..744: mol_type = other RNA
gaagtacaattagtagaatcaggagccgaagtaaaaaaaccaggaagtagcgtaaaagtaagctgtaaagcaagtggaggaacatttagtttttatagtatgagctgggtaagacaggcaccaggacaaggattagaatggatgggaggaataataccaatgtttggaacaacaaattatgcacaaaaatttcaaggaagagtaacaataacagcagtagaaagtacaagtacagcatatatggaagtatcaagtttaagaagtgaagatacagcagtatattattgtgcaagaggagataaaggaatatattattattatatggatgtatggggtaaaggaacaacagtaacagtaagtagcggaacaggaggatcaggaggaacaggaagtggaacaggaggaagtacacaaagtgcgttgacgcaaccagcatcagtatcaggatcaccaggacaaagtataacaataagctgtacaggaacaagtagtgatgtaggaggatataattatgtgagctggtatcaacaacatccaggaaaagcaccaaaattaatgatatatgaagtaagtaatagaccaagcggggtaagtaatagattttcaggatcaaaaagcggtaatacagcaagtctaacaataagtggattacaagcagaagatgaagcagattattattgtagttcatatacaagtagcagtacattagtattcgggacaggaacaaaagtaacagtattagga

SEQ ID NO: 51037 - RNA, 744 nt, synthetic construct
  misc_feature 1..744: note = derived and/or modified sequence opt6 from anti-influenza_Chain
  source 1..744: mol_type = other RNA
atgagtctatttggagatacaatagcatatttattaagcttaatagaagacggagaaggaaaagcagaattagcagaaaaattacactgttggtttggaggaaaagaattcgatctagatagcgcactagaatggataaaaaataaaagatgcttaacagatatacaaaaagcactaataggagcaagtatatgctttttaaaaccaaaagaccaagaaagaaaaagaagatttataacagaaccattatcaggaatgggaacaacagcaacaaaaaaaaaaggattgatattagcagaaagaaaaatgagaagatgtgtatcattccatgaagcattcgaaatagcagaaggacacgaaagtagcgcattactatattgcttaatggtaatgtatttaaatccagaaaattatagcatgcaagtaaaactaggaacgctatgtgcattatgcgaaaaacaagccagtcactcgcacagagcacatagcagagcagcaagatcaagcgtaccaggagtcagacgagaaatgcaaatggtaagtgcaatgaataccgcaaaaacgatgaatggtatgggaaaaggagaggacgtacaaaaactagcagaagaactacaaaataatataggagtattaagatcattaggggcatcacaaaaaaacggagaaggaatagcaaaagatgtaatggaagtactaaaacaatcaagtatgggaaacagtgcactagtaagaaaatactta

SEQ ID NO: 51038 - RNA, 747 nt, synthetic construct
  misc_feature 1..747: note = derived and/or modified sequence opt6 from anti-influenza_Chain
  source 1..747: mol_type = other RNA
gaagtacaattagtagaaagtggagcagaagtaaaaaaaccaggatcaagtgtaaaagtaagctgtaaagcaagtggaggaccatttagaagttacgcaataagttgggtaagacaagcacctggacaaggtccagaatggatgggaggaataataccaatatttggaacaacaaaatatgcaccaaaatttcaaggaagagtaacgataacagcagatgactttgcaggaacagtatatatggaactatcatcattaagatcagaagatacagcaatgtattattgtgcaaaacatatgggatatcaagtaagagaaacaatggatgtttggggtaaaggaacaacagtaacagtaagttcaggaacaggaggaagtggaggaacaggatcaggaacaggaggaagtacacaaagtgttttaacacaaccaccaagtgtaagtgcagcaccaggacaaaaagtaacaataagctgtagcggaagttcaagcaatataggaaatgactatgtaagttggtatcagcaactaccaggtactgcaccaaaactactaatatatgataataataaaagaccaagcggaataccagacaggtttagtggatcaaaaagcggaacaagtgcaacattaggaataacaggactacaaacaggtgatgaagcaaattattattgtgcgacgtgggatagaagaccaacagcatatgtagtatttggaggaggaacaaaactaacagttttagga

SEQ ID NO: 51039 - RNA, 750 nt, synthetic construct
  misc_feature 1..750: note = derived and/or modified sequence opt6 from anti-influenza_Chain
  source 1..750: mol_type = other RNA
caagtacaattagtacaatcaggagcagaagtaaaaaaaccaggatcaagcgtaagagtatcatgtaaagcatcaggaagtatatttagaaattatgcaatgtcatgggtacgacaagcaccaggacaaggattagaatggatgggaggaataatagcaatttttggtacaccaaaatatgcacaaaaatttcaaggaagagtaacaataacagcagatgaaagcacatcaactgtatatatggaattaagtggattaagaagtgaagatacggcaatgtattattgtgcaagaatacctcattataactttggaagcggaagttattttgactattggggacaaggaacattagtaacagtaagtagtggtacaggaggaagtggaggaacaggaagtggaacaggaggaagtacaacagtactaactcaaccaccatcagtatcaggagcaccaggacaaagagtaacaatatcatgcacaggatcatcatcaaacataggagcaggatatgatgtacattggtatcagcaattaccaggaacagcaccaaaattattaatttatggaaattcaaatagaccaagcggagtaccagatagattttcaggaagcaaaagtggaacaagtgcaacactaggaataacaggattacaaacaggagatgaagctgattattattgtggaacatgggattcaagtttaagtgcatatgtatttggaacagggacaaaagtaacagtattagga

SEQ ID NO: 51040 - RNA, 756 nt, synthetic construct
  misc_feature 1..756: note = derived and/or modified sequence opt6 from anti-influenza_Chain
  source 1..756: mol_type = other RNA
gaagtacaactagttgaatcaggagcagaagtaaaaaaaccaggaagtagtgtaaaagtatcatgtaaagcaagcggtcatatattcagtggatatgcaatatcatgggtacgacaagcaccaggacaaggattagaatggatgggaggcataataccaatttttggtacaacaaactacgcacaaaaatttcaaggaagagtaacaatcacagcagatcaatcaacatcaacagcatatatggatttaagtaatcttagaagtgaagacacagcagtatattattgtgcaagagtaaaagatggctattgtacattaacaagctgtccagtaggatggtattttgatttatggggaagaggaactttagtaacagtaagtagtggaacaggaggatcaggaggaacaggaagcggaactggaggatcaactgaaatagtaatgacacaaagtcctggaacattaagcctaagtccaggagaaagagcaacattaagctgtagagcatcacaaagtgtatcatcaagttatttagcatggtatcaacaaaaaccgggacaagcaccaagattactaatatttggagcaagtagtagagccacaggcataccagatagattttcaggaagcggaagcggaacagattttacattaacaatatcaagattagaaccagaagattttgcagtatattattgtcaacaatacggatcatcattaacatttggaggaggaactaaattagaaataaaaaga

SEQ ID NO: 51041 - RNA, 768 nt, synthetic construct
  misc_feature 1..768: note = derived and/or modified sequence opt6 from anti-influenza_Chain
  source 1..768: mol_type = other RNA
caagtacaattagtacaaagtggagcagaagtaaaaaaacctggatcatcagtaaaagtaagttgcaaagcatcaggaggctttttctcatcatacgcaatatcatgggtaagacaagcaccaggacaaggattagaatggatgggaggagtaataccaatattcagaacagcaaactatgcacaaaactttcaaggaagagtaacaattacagcagacgaatttacatcatacatggaactatctagcctaagatcagacgatacagcagtatactactgtgctagactaaattaccacgactcaggaacatactataacgcaccaagaggatggttcgacccatggggacaaggaacactagttacagtatcatcaggaacaggaggaagcggaggaacaggatctggaacaggaggatcaactgacatacaaatgactcaatcaccagattcattagcagtatcactaggagaaaaagcaacaataaactgtaaaagttcacaaagcatattaaactcatcaaataataaaaattacttagcctggtatcaacaaaaaccaggacaaccacccaaattattaatatactgggcaagtacaagagaaagtggagtaccagatagattctcaggttcaggaagcggaacagacttcacactaacaatatcatcattacaagcagaagacgtagcagtatactactgccaacaatactattcatcaccaccaacattcggacaaggaacaaaagtagaaataaaaaga

SEQ ID NO: 51042 - RNA, 768 nt, synthetic construct
  misc_feature 1..768: note = derived and/or modified sequence opt6 from anti-influenza_Chain
  source 1..768: mol_type = other RNA
caagtacaattagtacaatcaggagccgaagtaaagaaacctggatcaagtgtaaaagtatcatgtaaagcaagcggaggtttcttttcaagttatgcaatatcatgggtaagacaagctccaggacaaggcctagaatggatgggaggagtaataccaatatttagaacagcaaattacgcacaaaattttcaaggaagagtaacaataacagcagacgaatttacatcatacatggaattatcatcattaagatcagacgatacagcagtatactattgtgcaagattaaattatcatgactcaggtacatattataatgcaccaagaggatggtttgatccatggggacaaggaacattagtaacagtatcatcaggaacaggaggatcaggaggaacaggaagcggaacaggaggatcaacagatatacaaatgacacaaagtccagactcattagcagtatctttaggagaaaaagcaacaataaactgcaaatcatcacaatcaatattaaacagcagtaataataaaaattatttagcatggtatcaacaaaaacctggacaaccaccaaaattactaatatactgggcaagtacaagagaaagcggagtaccagacagattctcaggatcaggaagcggaacagatttcacattaacaataagttcattacaagcagaagatgtagcagtttattattgtcaacaatattacagctcaccaccaacatttggacaaggaacaaaagtagaaataaaaaga

SEQ ID NO: 51043 - RNA, 771 nt, synthetic construct
  misc_feature 1..771: note = derived and/or modified sequence opt6 from anti-influenza_Chain
  source 1..771: mol_type = other RNA
atatgcataggataccacgcaaacaacagcacagaacaagtcgacacaataatggaaaaaaacgtaacagtaacccacgcacaagacatattagaaaaaacacacaacggaaaactatgcgacctagacggagtaaaaccattaatactaagagactgttccgtagcaggatggctactaggaaatccaatgtgcgatgaattcataaacgtcccagaatggtcatacatagtagaaaaagcaaacccagcaaacgacctatgttacccaggaaatttcaacgactacgaagaattaaaacacttactatcaagaataaatcacttcgaaaaaatacaaataataccaaaatcatcatggtcagaccacgaagcctcaagcggagtatcatcagcatgcccataccaaggcacaccatcatttttcagaaacgtagtatggctaataaaaaaaaacaacacatacccaacaatcaaacgatcatataataacacaaaccaagaagacttactaatactatggggaatacaccactctaacgacgcagcagaacaaacaaaactataccaaaacccaacaacatacatatcagtaggaacatcaacactaaaccaaagactagtaccaaaaatagcaacacgatcaaaagtaaacggacaaaacggaagaatggacttcttttggacaatattaaaaccaaacgacgcaataaacttcgaatcaaacggaaatttcatagcaccagaatacgcatacaaaatagtcaaaaaa

SEQ ID NO: 51044 - RNA, 771 nt, synthetic construct
  misc_feature 1..771: note = derived and/or modified sequence opt6 from anti-influenza_Chain
  source 1..771: mol_type = other RNA
atatgcataggataccacgcaaacaactccacagaacaagtagacacaataatggaaaaaaacgtaacagtaacacacgcacaagacatactagaaaaaacacacaacggaaaactatgtgatctagacggagtaaaaccactaattctaagagattgctcagtcgcaggatggttactaggaaatccaatgtgcgacgaattcataaacgtaccagaatggtcatatatagtagaaaaagcaaaccccgcaaacgacctatgctacccaggaaactttaacgactatgaagaactaaaacacctactatcacgcataaatcacttcgaaaaaatacaaataataccaaaatcatcatggtcagaccacgaagcatcatccggagtatcatcagcatgcccataccaaggaacaccatcatttttcagaaacgtagtatggctaataaaaaaaaacaacacatacccaacaataaaacgatcatacaacaacacaaaccaagaagatttacttatactatggggaatacaccacagcaacgacgcagcagaacaaacaaaactataccaaaacccaacaacatacatatcagtaggaacatcaacattaaaccaaagactagtaccaaaaatagcaacaagatcaaaagtaaacggacaaaacggaagaatggacttcttctggacaatactcaaaccaaatgacgcaataaacttcgaatcaaacggaaacttcatagcaccagaatacgcatacaaaatagtaaaaaaa

SEQ ID NO: 51045 - RNA, 777 nt, synthetic construct
  misc_feature 1..777: note = derived and/or modified sequence opt6 from anti-influenza_Chain
  source 1..777: mol_type = other RNA
atggtaaaatcaaaatatttagtatttataagtgtatttagcttattatttggagtatttgtagtaggatttagtcatcaaggagtaaaagcagaagaagaaagaccaatgggaacagcattttatgaatcatttgatgcatttgatgatgaaagatggtcaaaagcaggagtatggacaaatggacaaatgtttaatgcaacatggtatccagaacaagtaacagcagatggattaatgagattaacaatagcaaaaaaaacaacatcagcaagaaattataaagcaggagaattaagaacaaatgatttctatcattatggattatttgaagtaagtatgaaaccagcaaaagtagaaggaacagtaagtagtttttttacatatacaggtgaatgggattgggacggcgacccatgggatgaaatagatattgaatttttaggaaaagacacgacaagaatacaatttaattattttacaaatggagtaggcggaaatgaattttattatgatttaggatttgacgcaagcgaaagttttaatacatatgcatttgaatggagagaagatagtataacatggtatgtaaatggagaagcagtacatacagcaacagaaaatataccacaaacaccacaaaaaataatgatgaatctatggcctggagtaggagtagatggatggacaggagtatttgatggagataatacaccagtatattcatattatgattgggtaagatatacacctttacaaaattatcaaatacatcaa

SEQ ID NO: 51046 - RNA, 777 nt, synthetic construct
  misc_feature 1..777: note = derived and/or modified sequence opt6 from anti-influenza_Chain
  source 1..777: mol_type = other RNA
atggtaaaatctaaatatttagtattcataagcgtattttcattattatttggagtatttgtagtaggatttagtcatcaaggagtaaaagcagaagaagaaagaccaatgggaacagcattctatgaatcatttgatgcatttgacgatgaaagatggagtaaagcaggagtatggacaaatgggcaaatgtttaatgcaacatggtatccagaacaagtaacagcagacggactaatgagattaacaatagcaaaaaaaacaacatcagcaagaaattataaagcaggagaattaagaacaaacgacttttatcattacggattatttgaagtaagtatgaaaccagcaaaagttgaaggaacagtatcaagtttttttacatatacaggagaatgggattgggatggagatccatgggatgaaatagatatagaatttttaggaaaagacacgaccagaatacaatttaattactttaccaatggagtaggaggaaatgaattttattatgatttaggatttgatgcatcagaatcattcaatacatatgcatttgaatggagagaagactcaataacatggtatgtcaatggagaagcagtacacacggcaacagaaaatataccacaaacaccacaaaaaataatgatgaatttatggccaggagtaggagtagacggatggacaggagtattcgatggagataatacaccagtttattcatattatgattgggtaagatatacaccattacaaaactaccaaatacatcaa

SEQ ID NO: 51047 - RNA, 783 nt, synthetic construct
  misc_feature 1..783: note = derived and/or modified sequence opt6 from anti-influenza_Chain
  source 1..783: mol_type = other RNA
gatatacaaatgacacaatcaccatcaagtgtaagtgcatcagtaggagacagagtaacaataacatgtagagcatcacaagacataagtacatggttagcatggtatcaacaaaaaccaggaaaagcaccaaaactattaatatatgcagcatcatcactacaaagtggagtaccaagtaggttttcaggaagcggatcagggacagactttacattaacaataagctcattacaaccagaagattttgcaacatatttttgccaacaagcaaattcattcccaccaacatttggatgtggaacaaaactagaaataaaaggaggaggaggaagtggaggaggaggaagtggaggaggcggaagcggaggaggtggatcagaagtacaattagtagtaagcggaggaggattagtaaaaccaggaggaagtctaagattaagctgtgcagcaagcggattaagttttcttaatgcatggatgagttgggtaagacaggcaccaggaaaatgcttagaatgggtaggaagaataaaaagtaatacagatggaggaactacagactatgcagcacctgtaaaaggaagatttagcataagcagggatgatagcaaaaatatgttatttttacatatgagctcattaagaacggaagatactgcagtatattattgtgcaacagacggaccatatagtgatgactttagatcaggatatgcagcaagatatagatattttggaatggatgtatggggacaaggaacaaccgtaacagtaagctca

SEQ ID NO: 51048 - RNA, 783 nt, synthetic construct
  misc_feature 1..783: note = derived and/or modified sequence opt6 from anti-influenza_Chain
  source 1..783: mol_type = other RNA
gatatacaaatgacacaaagtccatcaagtgtttcagcatcagtaggagatagagtaacaataacatgtcgagcaagtcaagatataagtacatggttagcatggtatcaacaaaaaccaggaaaagcaccaaaattactaatatatgcagcaagttcattacaatcaggagtaccaagcagatttagtggaagtggatctggaacagattttacattaacaataagcagtttacaaccagaagactttgcaacatatttttgccaacaagcaaatagctttccaccaacatttggatgcggaacaaaattagaaataaaaggaggaggtggaagtggaggaggaggatcaggaggagggggttcaggaggaggaggatcagaagtacaattagtagtaagcggaggaggtctagtaaaaccaggaggaagtctaagattaagctgtgcagcatcaggattatcatttttaaacgcatggatgagctgggtaagacaagcaccaggaaaatgtttagaatgggtaggaagaataaaaagtaatacagatggaggaactacagattatgcagctccagtaaaaggaagatttagtatatcaagagatgatagcaaaaatatgttatttttacatatgtcaagtttaagaacagaagatacagcagtatattattgcgcaacagatggaccatatagtgatgactttagatcgggatatgcagcaagatatagatattttggaatggatgtttggggacaaggaacaacagtaacagtatcatca

SEQ ID NO: 51049 - RNA, 789 nt, synthetic construct
  misc_feature 1..789: note = derived and/or modified sequence opt6 from anti-influenza_Chain
  source 1..789: mol_type = other RNA
atgggattcgtcttattttcacaactaccaagctttctattagtatctacactactattattcttagtaataagccatagctgtcgagcacaaaatggaggatcatatccatataaatcaggagaatacagaacaaaatcatttttcggatacggatactatgaagtaagaatgaaagcagcaaaaaacgtaggaatagtatcatcattcttcacatacacaggaccatcagataacaatccatgggacgaaattgatatagaattcttaggaaaagacacaacaaaagttcaatttaattggtataaaaatggagtaggaggaaatgaatacttacacaatctaggatttgacgcatcacaagattttcatacatatggatttgaatggcgaccagactatatagatttctatgtagatggaaaaaaagtttacagaggaacaagaaacataccagtaacaccaggaaaaataatgatgaacctttggccaggaataggagtagacgaatggctaggaagatacgacggaagaacaccattacaagcagaatacgaatacgtaaaatattacccaaacggaagatcaaaattagtcgtaaacacaccatttgtagcagtatttagtaatttcgatagctcacaatgggaaaaagcagattgggcaaacggatccgtattcaattgcgtatggaaaccatcacaagtaacctttagtaatggaaaaatgatactaactctagatagagaatatgtagaccatcaccaccaccatcacaaagacgaacta

SEQ ID NO: 51050 - RNA, 789 nt, synthetic construct
  misc_feature 1..789: note = derived and/or modified sequence opt6 from anti-influenza_Chain
  source 1..789: mol_type = other RNA
atgggattcgtattatttagccaattaccaagctttttattagtatcaacattactactattcttagtaataagtcatagttgtagagcacaaaacggaggaagctacccatataaatcaggagaatacagaactaaaagctttttcggatacggatactatgaagtaagaatgaaagcagcaaaaaacgttggaatagtatcaagttttttcacatatacaggacctagcgataacaatccatgggacgaaatcgatatagaattcttaggaaaagacacaacaaaagtacaattcaattggtataaaaacggagtaggaggaaatgaatatttacacaatctaggatttgacgcatcacaagattttcatacatatggattcgaatggagaccagactatatagatttctacgtagacggaaaaaaagtatacagaggaacacgaaatataccagtaacaccaggaaaaataatgatgaacctatggcctggaataggagtagacgaatggctaggaagatacgatggaagaacaccactacaagcagaatacgaatacgtaaaatattacccaaacggaagatcgaaattagttgtaaacacaccatttgtagcagtatttagtaatttcgatagttcacaatgggaaaaagcagattgggcaaacggaagcgtgttcaattgcgtatggaaaccatcacaagtaacattttcaaatggaaaaatgatactaacactagatagagaatacgtagaccatcaccaccaccatcacaaagacgaatta

SEQ ID NO: 51051 - RNA, 840 nt, synthetic construct
  misc_feature 1..840: note = derived and/or modified sequence opt6 from anti-influenza_Chain
  source 1..840: mol_type = other RNA
atggcacaagtaggaagaggagcatcaccactttcaagagcaagagtaccaccattaccacatccattagatggtgaacatttaccacatgaccccgcaggtggaggacatggaaaagcatcatctcaagatgccccagtaggacaattaccaggtcacctagcaagaccagcattttttcattatttaaaaaattcttttttagtatgttcattaacaacagtttttgcactagctgttgcaacatttgcaggatatgcactagcaagatttagatttccaggagcagaattatttggtggttctgtattagtaacacaagtaataccaggaatattattcttaataccaatatatattatgtatatatatgtacaaaattgggtaagatcagcacttggattagaagtacgattagtaggatcttatggtggactagtatttacttatacagcattttttgtaccattatctatatggatattaagaggattctttgcatccataccaaaagaattagaagaagcagcaatggtagatggagcaacaccatttcaagcatttcatagagtaattctaccactagcattaccaggattagcagcaacagcagtatatatcttcttaacagcatgggatgaattactatttgctcaagtattaacaacagaagcaactgctacagttcctgtaggaatacgaaattttgtaggaaattatcaaaacaggtatgatttagtaatggcagcagcaacagtagcaacattaccagtattagtattatttttttttgtacaaagacaattaatacaaggattaacagcaggagcagttaaagga

SEQ ID NO: 51052 - RNA, 840 nt, synthetic construct
  misc_feature 1..840: note = derived and/or modified sequence opt6 from anti-influenza_Chain
  source 1..840: mol_type = other RNA
atggcacaagtaggaagaggagcatcaccattatcaagagcaagagtaccacctttacctcatccattagatggagaacatcttccacatgatccagcaggaggaggtcatggaaaagcatcatctcaagatgcacctgtaggacaactaccaggacacttagcaagaccagcattctttcattatttaaaaaattcttttttagtatgtagtttaacaacagtatttgcattagcggtagcaacttttgcaggatatgcattagcaagatttagatttccaggagcagaactctttggaggatcagtattagtaacacaagttataccaggaattttatttttaataccaatatatattatgtacatatatgttcaaaattgggttagatcagcattaggactagaagtacgattagtaggatcatacggtggattagtatttacatatacagcattttttgtaccattatctatatggatactaagaggattttttgcatctataccaaaagaattagaagaagcagctatggtagatggagcaacaccatttcaagcatttcatagagtaatattacctttagcattacctggactagcagccacagcagtatacatattcttaacagcatgggatgaattactttttgcacaagtactaacaacagaagcaacagcaacagtaccagtaggtattcgtaatttcgtcggaaactaccaaaatagatatgacttagtaatggcagcagcaacagtagcaacattacctgtattagtattatttttttttgtacaaagacaattaatacaaggtttaacagcaggagcagtaaaagga

SEQ ID NO: 51053 - RNA, 843 nt, synthetic construct
  misc_feature 1..843: note = derived and/or modified sequence opt6 from anti-influenza_Chain
  source 1..843: mol_type = other RNA
atggcagacaacatgacaacaacacaaatagaagtaggaccaggagcaaccaacgcaacaataaacttcgaagcaggaatattagaatgctacgaaagattctcatggcaacgagcactagactacccaggacaagacagattacatagactaaaaagaaaactagaatcaagaataaaaacacacaataaatcagaaccagaaaacaaaagaatgtcactcgaagaaagaaaagccataggagtaaaaatgatgaaagtattactattcatggacccaagtgcaggaatagaaggattcgaaccatactgtgtaaaaaacccctcaacatcaaaatgcccaaattacgattggacagattaccccccaacaccaggaaaatacttagacgatatagaagaagaaccagaaaacgtagaccacccaatagaagtagtactccgagacatgaacaataaagacgcaagacaaaaaataaaagacgaagtaaacacacaaaaagaaggaaaattcagactaacaataaaaagagatataagaaatgtattaagcttacgagtactagtaaacggaacattcctaaaacacccaaatggagacaaaagcctaagtacattacacagattaaacgcatacgaccaaaacggaggacttgtagcaaaactagtagcaacagacgacagaacagtagaagacgaaaaagacggacacagaatactaaatagcctattcgaaagattcgacgaaggtcatagcaaaccaataagagcagcagaaacagcggtaggagtactaagccaattcgggcaagagcacagactaagcccagaagaaggagataac

SEQ ID NO: 51054 - RNA, 843 nt, synthetic construct
  misc_feature 1..843: note = derived and/or modified sequence opt6 from anti-influenza_Chain
  source 1..843: mol_type = other RNA
atggcagacaacatgacaacaacacaaatagaagtaggaccaggagccacaaacgcaacaataaacttcgaagcaggaatactagaatgctacgaaagattctcatggcaaagagcattagactatccaggacaagacagactacacagattaaaaagaaaattagaatcaagaataaaaacacacaacaaaagcgaaccagaaaacaaaagaatgtcactagaagaaagaaaagcaataggagttaaaatgatgaaagttctactatttatggacccatcagcaggaatagaaggattcgaaccatactgtgtaaaaaacccatcaacaagcaaatgcccaaactatgactggacagactacccaccaacacccggcaaatacttagacgatatcgaagaagaaccagaaaacgtagaccacccaatcgaagtagtactaagagacatgaacaacaaagacgcaagacaaaaaataaaagacgaagtaaacacacaaaaagaaggaaaattcagactaacaataaaaagagacataagaaacgtcttaagcctaagagtattagtaaacggaacattcctaaaacacccaaacggagacaaaagtttgagtacactccacagattaaatgcatacgaccaaaacggaggcctagtagcaaaattagtagcaacagatgatagaacagtagaagacgaaaaagacggacacagaatattaaattcactattcgaaagatttgacgaaggacacagcaaaccaataagagcagcagaaaccgcagtaggagtattatcccaattcggacaagaacacagactatcaccagaggaaggagacaac

SEQ ID NO: 51055 - RNA, 858 nt, synthetic construct
  misc_feature 1..858: note = derived and/or modified sequence opt6 from anti-influenza_Chain
  source 1..858: mol_type = other RNA
atgtgtactatgccattaatgaaattaaaaaaaatgatgagaaggacagcatttttattaagtgtattaataggatgtagcatgctaggaagcgatcgatcagataaagcaccacattgggagttagtatggagcgatgaatttgattattcaggactaccagatccagaaaaatgggattatgatgtaggaggacatggatggggaaatcaagaactacaatactataccagagcaaggattgaaaatgcaagagtaggaggaggagtattaataatagaagctcgacatgaaccatatgaaggaagagaatatactagtgcaagattagtaacaagaggaaaagcaagttggacatatggaagattcgaaataagagcaaggttaccaagtggtagaggaacatggccagcaatatggatgttaccagatagacaaacatatggaagtgcatattggccagataatggagaaatagatataatggaacatgtaggatttaatccagatgtagtacatggaacagtgcacacaaaagcatataatcatctgctaggaacgcaaagaggaggaagtataagagtaccaacagcaagaacagattttcatgtatacgcaatagaatggacgccagaagaaataagatggtttgtggatgatagcttatactatagatttcctaatgaaagactaacagatccagaagcagattggagacattggcctttcgatcaaccatttcatttaataatgaatatagcagtaggaggagcatggggtggacaacaaggagtagatccagaagcatttccagcacaactagtagtagactatgtaagagtatatagatgggtagaa

SEQ ID NO: 51056 - RNA, 858 nt, synthetic construct
  misc_feature 1..858: note = derived and/or modified sequence opt6 from anti-influenza_Chain
  source 1..858: mol_type = other RNA
atgtgtacaatgccactaatgaaattaaaaaaaatgatgagaagaacggcatttctattaagtgtattaataggatgtagtatgttagggagcgatcgaagtgataaagcaccacactgggaattagtatggagtgatgaattcgactatagtggattaccagatccagaaaaatgggattatgatgtaggaggacatggatggggaaatcaagaattacaatactatacaagagcaagaatagaaaatgctagggtaggaggaggagtattaataatagaagctagacatgaaccatatgaaggaagagaatatacaagcgcaagattagtaacaagaggaaaagcaagttggacatatggaaggtttgaaataagggcaagactaccgagcggaagaggaacatggccagcaatatggatgctaccagatcgacaaacatatggttcagcatattggccagataatggagaaatagatataatggaacatgtaggatttaatccagatgtagtacatggaacagtacacactaaagcatataatcatttattaggaacacaaagaggaggaagcataagagtaccaacagcaagaactgactttcatgtgtatgcaatagaatggacaccagaagaaattagatggtttgtagatgatagtttatattacagatttcccaatgaaagactaacagatccagaagcagactggagacattggccattcgaccaaccatttcatttaataatgaatatcgcagtaggaggagcatggggaggacaacaaggagtagacccagaagcatttccagcacaattagtagtagattatgtaagagtatatagatgggtagaa

SEQ ID NO: 51057 - RNA, 900 nt, synthetic construct
  misc_feature 1..900: note = derived and/or modified sequence opt6 from anti-influenza_Chain
  source 1..900: mol_type = other RNA
aacgtaccagaatggtcatacatagtagaaaaagccaacccagcaaacgacctatgctaccctggaaatttcaatgactacgaagaactaaaacacttattatcacgaataaaccactttgaaaaaatacaaggatacatcccagaagcaccacgagacggacaagcatacgtaagaaaagacggagaatgggtattattatctacattcctaagatcagacaaaacacatacatgcccaccatgcccagcacccgaactactaggaggaccatcagtattcttattcccaccaaaaccaaaagacaccctaatgatctcaagaacaccagaagtaacctgcgtagtagtagatgtatcacatgaagaccccgaagtaaaattcaactggtacgtagacggagtagaagtacacaacgccaaaaccaaacccagagaagaacaatacaactcaacatacagagttgtatcagtattaacagtattacaccaagactggctaaacggaaaagaatacaaatgcaaagtatcaaacaaagcattaccagcaccaatagaaaaaacaatatcaaaagcaaaaggacaacccagagaaccacaagtatataccctacccccatcacgtgaagaaatgacaaaaaaccaagtaagcctaacatgcctcgtaaaaggattctacccatccgacatagcagtagaatgggaatcaaacggacaaccagaaaacaactacaaaacaaccccaccagtactagactccgacggctccttctttttatactcaaaattaacagtagacaaatccagatggcaacaaggaaacgtattctcatgctcagtaatgcacgaagctctacacaaccactacacacaaaaaagcctatcactatcaccaggaaaa

SEQ ID NO: 51058 - RNA, 900 nt, synthetic construct
  misc_feature 1..900: note = derived and/or modified sequence opt6 from anti-influenza_Chain
  source 1..900: mol_type = other RNA
aacgtaccagaatggtcatacatcgtagaaaaagcaaacccagcaaatgacctatgctacccaggcaacttcaacgactacgaagaactcaaacacttactatcaagaataaaccacttcgaaaaaatacaaggatacataccagaagcaccaagagacggacaagcatacgtaagaaaagacggagaatgggtactactaagcacattcttacgatctgataaaacacacacatgtccaccatgcccagccccagaactactaggaggaccaagtgtattcctatttccaccaaaacctaaagacacactaatgatatcacgaacaccagaagtaacctgcgtagtagtagatgtatctcacgaagatccagaagtaaaattcaactggtacgtagacggcgtagaagtacacaacgccaaaacaaaaccaagagaagaacaatataattcaacatatagagtagtatcggtacttacagttctacatcaagactggttaaatggaaaagaatacaaatgcaaagtatcaaacaaagcacttccagcaccaattgaaaaaacaataagcaaagctaaaggacaaccaagagaaccacaagtatacacattaccaccatcacgagaagaaatgactaaaaaccaagtatcattaacatgcctcgtaaaaggattctacccatccgatatagccgtagaatgggaaagcaatggacaaccagaaaacaactataaaacaacaccaccagtactagattcagatggctcattcttcctatactcaaaattaactgtagacaaatcaagatggcaacaaggaaacgtattctcatgctcagtaatgcacgaagcattacataatcactacacacaaaaatcattatctctatcaccaggaaaa

SEQ ID NO: 51059 - RNA, 927 nt, synthetic construct
  misc_feature 1..927: note = derived and/or modified sequence opt6 from anti-influenza_Chain
  source 1..927: mol_type = other RNA
atggtaaataggagagatttaataaaatggagtgcagtagcattaggggctggggctggattagcagggccagcaccagcagcacatgcagctgatttagaatgggaacaatatccagtaccagcagcccccggaggaaataggagttggcaattattaccatcacattcagatgatttcaattatacaggaaaaccacaaacatttagaggaagatggttagatcaacataaagatggatggtcaggaccagcaaactcactatactcagcaagacatagttgggtagcagatggaaatttaatagtagaaggaagacgagctccagatggaagagtatattgtggatatgtaacaagcagaacaccagtagaatatccattatatacagaagtattaatgagagtaagcggattaaaactaagtagtaatttttggttactaagcagagatgatgttaatgaaatagatgtaatagaatgttatggaaatgaatcattacatggaaaacatatgaacacagcatatcatatatttcagagaaatcctttcacagaattagcaagatcacaaaaaggatactttgcagatggaagttatggttataatggagaaacaggtcaagtatttggagatggagcaggacaaccattactaagaaatggattccatagatatggtgtacactggataagtgcaacagaatttgatttttattttaatggaagattagttagaagattaaatagaagtaatgatctaagagatccaagaagtagattctttgatcaaccaatgcatttaatattaaatacagaatcacatcaatggagggtagatagaggaatagaaccaacagatgcagaattagctgatccaagtataaataatatatattatcgatgggtaagaacatatcaagctgta

SEQ ID NO: 51060 - RNA, 927 nt, synthetic construct
  misc_feature 1..927: note = derived and/or modified sequence opt6 from anti-influenza_Chain
  source 1..927: mol_type = other RNA
atggtaaatagaagagacctaataaaatggagcgcagtagcattaggagcaggggcaggattagcaggaccggcaccagcagcacatgcggcagatttagaatgggaacaatatccagtcccagctgcaccaggtggaaatagaagctggcaattattaccaagccattcagacgattttaactatacaggaaaaccacaaacattcagaggaagatggttagatcaacataaagatggatggtcaggaccagcaaatagcttatattcagcaagacatagttgggtagcagatggaaatctaatagtagaaggaagacgagctccagatggtagagtatattgcggatatgtaacttcaagaacaccagtagaatatcctttatatacagaagttttaatgagagttagcggacttaaattatcaagtaatttctggttattaagtagagatgatgtaaatgaaatagatgtaatagaatgctatggaaatgaatcactacacggaaaacatatgaatacagcatatcatatatttcaaagaaatccatttacagaactagcaagatcacaaaaaggatattttgcagacggatcatatggatataatggggaaacaggacaagtatttggagatggagcgggacaaccactattaagaaatggatttcatagatacggagtacactggatatcagcaacagaatttgatttttattttaatggaagattagttagaagattaaatagaagtaatgatttacgtgaccctagaagtagattctttgatcaaccaatgcatttaattctaaatacagaatcacaccaatggagagttgatagaggaatagaacccacagatgcagaactagctgatccatcaataaataacatatattatcgatgggtaagaacatatcaagcagta

SEQ ID NO: 51061 - RNA, 960 nt, synthetic construct
  misc_feature 1..960: note = derived and/or modified sequence opt6 from anti-influenza_Chain
  source 1..960: mol_type = other RNA
atatgcataggataccacgcaaacaactcaacagaacaagttgacacaataatggaaaaaaatgtaacagtcacacacgcacaagacatactagaaaaaacacacaatggaaaattatgcgacttagatggagtaaaacccctaatactcagagactgctcagtagccggatggctactaggaaacccaatgtgtgacgaattcataaatgtaccagaatggtcatatatcgtagaaaaagcaaacccagccaacgacctatgctacccaggaaacttcaacgattacgaagaactaaaacacttattatcccgaataaaccacttcgaaaaaatccaaataataccaaaaagctcatggtcagaccacgaagcctcatcaggagtctcatccgcatgcccctaccaaggaacaccaagcttcttcaggaacgtagtatggctaataaaaaaaaacaatacatacccaacaatcaaaagatcatacaacaacacaaaccaagaagacctcttaatattatggggaatccaccactcaaatgacgcagcagaacaaacaaaactataccaaaatcccacaacatacatatcagtcggaacaagcacactaaaccaaagattagtacctaaaatagcaacaagatctaaagtcaacggacaaaacggaagaatggacttcttctggacaatactaaaacccaacgacgcaataaacttcgaatcaaacggaaacttcatagcaccagaatacgcatataaaatagtcaaaaaaggagattctgctatagtaaaatcagaagtagaatacggaaactgcaacacaaaatgccaaacccccataggagcaataaactcatcaatgccattccacaacattcacccattaacaataggagaatgcccaaaatacgtcaaatccaacaaactcgtactagcaacaggactaagaaactcaccacta

SEQ ID NO: 51062 - RNA, 960 nt, synthetic construct
  misc_feature 1..960: note = derived and/or modified sequence opt6 from anti-influenza_Chain
  source 1..960: mol_type = other RNA
atatgcataggataccacgcaaataattcaacagaacaagtcgatacaataatggaaaaaaacgtaacagtaacacacgctcaagacatcttagaaaaaacacacaacggaaaattatgcgacctcgacggcgtaaaaccactaatactaagagactgctcagtagcaggatggctactaggaaacccaatgtgcgacgaattcataaacgtaccagaatggtcatacatagtagaaaaagcaaacccagccaatgacctatgttacccaggaaacttcaacgattacgaagaactaaaacatttactatccagaattaatcactttgaaaaaatacaaatcatacccaaatcatcatggtcagaccacgaagcatcatctggagtaagctcagcatgcccatatcaaggaacaccatctttcttcagaaacgtagtatggttaataaaaaaaaacaacacatacccaacaataaaacgatcttacaacaacacaaaccaagaagacctactaatactatggggaatacaccactcaaacgacgcagcagaacaaactaaactataccaaaacccaacaacatacatatccgtaggaacatccacactaaaccaaagactagtaccaaaaatagccacaagatcaaaagtaaacggacaaaacggccgaatggatttcttctggacaatactaaaaccaaacgacgcaataaacttcgaatcaaacggaaacttcatagcaccagaatacgcatacaaaatagtaaaaaaaggcgactcagcaatagtcaaatcagaagtcgaatatggcaactgcaacacaaaatgccaaacacccataggcgcaataaactcctcaatgccctttcacaacatacatccactaacaataggagaatgcccaaaatatgtaaaaagcaacaaactagtactagcaacaggacttcgaaactcaccacta

SEQ ID NO: 51063 - RNA, 960 nt, synthetic construct
  misc_feature 1..960: note = derived and/or modified sequence opt6 from anti-influenza_Chain
  source 1..960: mol_type = other RNA
atatgcataggataccacgcaaacaattcaacagaacaagtagataccattatggaaaaaaacgtaacagtaacacacgcccaagatatactcgaaaaaacacataacggaaaactatgcgatctagacggagtaaaaccattaatattacgagactgctcagttgcaggatggttactaggtaaccccatgtgcgacgaattcataaacgtaccagaatggtcatatatagtagaaaaagcaaatccagcaaacgacctatgctacccaggaaacttcaacgactatgaagaactaaaacacctactatcacgaataaaccacttcgaaaaaatacaaataataccaaaatcatcatggtcagaccacgaagcatcatcaggagtatcatccgcctgcccataccaaggaacaccatcattcttcagaaacgtagtatggctaataaaaaaaaacaacacatacccaacaataaaaagatcatacaataacacaaaccaagaagacctcctaatactatggggaatacatcatagcaacgatgccgcagaacaaactaaactataccaaaacccaacaacatacatatcagtcggcacatcaaccctaaaccaacgactagtaccaaaaatagccacaagatcaaaagtcaatggccaaaacggtagaatggactttttttggacaatactaaaaccaaatgacgcaataaactttgaatcaaacggaaacttcatagcgccagaatacgcatataaaatagtaaaaaaaggagattcagcaatagtaaaatcagaagtagaatacggaaactgcaacacaaaatgccaaacaccaataggcgccatcaattcaagcatgccattccacaacatacacccattaacaatcggcgaatgcccaaaatacgtaaaatccaacaaactagtactagcaactggactccgcaactccccacta

SEQ ID NO: 51064 - RNA, 978 nt, synthetic construct
  misc_feature 1..978: note = derived and/or modified sequence opt6 from anti-influenza_Chain
  source 1..978: mol_type = other RNA
accttatgcataggataccatgcaaacaattcaacagacacagtagacacagtattagaaaaaaacgtaacagtaacacacagtgtaaacctactcgaagataaacacaacggcaaactatgcaaactaagaggagtagccccactacacctaggaaaatgcaacatagcaggatggatactaggaaacccagaatgcgaatcactatccacagcatcaagctggtcttacatcgtagaaacatcatcatcagacaacggtacatgctacccaggagacttcatagactacgaagaactaagagaacaattatcatcagtatcatcctttgaaagatttgaaatattcccaaaaacatcatcatggccaaaccatgactcaaataaaggcgtaacagcagcatgcccacatgcaggagcaaaatcattctacaaaaacctaatatggctagtaaaaaaaggaaactcataccccaaattatcaaaatcatacattaacgacaaaggaaaagaagtactagtactctggggaatacaccacccatcaacatcagcagaccaacaatcactctaccaaaacgccgatgcatatgtatttgtaggaacatctagatactcaaaaaaattcaaaccagaaatagcaatcagacccaaagtacgagaccaagaaggaagaatgaactactattggaccctagtagaaccaggagataaaataacattcgaagcaacaggaaacttagtagtaccacgatacgcattcgcaatggaacgagacgcaggatcaggcataattatttcagacacacccgtacacgattgtaatactacatgccaaacaccaaaaggcgcaataaacacaagcttaccatttcaaaatatacacccaataacaataggaaaatgcccaaaatacgtaaaatcaacaaagttaagactagcaacaggactaagaaatgtaccaagcatacagagtaga

SEQ ID NO: 51065 - RNA, 978 nt, synthetic construct
  misc_feature 1..978: note = derived and/or modified sequence opt6 from anti-influenza_Chain
  source 1..978: mol_type = other RNA
acactatgcataggataccacgcaaataactcaacagacaccgtagacacagtattagaaaaaaatgtcacagtaacccacagcgtaaacttactagaagacaaacacaatggcaaattatgtaaattaagaggagtcgcaccactacatttaggtaaatgcaatatcgcaggatggatattaggcaacccagaatgcgaatcactatcaacagcatcatcatggtcatatatagtagaaacatcctcatccgataacggaacatgctaccccggagacttcatagactatgaagaattaagagaacaattatcatcagtatcatcattcgaaagatttgaaatattcccaaaaacatcaagctggccaaaccacgactcaaacaaaggagtaacagcagcatgtccccatgcaggagcaaaatcattctataaaaacctaatttggttagtaaaaaaaggaaactcatacccaaaactatcaaaatcatacataaacgacaaaggaaaagaagtattagtattatggggaatacaccacccatcaacatccgcagatcaacaatcactataccaaaacgctgacgcatacgtattcgtaggaacaagcagatattcaaaaaaattcaaaccagaaatagcaataagaccaaaagtccgagaccaagaaggaagaatgaactactactggacattagtagaacctggtgacaaaataacattcgaagcaacaggaaacttagtagtaccaagatacgcattcgctatggaaagagacgccggatcaggaataataatatccgacacacccgtacatgactgcaacacaacatgccaaacaccaaaaggagcaataaacacatccttaccattccaaaacatacatccaataacaataggaaaatgcccaaaatacgtaaaatcaacaaaactaagactagcaaccggattacgaaacgtcccatcaatccaaagccgt

SEQ ID NO: 51066 - RNA, 960 nt, synthetic construct
  misc_feature 1..960: note = derived and/or modified sequence opt6 from anti-influenza_Chain
  source 1..960: mol_type = other RNA
atatgcataggctaccacgcaaacaactcaacagaacaagtagacactataatggaaaaaaatgtcacagtcacacacgcacaagacatactagaaaaaacacacaacggaaaattatgcgacctagacggagtaaaaccactaatcctacgagactgctcagtagcaggatggctactcggcaacccaatgtgtgacgaattcataaacgttccagaatggtcatacatcgtagaaaaagcaaacccagcaaacgatctatgctacccaggaaacttcaacgattacgaagaattaaaacacttattatccagaataaatcacttcgaaaaaatacaaataataccaaaatcatcatggtctgaccacgaagcctcatcaggagtatccagcgcatgcccataccaaggaacaccttcattcttcagaaacgtagtatggctaataaaaaaaaacaacacttacccaacaataaaaagatcatacaacaacacaaaccaagaagacttactcatactatggggcatacaccattcaaatgacgcagccgaacaaacaaaactctaccaaaacccaacaacatatatctcagtaggaacatcaacactaaaccaacgactagtaccaaaaatagcaaccagatcaaaagtaaacggacaaaacggaagaatggatttcttctggacaatactaaaaccaaacgacgcaataaacttcgaatcaaacggaaactttatagcaccagaatatgcatacaaaatagtcaaaaaaggagactcagcaatagtaaaatctgaagtagaatacggaaattgcaacacaaaatgtcaaacaccaataggagcaataaactcctcaatgccattccacaacatacacccactaacaataggagaatgcccaaaatacgtaaaatcaaacaaactagtcctagcaacaggactaagaaactcaccatta

SEQ ID NO: 51067 - RNA, 990 nt, synthetic construct
  misc_feature 1..990: note = derived and/or modified sequence opt6 from anti-influenza_Chain
  source 1..990: mol_type = other RNA
atgtgctcaagcataccatcattaagagaagtattcgcaaacgacttcagaataggagcagcagtaaatccagtaacactagaagcacaacaatcattactaatacgacacgtaaactccctcacagcagaaaaccacatgaaattcgaacacctccaaccagaagaaggaagattcacatttgacatagcaataaaatcatcaacaagcccattttcatcacacggagtgagaggacacacactagtctggcataaccaaacaccaagctgggtattccaagactcacaaggacactttgtaggcagagacgtcctactagaaagaatgaaatcccacatatcaacagtcgtacaacgatacaaaggaaaagtatactgctgggatgtaataaacgaagcagtagcagatgaaggatcagaatggctacgatcatcaacatggcgtcaaattataggagacgacttcatacaacaagcatttttatacgcacacgaagcagacccagaagctcttctattctacaacgactacaatgaatgcttcccagaaaaaagagaaaaaatatacacattagtaaaatcattaagagacaaaggaataccaatacacggaataggaatgcaagcacactggtcattaaaccgaccaacactagacgaaatcagagcagcaatagaaagatatgcatcattaggagtaatattacacataaccgaattagacatatcaatgtttgaattcgacgaccatagaaaagacttagcagcaccaacaaacgaaatggtagaaagacaagcagaaagatatgaacaaatattcagccttttcaaagaataccgagacgtcatacaaaatgtaacattctggggtattgcagatgaccacacatggttagaccacttcccagtacaaggacgaaaaaactggccactactattcgatgaacaacacaatccaaaaccagcattctggcgagtagtaaacata

SEQ ID NO: 51068 - RNA, 990 nt, synthetic construct
  misc_feature 1..990: note = derived and/or modified sequence opt6 from anti-influenza_Chain
  source 1..990: mol_type = other RNA
atgtgcagctccataccatcacttagagaagtattcgccaatgatttcagaataggcgcagcagtaaatccagtaacactagaagcacaacaatcattactaataagacatgtaaactcactaacagcagaaaaccatatgaaattcgaacacctacaaccagaagaaggaagattcactttcgacatagcaataaaatcatcaacatccccattctcatcacacggcgtaagaggacatacattagtatggcacaaccaaacaccatcctgggttttccaagactcacaaggacacttcgtaggaagagatgtattactagaaagaatgaaatcacacatatcaaccgtagtacaaagatataaaggcaaagtatattgttgggatgtaataaatgaagcagtagcagacgaaggatccgaatggctaagatcaagcacatggcgacaaataataggagacgacttcatacaacaagcatttttatacgctcacgaagcagatcccgaagcattactattctacaatgactataacgaatgcttcccagaaaaaagagaaaaaatatatacactagtaaaatccctaagagacaaaggaataccaatacacggaataggaatgcaagcacactggtcactaaacagaccaacactagacgaaataagagctgccatagaaagatacgcctcattaggagtaatattacacatcacagaactagacatatctatgttcgaattcgacgaccatagaaaagacttagcagcacctacaaacgaaatggtagaacgccaagcagaaagatacgaacaaatattctcactcttcaaagaatacagagatgtaatacaaaatgtaacattctggggaatagcagacgaccacacatggttagaccatttccccgtacaaggaagaaaaaactggccactattattcgacgaacaacacaacccaaaaccagcattctggagagtagtaaacata

SEQ ID NO: 51069 - RNA, 1002 nt, synthetic construct
  misc_feature 1..1002: note = derived and/or modified sequence opt6 from anti-influenza_Chain
  source 1..1002: mol_type = other RNA
atgaaaaatagagtaatatctttattaatggcaagtcttttattagtactaagtgtaatagtagcaccattctacaaagcagaagcagcaactgtagtaaacacaccatttgtcgcagtattctccaacttcgatagttcacaatgggaaaaagcagattgggcaaacggaagtgtattcaattgcgtatggaaaccaagccaagtaacattttcaaacggaaaaatgatattaacactagatagagaatacggaggatcatacccatacaaatcaggagaatatcgaacaaaatcattctttggatatggatattacgaagttagaatgaaagccgctaaaaatgtaggaatagtaagttcattcttcacatataccggaccatcagacaataatccatgggatgaaatagacatagaatttctaggaaaagatacaacaaaagtacaatttaactggtataaaaacggtgtaggaggaaatgaatacctacataacctaggattcgatgcaagccaagacttccacacatatggattcgaatggagacctgattacatagatttttacgtagacggtaaaaaggtttacagaggaacgagaaacattccagtaaccccaggaaaaataatgatgaatctatggccaggaataggagtagatgaatggctaggacgatatgacggaagaacaccattacaagcagaatatgaatatgtaaaatactatccaaacggagtacctcaagacaatccaacaccaacaccaaccatagcaccatcaacaccaacaaatccaaatttaccattaaaaggagacgtaaatggagatggacatgtcaattcatcagactatagtttatttaaaagatacctactaagagtaatagatagatttccagtaggagaccaatcggtagcagacgtaaaccgagacggtagaatagactcaacagacttaacaatgctaaaaagatacttgatacgagcaataccatcatta

SEQ ID NO: 51070 - RNA, 1002 nt, synthetic construct
  misc_feature 1..1002: note = derived and/or modified sequence opt6 from anti-influenza_Chain
  source 1..1002: mol_type = other RNA
atgaaaaacagagtaatatcattattaatggcaagcctattactagtattatcagtaatagttgcaccattctataaagcagaagcagcgacagtagtaaatacaccatttgtagcagtattctcaaatttcgatagcagtcaatgggaaaaagcagactgggcaaacggtagcgtattcaattgcgtatggaaaccatcacaagtaacattttcaaacggaaaaatgatattaacactagacagagaatatggaggatcatacccttataaatcaggagaatatagaacaaaaagtttcttcggatacggatattacgaagtaagaatgaaagcagcaaaaaatgtaggtatagtaagcagcttttttacatatacaggaccttctgacaacaacccatgggatgaaatcgacatagaatttctcggaaaagatacaacaaaagtacaattcaactggtacaaaaacggcgtaggaggaaatgaatatctacataatcttggatttgacgctagtcaagacttccacacatacggattcgaatggagaccagactacatagacttctacgtcgacggaaaaaaagtatacagaggaacacggaatataccagtaacaccaggaaaaatcatgatgaatctatggccaggaataggagtagatgaatggctaggaagatatgacggaagaacaccactacaagcagaatacgaatacgtcaaatactatccaaatggagtaccccaagacaatccaacaccaacaccaacaatagcaccatcaacaccaacaaatccaaatttacctctaaaaggagatgtaaacggagacggacatgtaaattcatcagactactcattattcaaaagatatctacttagagtaatagatagatttccagtaggagatcaatcagtagcagacgtaaacagagacggaagaatagactcaacagatctaacaatgttaaaaagatacttaataagagcaataccatcatta

SEQ ID NO: 51071 - RNA, 1041 nt, synthetic construct
  misc_feature 1..1041: note = derived and/or modified sequence opt6 from anti-influenza_Chain
  source 1..1041: mol_type = other RNA
atatgcataggataccacgcaaacaactcaaccgaacaagtagacacaataatggaaaaaaacgtaacagtaacccacgcacaagatattctagaaaaaacccacaacggaaaactatgtgacctagacggcgtaaaaccactaatattacgtgattgctcagtagccggatggctattaggaaacccaatgtgcgacgaattcataaacgtacccgaatggagttacatagtagaaaaagcaaacccagcaaacgacctatgctacccaggaaacttcaatgactacgaagaactaaaacatctactatcaagaataaaccacttcgaaaaaatccaaataataccaaaatcatcatggtcagaccacgaagcatcatcaggagtatcatcagcatgtccctaccaaggcaccccatcattcttccgaaacgtcgtatggttaataaaaaaaaacaacacatacccaacaataaaaagatcctacaataatacaaaccaagaagacctactaatattatggggaatacaccacagcaacgatgcagcagaacaaacaaaactataccaaaacccaacaacatacatatcagtaggtacatccacactaaaccaaagattagtaccaaaaatagcaacacgatctaaagtaaacggacaaaacggcagaatggactttttctggactattctaaaaccaaacgacgcaataaacttcgaatcaaatggaaacttcatagcaccagaatacgcctacaaaatagtaaaaaaaggagattcagcaatagttaaatcagaagtagaatacggaaactgcaatacaaaatgccaaacacccataggagccataaactcctcaatgccctttcacaacatacaccctctaacaataggagaatgtccaaaatacgttaaatcaaacaaactagtactagcaacaggattacgaaattccccattaggttacataccagaagcaccaagagacggacaagcatacgttcgaaaagatggagaatgggtactactatccacattctta

SEQ ID NO: 51072 - RNA, 1041 nt, synthetic construct
  misc_feature 1..1041: note = derived and/or modified sequence opt6 from anti-influenza_Chain
  source 1..1041: mol_type = other RNA
atatgtataggataccacgcaaacaacagcacagaacaagtcgacactataatggaaaaaaacgtcacagtaacacacgcacaagacatcctagaaaaaacccacaatggaaaattatgcgacctagacggagtaaaaccactcatattaagagactgctcagtagcaggatggctattaggaaacccaatgtgcgatgaattcataaacgtacccgaatggtcatacatagtagaaaaagcaaacccagccaacgacctatgctatccaggaaatttcaacgactacgaagaactaaaacacctactctccagaataaaccatttcgaaaaaatacaaataataccaaaatcatcatggtcagatcatgaagcatcatccggagtatcatcagcatgcccataccaaggaacaccatcattcttcagaaacgtagtatggttaataaaaaaaaataacacatacccaacaatcaaaagatcatacaacaacacaaaccaagaagacctactaatactatggggaatccaccactccaacgacgcagcagaacaaacaaaactctaccaaaacccaacaacatacatatcagtaggaacatcaacactcaaccaaagattagtaccaaaaatagcaacaagatcaaaagtaaacggacaaaatggaagaatggatttcttctggacaatacttaaaccaaacgatgcaataaacttcgaatctaacggaaacttcatcgcaccagaatacgcctacaaaatagtaaaaaaaggagactcagcaatagtaaaatccgaagtagaatacggaaactgcaatacaaaatgccaaacaccaataggagcaataaactcatcaatgccattccacaacatacaccccctaaccatcggcgaatgcccaaaatatgtaaaatccaacaaattagtactagcaacaggactaagaaattcaccattaggatacatacccgaagcaccaagagatggacaagcctacgtaagaaaagacggagaatgggtattactatcaaccttttta

SEQ ID NO: 51073 - RNA, 1047 nt, synthetic construct
  misc_feature 1..1047: note = derived and/or modified sequence opt6 from anti-influenza_Chain
  source 1..1047: mol_type = other RNA
atgaatattaaaaaaacagcagtaaaatcagcattagcagtagctgcagcagctgcagctttaactacaaatgtaagtgcaaaagattttagcggagcagaattatatacacttgaagaagtacaatatggtaaattcgaagcaagaatgaaaatggcagcagcatcaggaacagtatcatccatgtttctataccaaaatggtagtgaaattgcagacggaagaccatgggtagaagtcgacatagaagtattaggaaaaaatccaggttcatttcaaagcaatataataacaggaaaagcaggagcacagaaaacaagcgaaaaacaccacgctgtaagtccagcagcagatcaagcatttcatacttatggattagaatggacaccaaattatgtaagatggacagtagatggacaagaagtaagaaaaacagaaggaggacaagtatcaaatttaacaggaacacaagggttaagattcaacttatggagtagcgaaagtgcagcttgggtaggacaatttgatgaatcaaaattacctctatttcaattcataaattgggtaaaagtttataaatatactccaggacaaggagaaggaggatcagactttacattagattggacagataattttgacacttttgacggaagtagatggggaaaaggtgattggactttcgatggaaatagagtagatttaacagataaaaatatatactcaagagatggtatgttaatattagcattaacaagaaaaggacaagaaagcttcaacggacaagtacctagagatgatgaaccagcaccacaatcatcatcatcagcaccagcaagttcaagtagcgtaccagcaagttcaagttcagtaccagcaagtagctcctccgcatttgtaccaccaagcagttcatcagcaacaaatgcaatacatggtatgagaaccaccccagcagttgcaaaagaacatagaaatcttgtaaatgcaaaaggagcaaaagtaaatccaaatggacataaaagatacagagtaaattttgaacac

SEQ ID NO: 51074 - RNA, 1047 nt, synthetic construct
  misc_feature 1..1047: note = derived and/or modified sequence opt6 from anti-influenza_Chain
  source 1..1047: mol_type = other RNA
gaagtacaacttgtagaatcaggcggaggagttgtacaacctggaagatcactaagattatcttgtgctgcttccggatttgctttccataacagagcaatgcactgggtacgacaagcaccaggaaaaggactagaatgggtagcactaatatatttcgatggatcaaaacaatactatgcagattcagtaaaaggaagatttacaatttcaagagacaattcaaaaaacacagtatttctacaaatgaattcattaagaccagaagacacagcagtatattattgtgcagtccccggaccaatattcggaatatttccaccttggtcatactttgatcattggggacaaggaatcctagtcacagtatcatcagcctcaacaaaaggaccttcagtatttccactcgccccatcatcaaaatcaacatccggaggtacagcagcactaggttgtctagtaaaagattactttcccgaaccagtcacagtctcatggaattcaggagcactaacttcaggagtacacacatttccagcagtattacaatcttccggcctatactctttatcatcagtagtaacagtaccatcatcttccctaggaacacaaacatatatatgtaacgtaaaccataaaccatcaaacacaaaagtcgataaaaaagtagaaccaaaatcatgtgacaaaacccatacatgtccaccatgtccagcacccgaattactaggaggaccaagcgtattcttattcccaccaaaaccaaaagatacattaatgatatcacgaacaccagaagtaacatgtgtcgtagtcgatgtttcacatgaagatccagaagtaaaattcaattggtatgtagacggagtagaagttcacaatgcaaaaacaaaaccacgtgaagaacaatataactcaacatacagagtagtatcagtactaacagttttacaccaagattggcttaatggaaaagaatacaaatgcaaagtatctaacaaagccttaccagcaccaatagaaaaaaccatatcaaaagcaaaagga

SEQ ID NO: 51075 - RNA, 1047 nt, synthetic construct
  misc_feature 1..1047: note = derived and/or modified sequence opt6 from anti-influenza_Chain
  source 1..1047: mol_type = other RNA
gaagtacaactagtagaatcaggaggaggagtagttcagccaggacgatcattaagactctcatgtgcagcatcaggtttcgcattccacaatagagcaatgcattgggtacgacaagctccaggtaaaggactagaatgggtagcattaatatatttcgatggctcaaaacaatattatgcagattcagtaaaaggacgatttacaatatcaagagacaattccaaaaacacagtatttctacaaatgaattccctaagaccagaagacacagctgtatattattgcgcagtaccaggtccaatattcggaatatttccaccctggtcatacttcgaccattggggacaaggaatattagtaactgtctcatcagcatcaactaaaggaccttcagtatttccacttgccccatcctctaaatcaacatcaggaggaacagcagcactaggatgcctagttaaagactactttccagaaccagtaacagtatcatggaatagtggagcactaacatcaggagtacatacatttcctgctgtattacaatcatcaggattatattccttatcaagtgtagtaacagtcccatcttcatcactaggaacacaaacatatatatgtaacgttaaccataaaccctcaaatactaaagtcgacaaaaaagttgaacctaaatcatgcgataaaacacacacctgtccaccatgcccagctccagaattactaggaggaccatccgtattcttatttccaccaaaaccaaaagacacattaatgataagtagaacaccagaagtaacatgcgtcgtagtagacgtctcacatgaagatccagaagtaaaattcaactggtatgtcgatggagtcgaagtacacaatgcaaaaaccaaaccaagagaagaacaatataactcaacatacagagtagtatctgtacttacagtattacatcaagattggcttaatggaaaagaatataaatgcaaagtatcaaataaagcactcccagcaccaatcgaaaaaactatatccaaagcaaaagga

SEQ ID NO: 51076 - RNA, 1047 nt, synthetic construct
  misc_feature 1..1047: note = derived and/or modified sequence opt6 from anti-influenza_Chain
  source 1..1047: mol_type = other RNA
atgaatataaaaaaaactgcagtaaaatcagcattagcagtagcagcagcagcagcagcattaacaacaaatgtatcagcaaaagatttttcaggagcagaattatatacattagaagaagttcaatacgggaaatttgaagcaagaatgaaaatggccgcagcatcaggaacagtatcatcaatgtttctatatcagaacggatcagaaatagcagatggaagaccatgggtcgaagtagatatagaagtattaggaaaaaatccaggaagctttcaatccaatataattacaggaaaagcaggagcacaaaaaacatcagaaaaacatcacgctgtaagtccagcagcagatcaagcatttcatacatatggactagaatggaccccaaattatgtaagatggacagtagatggacaagaagtcagaaaaacagaaggaggtcaagtatcaaatctaacaggaacacaaggattacgatttaacttgtggtcatcagaaagtgcagcctgggtaggacaatttgatgaatcaaaacttccactatttcaattcataaattgggtaaaagtatataaatatactcctggacaaggagaaggaggctcagactttacattagattggacagacaattttgatacattcgacggatcaagatggggaaaaggagactggacttttgatggaaatcgagtagatttaacagataaaaacatatactcaagagatggaatgttaatactagcactaacaagaaaaggacaagaaagctttaatggacaagtacctagagatgatgaaccagcaccacaatcatcaagtagcgcaccagcaagcagtagctcagtcccagcatcatcatcatcagtcccagcttcaagctcatcagcatttgttccaccttcatcatcatctgcaacaaacgcaatacatggaatgagaaccacaccagcagtagcaaaagaacatagaaatctagtcaacgcaaaaggagcaaaagtaaacccaaatggacataaaaggtatagagtcaattttgaacac

SEQ ID NO: 51077 - RNA, 1161 nt, synthetic construct
  misc_feature 1..1161: note = derived and/or modified sequence opt6 from anti-influenza_Chain
  source 1..1161: mol_type = other RNA
atgaataaattcttaaacaaaaaatggtcactaatactaacaatgggaggcatctttttaatggccacactatcattaatatttgcaacaggaaaaaaagccttcaacgaccaaacaagcgccgaggatataccaagtctagcagaagcatttagagattatttcccaatcggagctgcaatcgaaccaggatatacaacaggacaaatagcagaactatacaaaaaacacgtaaatatgctagtagccgaaaacgccatgaaaccagcatcactacaacctacagaaggaaacttccaatgggcagatgcagacagaatagtacaattcgcaaaagaaaatggaatggaattaagattccatacattagtatggcacaaccaaacaccaacaggctttagtctagacaaagaaggtaaaccaatggtggaagaaacagatccacaaaaaagagaagaaaacagaaaattattactacaaagattagaaaactacataagagcagttgtcttacgatataaagatgacataaaatcatgggatgtagtaaacgaagtaatagaacctaacgacccaggaggtatgagaaattcaccatggtatcaaatcacaggaacagaatacatagaagtagcattcagagcaacaagagaagcaggaggctcagatattaaactatacatcaatgactacaacacagacgacccagtaaaacgagacatactatatgaattagtcaaaaacctactagaaaaaggagtaccaatagacggagttggacatcaaacacacatcgacatatacaatccacctgtcgaaagaataatagaatccataaaaaaattcgcaggattaggattagacaatatcataacagaactagacatgtcaatatattcatggaacgatagatcagactatggagattcaatcccagactacatactaacactacaagcaaaaagatatcaagaactatttgacgctctaaaagaaaataaagacatagtttcagcagtcgttttctggggaataagtgataaatattcttggctaaatggcttcccagtaaaaagaacgaatgcaccactactattcgacagaaacttcatgccaaaacccgcattctgggcaatagtcgatccatcaagactacgagaa

SEQ ID NO: 51078 - RNA, 1161 nt, synthetic construct
  misc_feature 1..1161: note = derived and/or modified sequence opt6 from anti-influenza_Chain
  source 1..1161: mol_type = other RNA
atgaacaaattcttaaataaaaaatggagcttaatcttaaccatgggaggtatcttcctaatggcaacactatcattaatatttgcgacaggtaaaaaagcattcaatgaccaaacatcagcagaagacatcccttcactagcagaagcattcagagattatttcccaataggagcagcaatagaaccaggatacacaacaggacaaatagcggaattatataaaaaacacgtaaatatgcttgtagcagaaaacgcaatgaaaccagcatcactccaaccaacagaaggaaatttccaatgggcagacgcagacagaatagtacaatttgcaaaagaaaacggaatggaacttagatttcatacactagtatggcacaatcaaacaccaacaggatttagcttagacaaagaaggaaaaccaatggtagaagaaacagatccacaaaaaagagaagaaaacagaaaattactattacaaagactagaaaactatataagagcagtagtattaagatataaagatgacataaaaagctgggacgtagtaaacgaagtaatagaaccaaacgatccaggaggaatgcgaaatagtccatggtaccaaattacaggaacagaatatatagaagtagcattcagagcaacaagagaagcaggaggatcagacataaaattgtacataaatgactacaacacagacgacccagtaaaaagggacatactatacgaactagtgaaaaacctattagaaaaaggcgttccaatagacggagtaggccatcaaacacacatagatatttacaacccacctgttgaacgcattatagaatcaataaaaaaattcgcaggactaggattagacaatatcataacagaactagacatgtcaatatactcatggaacgatagatcagactatggagactcaataccagattacatactcacactacaagcaaaaagataccaagaattattcgacgcattaaaagaaaataaagacatagtcagcgctgtagtattctggggcataagcgataaatacagttggctaaatggatttccagtaaaaagaacaaacgcaccactattattcgacagaaacttcatgccaaaaccagcattctgggcaatagtagacccatcaagattaagagaa

SEQ ID NO: 51079 - RNA, 1221 nt, synthetic construct
  misc_feature 1..1221: note = derived and/or modified sequence opt6 from anti-influenza_Chain
  source 1..1221: mol_type = other RNA
atgagaaacgtagtacgaaaaccactgacaataggactagcactaaccttattactaccaatgggcatgaccgcaacctcagcaaaaaacgcagatagctacgcaaaaaaaccacacatatcagcactaaacgcaccacaactagaccaaagatacaaaaacgaattcacaataggagcagcagtagaaccataccaattacaaaacgaaaaagatgtacaaatgctaaaaagacatttcaacagcatagttgctgaaaacgtaatgaaaccaatcagtattcaaccagaagaaggaaaatttaactttgaacaagcagacaggatagtcaaatttgcaaaagcaaacggaatggatataagattccatacactcgtatggcactcacaagtaccacaatggttctttctagataaagaaggaaaaccaatggtaaatgaaacagacccagtaaaaagagaacaaaacaaacaactattactaaaaagactagaaacacacataaaaacaatagtagaacgatataaagacgacataaaatactgggacgtagtaaacgaagtcgtaggcgacgacggcaaactacgaaactcaccatggtatcaaatagcaggaatagattacataaaagtagcatttcaagcagccagaaaatacggaggtgacaatataaaactatatatgaatgactataacacagaagtagaaccgaaaaggacagcactatacaacttagtaaaacaattaaaagaagagggagtaccaatagacggaataggacaccaatcacatatccaaataggatggccatcagaagcagaaattgaaaaaaccataaacatgttcgcagcattaggattagacaaccaaataacagaactagacgtatcaatgtacggatggccaccaagagcatacccaacctacgatgcaataccaaaacaaaaatttttagatcaagcagcacgatacgacagactattcaaactatatgaaaaattatcagacaaaataagcaatgtaacattctggggaatagcagacaaccacacatggttagactcgcgagcagacgtctactacgatgcaaacggaaacgttgtagtagacccaaatgcaccctacgcaaaagtcgaaaaaggaaaaggaaaagatgccccattcgtattcggaccagactacaaagtaaaaccagcatactgggcaataatagaccacaaa

SEQ ID NO: 51080 - RNA, 1221 nt, synthetic construct
  misc_feature 1..1221: note = derived and/or modified sequence opt6 from anti-influenza_Chain
  source 1..1221: mol_type = other RNA
atgagaaacgtagtcagaaaaccattaaccataggattagcattaacactcctactaccaatgggaatgacagcaacaagcgcaaaaaacgccgacagctacgcaaaaaaaccacacatatcagccctaaacgcaccacaattagaccaaagatataaaaacgaatttacaataggcgcagcagtagaaccataccaactacaaaacgaaaaagatgtacaaatgttaaaaagacatttcaactcaatagtagctgaaaacgtaatgaaacccataagcatacaaccagaagaaggaaaattcaactttgaacaagccgacagaattgtaaaatttgcaaaagcaaacggaatggacataagattccatacattagtatggcactcacaagttccacaatggttctttctagacaaagaaggaaaaccaatggtcaacgaaacagacccagtaaaaagagaacaaaataaacaactactattaaaaagacttgaaacacacataaaaaccatagtagaaagatacaaagacgacataaaatactgggatgtagtaaacgaagtcgtaggagatgatggcaaattaagaaacagtccatggtatcaaatagcagggatcgactatataaaagtagcatttcaagcagcaagaaaatatggaggagataatataaaactctatatgaacgactataacacagaagtcgaaccaaaacgaacagccctatacaacctagtaaaacaactaaaagaagaaggagtcccaatagacggaataggacaccaaagtcacatacaaataggatggccaagcgaagccgaaatagaaaaaacaataaacatgttcgccgcactaggattagacaaccaaattacagaactagatgtctcgatgtatggatggcccccacgagcatatccaacatatgacgcaatacccaaacaaaaatttctagaccaagcagcaagatacgaccgattattcaaattatacgaaaaactatcagacaaaataagtaatgtaacattctggggaattgcagacaaccacacatggctagatagcagagcagatgtatattatgacgcaaacggtaacgtagtagtggaccccaacgccccatacgcaaaagtagaaaaaggtaaaggaaaagatgcaccattcgtattcggaccagattacaaagtaaaaccagcttattgggccataatagaccataaa

SEQ ID NO: 51081 - RNA, 1233 nt, synthetic construct
  misc_feature 1..1233: note = derived and/or modified sequence opt6 from anti-influenza_Chain
  source 1..1233: mol_type = other RNA
ctctcaagaataaaccactttgaaaaaatccaaataataccaaaatcatcatggagcgaccacgaagcatcatcaggcgtaagctcagcctgtccataccaaggaacaccatccttcttccgaaacgtagtatggttaataaaaaaaaataatacatacccaacaatcaaaagatcatataacaacaccaaccaagaagatttacttatactatggggaatacaccattcaaatgacgccgcagaacaaacaaaactctatcaaaacccaacaacatatatatcagtaggaacaagcaccttaaaccaacgattagtaccaaaaattgcaacaagatccaaagtaaatggacaaaacggacgaatggactttttctggaccatacttaaacctaacgacgccataaacttcgaatccaacggaaattttatagccccagaatacgcatacaaaatagtcaaaaaaggctacataccagaagcaccaagagacggacaagcatacgtaagaaaagacggagaatgggtactattatcaacatttctcagatcagacaaaacccacacatgtccaccatgcccagcaccagaattattaggaggaccttctgtattcttattccccccaaaacccaaagacacattaatgatatcaagaactcccgaagtaacatgcgtagtagtagacgtatcccacgaagaccccgaagtaaaatttaactggtatgtagacggagtagaagtacataacgcaaaaacaaaacccagagaagaacaatacaactcaacatatcgagtcgtatcagtactaacagtattacaccaagactggctaaacggaaaagaatacaaatgcaaagtttcaaacaaagctctaccagcaccaatagaaaaaacaatatccaaagcaaaaggccaacctagagaaccacaagtatacacactaccaccatcaagagaagaaatgacaaaaaaccaagtttcattaacatgcctagtaaaaggattctacccatccgacatagccgtagaatgggaatcaaacggtcaacccgaaaacaactataaaacaacaccaccagtattagactcagacggatccttcttcctatactccaaactaactgtcgataaatctagatggcaacaaggaaacgtattctcatgctccgtaatgcacgaagcattacacaaccattacacacaaaaatctctatcactctcaccaggaaaa

SEQ ID NO: 51082 - RNA, 1233 nt, synthetic construct
  misc_feature 1..1233: note = derived and/or modified sequence opt6 from anti-influenza_Chain
  source 1..1233: mol_type = other RNA
ctcagccgtataaaccactttgaaaaaatacaaataatacccaaatcatcatggtcagaccacgaagcaagttcaggagtatcatccgcatgtccataccaaggaacaccatctttcttccgaaacgttgtatggttaataaaaaaaaacaacacgtacccaaccataaaaagatcatataacaacacaaaccaagaagacttactgatactatggggaatacaccactccaacgacgcagcagaacaaacaaaactataccaaaatcccaccacatacatatcagtaggaacatcaaccctaaatcaaagactagttccaaaaatagccacacgaagcaaagttaatggacaaaacggcagaatggatttcttctggacaatattaaaaccaaacgacgcaatcaactttgaatcaaatggaaatttcatcgcaccagaatacgcatacaaaatagtaaaaaaaggttacatacccgaagctccacgcgacggacaggcatacgtaagaaaagacggagaatgggtactactaagcactttcttaagatcagacaaaacacacacatgtccaccatgtccagccccagaactcttaggaggcccatctgtttttctctttccaccaaaaccaaaagacacattaatgatatcaagaacaccagaagtcacatgtgtagtcgtagacgtttcacacgaagatccagaagtaaaattcaactggtatgtagatggagtagaagtacataacgcaaaaactaagccaagagaagaacaatacaattcaacatacagagtagtttccgtactaacagtactacaccaagattggttaaacggaaaagaatacaaatgcaaagtatcaaacaaagcattaccagcaccaatagaaaaaacaatatccaaagcaaaaggacaaccccgagaaccacaagtttacacattaccaccatccagagaagaaatgacaaaaaaccaagtatcattaacatgcctagtaaaaggcttttacccctctgacatagcagtagaatgggaatctaacggacaacctgaaaacaactataaaacaactcccccagtactagactcagatggatccttcttcttatacagcaaactaacagtagacaaatccagatggcaacaaggaaacgtattctcctgctcagtaatgcatgaagcactacataaccattacacacaaaaatcattatcactatcaccaggaaaa

SEQ ID NO: 51083 - RNA, 1293 nt, synthetic construct
  misc_feature 1..1293: note = derived and/or modified sequence opt6 from anti-influenza_Chain
  source 1..1293: mol_type = other RNA
atggatgaccacgcagaaaaatttttatggggagtagccacatcagcatatcaaatagaaggcgcaacacaagaagatggaagaggtccatcaatatgggatgcttttgcaaggagaccaggagcaataagagatgggtctacaggagaacccgcttgtgaccactatagaagatatgaggaagatattgctttaatgcaatcactaggtgtaagagcatatagattttcagtagcatggccaagaatattaccagaaggaaggggtcgaataaatccaaaaggacttgcattttatgatagattagtagatagattattagctagtgggataactccatttctaacattatatcattgggatttaccacttgcattagaagaaagaggaggatggcgatcaagagaaaccgcatttgcatttgcagaatatgctgaagcagtagcaagagcattagcagatagagtaccatttttcgctacattaaacgaaccatggtgctcagcatttttaggacactggacaggagaacatgcaccaggtctaagaaatctagaagcagcacttagggcagcacatcatttactattaggtcatggactagcagtagaagcattaagagcagcaggagcaagaagagtaggaatagtattaaattttgcaccagcatatggagaagatccagaagctgttgatgtagcagatagataccacaatagatatttcttagatccaatattaggtaaaggctacccggaaagtccatttagagatccaccaccagttccaatattgtcaagagatttagaattagtagcaagacctttagatttcttaggggtaaattactatgcaccagtaagggtcgcaccaggtacaggaactttaccagtgcgatatttaccacctgaaggaccagcaacagctatgggatgggaagtttatccagaaggattacatcatttattaaaaaggctaggaagagaagtaccatggccattgtatgtaacagagaatggagcagcatatccagatttatggacaggagaagctgtagtagaagatccagaacgcgtagcatacttagaagcacatgtggaagctgcactacgagcaagagaagaaggagttgatctaagaggttattttgtgtggagtttaatggataattttgaatgggcatttggatatacgagaagattcggcctatattacgtagatttcccctcacaaagaagaatacctaaaagaagtgctctatggtatcgagaaagaatagccagagcacaaaca

SEQ ID NO: 51084 - RNA, 1293 nt, synthetic construct
  misc_feature 1..1293: note = derived and/or modified sequence opt6 from anti-influenza_Chain
  source 1..1293: mol_type = other RNA
atgactgaaaatgcagaaaaatttttatggggtgtagcaacaagtgcatatcaaattgaaggagctacacaagaagatggaagaggaccatcaatatgggatgcatttgcacaaagaccaggagcaataagagatggaagtactggtgaaccagcatgtgatcattatagaagatatgaagaagatatagcactaatgcaaagtttaggagtaagagcatatagattttcagtagcatggccaagaatactaccagaaggtagaggaagaataaatccaaaaggattggctttttacgataggttagtagatagattactagcatcaggtataactccatttttaacgttatatcattgggatttaccactggcattagaagaaagaggaggatggagatctagagaaacagcatttgcttttgcagaatacgcagaagcagtagcaagagcattagctgatagagttccattctttgcaacgttaaatgaaccttggtgtagtgcatttcttggacattggaccggagaacatgcaccaggtcttagaaatttagaggcagcattgagagcagcacaccatttacttttaggccatggactagcagtagaagcattgagggctgcaggcgcaagaagagtaggaattgttttaaattttgctccagcatatggagaagatccagaagcagtagacgtagcagatagataccataatcgtttctttctagatccaatattaggaaaaggatatccagaatcaccatttagagatccaccaccagtacccatattatcaagagacttagaattagtggcaagaccattagactttttaggtgtaaattattatgcaccggtaagagtagcacctgggacaggaacattaccagttagatatttaccaccagaaggacctgcaacagctatgggatgggaagtatatccagaagggctatatcatttacttaaaagattgggaagggaagtgccttggccactatatgtcacagaaaacggagcagcatatccagatttatggacaggtgaagccgttgtggaagatccagaaagagtagcatatttagaagcacatgtagaagcagcactaagagctcgagaagaaggagttgatttaagaggttattttgtctggagtttaatggataactttgaatgggcatttggatacacaagacggttcggtttatattatgtagattttccatcacaaaggagaataccaaaaagatcagcactatggtatagagaaagaatagcaagagcacaaaca

SEQ ID NO: 51085 - RNA, 1293 nt, synthetic construct
  misc_feature 1..1293: note = derived and/or modified sequence opt6 from anti-influenza_Chain
  source 1..1293: mol_type = other RNA
atggcagaaaatgctgaaaaatttttatggggagtagcaacaagcgcataccaaatagaaggtgcaacacaagaagacggtagaggaccatcaatatgggatacattcgcaagaagacccggagcaataagagatggatcaactggtgaacctgcatgtgatcattaccatagatatgaagaagatattgcactaatgcaatcattaggagtaggagtttatagattttcagttgcttggccaagaatattgccagaaggcagagggagaataaatccaaagggcctagcattctacgatagattagttgatagattattagcagccggaataacacccttcctaacactatatcactgggatttacctcaagcattagaagacagaggagggtggagaagtagagagacagcttttgcatttgcagaatatgctgaagcagtagctagagcattagcagacagagttccatttttcgcaacactaaatgaaccttggtgtagtgcatttcttggacattggacaggcgaacacgcaccaggactaagaaatctagaagcagcacttagagctgcacatcatttattattaggtcatggactagctgtagaagcacttcgagcagctggagcaaaaagggtaggaatagttttaaattttgcacccgtttatggagaagacccagaagccgttgatgtcgcagataggtatcataatagatattttctagacccaatattaggcagaggttatccagaatcaccattccaagacccacctccaactcctaatctttcaagagatttagaattagtagctagaccattagattttctaggagtaaattattatgctccagtaagagtagcaccaggaacaggacccttaccagtaagatatctaccaccagaaggacccgtaacagcaatgggatgggaagtatatcctgaaggactgtatcatttactaaaaagattaggtagagaagtaccatggccattatatataactgaaaatggagctgcttatccagatttatggacaggggaagcagtagtagaagatccagaaagagtagcatatttagaagcacatgtagaagcagcgttaagagcaagagaagaaggtgttgatctaagaggttatttcgtatggtcacttatggacaattttgaatgggcttttggatacacaagaagatttggcttatattatgtagacttcccaagtcaaagaagaataccaaaaagaagcgcattatggtacagagaaagaatagcaagggcacaatta

SEQ ID NO: 51086 - RNA, 1293 nt, synthetic construct
  misc_feature 1..1293: note = derived and/or modified sequence opt6 from anti-influenza_Chain
  source 1..1293: mol_type = other RNA
atggatgatcacgcagaaaagttcttatggggagtagctacaagcgcttatcaaattgaaggagcaacacaagaagacggtagaggacctagtatttgggatgcatttgcaagaagaccaggagcaataagagatggaagtacaggagaaccagcatgtgatcattatcgacgatatgaagaagatatagcactaatgcagtcactaggagtaagagcttataggtttagtgtagcatggccaagaatactaccggaaggaagaggaaggataaatccaaaaggattagcattctacgacagattagtagatcgattattagcaagtggaataacaccttttctaacattatatcattgggacttgcctctagctttagaggaaagaggcggatggagatcaagagaaactgcatttgcatttgcagaatacgcagaagcagtagcaagagcactagcagatcgtgtaccattctttgcaacattaaacgaaccatggtgttcagcatttttaggtcattggacaggggaacatgctccaggattaaggaacctagaagctgcattaagggcagcacatcacttattattaggacatggattagctgtagaagcattaagagcagcaggagcaagaagggttggtattgtattaaattttgctccagcatatggagaagacccggaagcagttgatgtagccgatagatatcataatcgatattttctagatccaattttagggaaaggatatccagagtcaccttttagagaccctccaccagtaccaatactgtcaagagacttagaattagttgcaagaccattagactttttaggagttaattattatgcaccagtaagagtcgcaccaggaacaggtacattaccagtaagatacctaccacctgaaggacctgctacagcaatgggatgggaagtttatccagaaggtctacatcatttactaaaaaggctaggaagagaagtaccatggccattatatgtgacagaaaatggtgctgcatatcctgatttatggacaggagaagcagtagtagaagatccagaaagggtagcatatctagaagcacatgtcgaagcagcactaagagcaagagaagaaggagtagatttaagaggttattttgtatggtccttaatggataattttgaatgggcatttggatatactcgaaggtttggattatattatgttgatttcccaagtcaaagaaggattccaaaaagaagcgcattgtggtatagagaaagaatagctagagcacagacg

SEQ ID NO: 51087 - RNA, 1293 nt, synthetic construct
  misc_feature 1..1293: note = derived and/or modified sequence opt6 from anti-influenza_Chain
  source 1..1293: mol_type = other RNA
atgacagaaaatgctgaaaaatttttatggggagtagcaacttcagcatatcaaatagaaggagcaacacaagaagatggaagaggtccttcaatatgggatgcctttgcacaaagaccaggagcaataagagatggatcaaccggagaaccagcatgtgatcattatagaagatatgaagaagatatagcgcttatgcaatcattaggagtacgagcatatagattttcagtagcatggcccagaatacttccagaaggaagaggaagaataaatccaaaaggattagcattttatgatagattagtggatagattgcttgctagtggaataacaccctttttaacattatatcattgggatctaccattggcattagaagaaaggggaggatggagatcaagagaaacagcatttgcattcgccgaatatgcagaagcagtagcacgagcactagcagatagagtaccattcttcgctacattaaatgaaccctggtgtagtgcatttttaggacattggacaggagaacatgctccaggattgagaaatctcgaagcagccttaagagcagcacatcatttactattaggacacggactagcagtcgaagcattaagagctgctggtgcaagaagagtaggaatcgtactaaatttcgcaccagcatatggagaagacccagaagcagtagatgttgcagatagatatcataatagattctttttagatccaattctaggaaaaggctatccagaatccccatttagagatcctccaccagtaccaatactaagcagagatctcgaattagtagcaagacctcttgatttcttaggagtaaattattatgctcctgtaagagtagcaccaggaacaggaacattaccagtaagatatttaccaccagagggaccagcaacagctatgggatgggaagtatatccagaaggattatatcatctattaaaacgacttggaagagaagtaccttggcctttatatgtaactgaaaatggagcggcatatccagatttatggacaggagaagctgtagtagaagatccagaaagagtagcttacttagaagcacatgtagaagctgcattaagagcaagagaagaaggggttgatctacgaggatactttgtttggtcactaatggataattttgaatgggcatttggttatacccgaagatttggtttatattatgtagatttcccatcacaaagaagaatacctaaaagatcagctttatggtatcgagaaagaatagcaagagctcaaacg

SEQ ID NO: 51088 - RNA, 1293 nt, synthetic construct
  misc_feature 1..1293: note = derived and/or modified sequence opt6 from anti-influenza_Chain
  source 1..1293: mol_type = other RNA
atggcagaaaatgctgaaaaatttttatggggagttgcaacatcagcatatcaaattgaaggagcaacacaagaagatggtagaggaccaagcatatgggatacttttgccagaagacctggtgcaataagggatggctcaacaggtgaaccagcatgtgatcattatcaccgatacgaagaagacatagcattaatgcagtcactaggcgtaggagtatatagattctcagtcgcttggccaagaatattaccagaaggacgaggaagaataaatccaaaaggattagcattttacgatagattagtagatagactactcgctgcaggaataacgccatttttaacattataccactgggatttacctcaagccttagaagatagaggtggttggagatcaagagaaacggcttttgcatttgcagaatatgcagaagcagtagcaagggcactagcagatagagtacctttctttgcaacattaaatgaaccttggtgttcagcatttttaggacattggactggagaacatgcacctggtttaagaaacctagaagcagcattaagagcagcacatcatttattattaggtcacggattagcagtagaagcactaagagctgcaggagctaaacgagtaggtatagtacttaattttgcaccagtatatggagaagatcctgaagcagtagatgtagctgacagatatcataacagatactttttagatccaatattaggaagaggttatccagaatcaccctttcaagatcctccaccaacacccaatttaagtagagatttagaattagtagcaagaccactagactttttgggagtaaattactatgcaccagtaagagtagcaccaggaacaggaccattaccagttagatatttaccaccagaaggaccagtaacagctatgggttgggaagtatatccagaaggtctatatcatttacttaaaagattaggaagagaagtaccatggccattatacataacagaaaacggagcagcatatccagatttatggacaggagaagcagtagttgaagatccagaacgagtagcatatttagaagcacatgtagaagcagcactaagagcgagagaagaaggagtagatctacgaggatattttgtatggagtctaatggataattttgaatgggcgtttggatatacacgacgctttggattatattatgttgactttccaagtcaacgaagaataccaaaaagaagtgctttatggtatagagaaagaatagcaagagcacaatta

SEQ ID NO: 51089 - RNA, 1296 nt, synthetic construct
  misc_feature 1..1296: note = derived and/or modified sequence opt6 from anti-influenza_Chain
  source 1..1296: mol_type = other RNA
atgttcaaaccaaattatcatttctttccaataacaggatggatgaacgatccaaatggattaatattttggaaaggaaaataccatatgttttatcaatataatcctagaaaaccagaatggggaaatatatgttggggccatgcggtaagtgatgatcttgtacattggcgtcatttaccagtagcattataccctgatgacgaaacacatggagtgttttcaggtagtgccgtagaaaaagacggaaaaatgttcttagtatatacttattacagagacccaacacataataaaggagagaaagaaacgcaatgtgtagctatgagtgaaaatggactagatttcgtaaaatatgatggaaatccagtaatatcaaaaccaccagaagaaggaacgcacgcatttagagatccaaaagtaaacagaagcaatggggaatggaggatggtactaggaagtggaaaagatgaaaagataggaagagtattactttacacaagcgatgacttatttcattggaaatatgaaggagtaatatttgaagatgagacaacaaaagaaatagaatgtccagatcttgtaagaataggtgaaaaagatatactaatatattcgataacatcaacaaatagcgtattatttagtatgggagagttaaaagaaggaaaattaaacgtagagaaaagaggactattagatcatgggacagatttttacgcagcacaaacatttttcggaacagacagagtagtcgtaataggatggttacaatcatggctaagaacaggactatatccgacaaaaagagaaggatggaatggagttatgagtttaccaagagaattatacgtagaaaataatgaattgaaagtaaaacccgtagatgaattattagcactaagaaaaagaaaagtatttgaaacagccaaaagtgggacattcttattagatgtaaaagaaaactcttacgaaatagtatgtgaatttagtggagaaatagaattaagaatgggaaacgaaagtgaagaagttgtcataaccaaaagtagagatgaactaatagttgatacaacaagatcaggagtaagtggaggagaagtaagaaaaagtacagtagaagatgaggcaacaaatagaataagagcatttttagactcatgttcggtagaatttttcttcaatgactcaatcgcattttcatttagaatccacccagaaaatgtttataatatattaagcgtaaaatcaaatcaagttaaacttgaagtcttcgaattagaaaatatctggtta

SEQ ID NO: 51090 - RNA, 1296 nt, synthetic construct
  misc_feature 1..1296: note = derived and/or modified sequence opt6 from anti-influenza_Chain
  source 1..1296: mol_type = other RNA
atgtttaaaccaaactaccacttctttccaataacaggatggatgaatgacccaaatggcctaatattttggaaaggaaaataccatatgttttaccaatataatccaagaaaaccagaatggggaaacatatgttggggacacgcagtttcagacgatttagtacactggagacatttaccagtagcactctatccagacgacgaaacccacggagtattttcaggaagcgccgtagaaaaagatggaaaaatgtttttagtctatacatactatagagacccaacacataacaaaggcgaaaaagaaacacaatgtgtagcaatgtcagaaaatgggctagactttgtaaaatatgacggaaacccagtaattagtaaaccaccagaagaaggaacacacgcatttagagacccaaaagtaaacagaagcaatggagaatggaggatggttctgggaagtggaaaagatgaaaaaattggcagagtactactatacacaagcgatgacctatttcattggaaatacgaaggtgtaatatttgaagacgaaacaactaaagaaatagaatgtccagacttagtaagaataggagaaaaagatatactaatatacagcattaccagtacaaacagtgtattatttagcatgggagaactaaaagaaggaaaattaaacgtagaaaaaagaggattattagaccatggaacagacttttatgcagcacaaacatttttcggaacagatagagtagtagtaataggatggctacaaagttggctaaggacaggattatacccgacaaaaagagaaggatggaacggagtaatgagcttaccaagagaactatacgttgaaaataatgaactaaaagttaaaccagtagacgaactattagccctaagaaaaagaaaagtatttgaaacagcaaaaagcggaacatttttattagacgtaaaagaaaattcatatgaaatagtatgcgaattttcaggagaaatagaactaagaatgggaaacgaaagtgaggaagtagtaataactaaatcaagagatgaattaatagtagacacaacaagaagtggagtttcaggaggagaagtcagaaaaagcacagtagaagacgaagcaaccaatagaataagagcgtttctagactcgtgttcagtagaatttttttttaatgacagtatagcattctcatttcgaatacaccctgaaaacgtatataatatattaagtgtaaaatcaaaccaagtaaaactagaagtattcgaattagaaaatatatggtta

SEQ ID NO: 51091 - RNA, 1323 nt, synthetic construct
  misc_feature 1..1323: note = derived and/or modified sequence opt6 from anti-influenza_Chain
  source 1..1323: mol_type = other RNA
gaagtaaaactagtagaatcaggaggaggcttagtccaacccggaggaagcctaagactatcatgcgctacatcaggattcacattttcagactactatatgtcatgggtacgacaatcacccggaaaagcactagaatggctaggattcacaagatcacgagtattaggatacacaacagactattcagcctcagtaaaaggaagattcaccataagtagagataactcacaatcaatcctatatctacaaatgaattcactaagaggagaagactccgcaacttactactgcgcaagagacagacccatggattactggggccaaggaacatcggtaacagtctcaagcgctaaaacaacaccaccatcagtataccccttagcacccggctcagcagcacaaacaaactcaatggtaacattaggatgcctagtaaaaggatacttcccagaaccagtaacagtaacctggaattctgggtcattatcatcaggcgtacatacattccccgcagtactacaatcagatctttatacactatcctcttcagtcacagttccatcaagtacatggccatcagaaacagtaacatgtaacgtagcacatcctgcatcttcaaccaaagtagataaaaaaattgtacccagagattgcggatgcaaaccctgtatatgtacagtaccagaagtatcatcagtattcatatttccacccaaacctaaagatgtattaacaatcacattaaccccaaaagtaacatgcgttgtcgtcgacatcagcaaagacgacccagaagtacaattttcatggttcgtagacgacgtcgaagtacacaccgctcaaacacaacccagagaagaacaatttaattcaacatttagatctgtatcagaattaccaataatgcaccaagactggcttaacggaaaagaatttaaatgcagagtaaactcagccgcattccctgcaccaatagaaaaaacaatatcaaaaacaaaaggaaggccaaaagccccccaagtctatacaataccaccacccaaagaacaaatggctaaagataaagtctcattaacatgtatgataacagactttttcccagaagatatcacagtcgaatggcaatggaacggccaaccagccgaaaattataaaaacacgcaacctataatggacacagacggatcatacttcgtctactcaaaattaaatgtacaaaaatcaaattgggaagcaggaaacacatttacatgctctgtattacacgaaggactacataaccatcacactgaaaaatcactttctcactcacccggaaaa

SEQ ID NO: 51092 - RNA, 1323 nt, synthetic construct
  misc_feature 1..1323: note = derived and/or modified sequence opt6 from anti-influenza_Chain
  source 1..1323: mol_type = other RNA
gaagtaaaactagttgaatcaggaggaggattagtccaaccaggtggatccctacgattatcatgcgctacatcaggatttaccttttcagattactatatgtcttgggtaagacaatctcctggaaaagcactcgaatggctaggattcacaagatcaagagtattaggctacactacagactacagtgcatccgtaaaaggacgcttcactatatcaagagataactcccaatcaatactatatttacaaatgaacagtctaagaggagaagactcagccacctactattgtgcaagagatagaccaatggactattgggggcaaggtacatcagtaacagtatcctcagcaaaaacaacacccccatcagtttaccctttagcaccaggttccgccgcacaaacaaactcaatggtaacattaggatgcttagtaaaaggctatttcccagaaccagtcactgtaacatggaattccggatcactttcttctggtgttcatactttcccagccgtcctccaatcagacttatatacactatcatcatccgtaacagtaccatcttccacttggccaagcgaaacagtaacctgtaatgttgcacacccagcttcatcaacaaaagtcgataaaaaaatagtaccacgagactgcggatgtaaaccatgcatatgcacagtcccagaagtatcttcagttttcatatttccaccaaaaccgaaagatgtactaacaataacactaacaccaaaagtcacctgcgtagtcgtcgacatatcaaaagatgacccagaagtacaattttcatggttcgtcgacgatgtggaagtacatacagcacaaacccaacctagagaagaacaattcaattcaacattcagatcagtatccgaactcccaataatgcaccaagactggttaaatggaaaagaatttaaatgccgagtaaactcagccgctttcccagcaccaatagaaaaaacaatcagtaaaacaaaaggaagaccaaaagctccacaagtatacacaatcccaccacccaaagaacaaatggcaaaagacaaagtatcattaacatgtatgataacagacttctttcctgaagacataacagtagaatggcaatggaatggccaaccagctgaaaattataaaaatacacaaccaataatggatacagatggatcctactttgtctactcaaaactaaatgtacaaaaatctaactgggaagcaggaaatacatttacatgttcagtattacatgaaggactccataaccatcatacagaaaaatcactatcacattcccctggaaaa

SEQ ID NO: 51093 - RNA, 1329 nt, synthetic construct
  misc_feature 1..1329: note = derived and/or modified sequence opt6 from anti-influenza_Chain
  source 1..1329: mol_type = other RNA
gaagtacaactccaacaatccggacccgaattagtaaaaccaggcgcatcagtaaaaatgtcatgtaaagcatcaggctacacattcacatcttacgttatgcattgggtaaaacaaaaacccggccaaggactagaatggataggatatataaacccatacaacgacggaacaagatacaacgagaaattcagagtaaaagccacactaacttcagacaaatcctcatcaacagcttatatggaattatcctccctaacttctgaagactccgcagtatattactgtgcaagacgaggattaataacaacaccaacactcgactactggggacaaggcacaaccttaaccgtatcatctgcaaaaactacaccaccctccgtctacccactagccccaggatcagccgcacaaacaaactctatggtcacactaggatgccttgtaaaaggatactttccagaaccagtaacagtaacatggaattccggatcactatcctcaggagttcacacatttccagcagtattacagtcagacctttatacactatcctcatcagtaactgtaccatcatcaacatggccatcagaaacagtaacatgtaatgtagcacacccagcttcatcaacaaaagtagataaaaaaatagtaccaagagactgcggatgcaaaccatgcatctgcacagtacccgaagtatccagtgtctttatattcccaccaaaacccaaagacgtattaacaataaccttaaccccaaaagtaacatgcgtagttgtcgacatatcaaaagacgacccagaagtacaattcagttgggtagatgacgtagaagttcacacagcccaaacacaacctagagaagaacaattcaactccacattccgctcagtatccgaattacctatcatgcatcaagactggttaaacggaaaagaattcaaatgcagagttaactcagcagcattccccgcacccatagaaaaaacaatatctaaaacaaaaggaagaccaaaagccccacaagtatatacaataccaccaccaaaagaacaaatggcaaaagacaaagtatcactaacatgcatgataacagactttttcccagaagacataacagtagaatggcaatggaacggccaacccgcagaaaactacaaaaacacccaaccaataatggatacagacggatcatacttcgtatattccaaattaaacgtacaaaaaagcaactgggaagcaggaaacacatttacttgttcagtcttacatgaaggcctacataatcaccacacagaaaaatcattatcacactcacctggaaaa

SEQ ID NO: 51094 - RNA, 1329 nt, synthetic construct
  misc_feature 1..1329: note = derived and/or modified sequence opt6 from anti-influenza_Chain
  source 1..1329: mol_type = other RNA
gaagtacaacttcaacaatcaggacctgaattagtaaaaccaggagcatcagtaaaaatgtcctgtaaagcctccggatacacattcacatcatacgtcatgcactgggttaaacaaaaaccaggacaaggattagaatggataggatatataaacccatacaatgacggcacaagatataacgaaaaatttagagtaaaagcaacattaacatcagataaatcatcttccactgcatacatggaattatcatccctaacttcagaagactcagcagtatactattgcgcaagaagaggattaataacaacaccaacactagactactggggacaaggcacaacacttaccgtttcatcagcaaaaacaacaccaccatccgtatacccattagctccaggatcagctgcacaaacaaactcaatggtaactttaggctgcctagttaaaggctatttcccagaaccagttacagttacatggaactcaggatccctctcatcaggagttcacaccttcccagccgtccttcaatcagacctatacacactatcatcatccgtaaccgtaccatcttcaacctggccaagcgaaacagtaacatgcaacgtagctcacccagccagttcaacaaaagtagacaaaaaaatagtaccaagagactgtggatgcaaaccctgcatatgcacagtaccagaagtctcatcagtattcatatttcccccaaaaccaaaagacgtactaaccataacactaaccccaaaagtaacctgcgtagtcgtagacatttccaaagatgacccagaagtacaattctcatgggtagacgacgtcgaagtccacaccgcacaaacccaaccaagagaagaacaattcaattctacatttagatcagtttccgaactccccataatgcaccaagactggttaaacggaaaagaatttaaatgcagagtaaattcagcagcattcccagcaccaatagaaaaaacaatatccaaaaccaaaggaagaccaaaagcacctcaagtctacacaataccaccaccaaaagaacaaatggcaaaagacaaagtatcattaacatgtatgataacagacttctttcccgaagacatcactgtagaatggcaatggaacggccaaccagcagaaaactacaaaaacacacaacctataatggacacagacggaagctactttgtatatagtaaactcaatgtacaaaaaagtaactgggaagcaggaaacacttttacatgctctgtcctacacgaaggactacacaatcaccacaccgaaaaatcattatcccactcaccaggaaaa

SEQ ID NO: 51095 - RNA, 1332 nt, synthetic construct
  misc_feature 1..1332: note = derived and/or modified sequence opt6 from anti-influenza_Chain
  source 1..1332: mol_type = other RNA
aacgtaccagaatggtcctacatagtagaaaaagcaaacccagccaacgacttatgctacccaggcaactttaacgattacgaagaactaaaacatctattatcaagaataaatcacttcgaaaaaatacaaataataccaaaatcatcttggtcagaccatgaagcatcttcaggagtttcatccgcatgcccatatcaaggaacaccctcattcttcagaaacgtagtatggttaataaaaaaaaacaacacatacccaactataaaacgatcatacaacaatacaaaccaagaagacttactaatactatggggaatacaccattcaaacgacgcagcagaacaaactaaactataccaaaatccaacaacatatataagcgttggcacatcaacacttaaccaaagactcgtaccaaaaatagcaactagatcaaaagtcaacggacaaaacggaagaatggacttcttctggacaatactaaaaccaaacgatgcaataaacttcgaatctaacggcaacttcatagctcccgaatacgcttacaaaatagtcaaaaaaggatacatacctgaagcaccaagagacggacaagcctacgttagaaaagacggagaatgggtactactatccaccttcttaagaagtgacaaaacccacacatgcccaccatgtccagcaccagaattactaggaggaccctcagtattcctattcccacctaaaccaaaagacaccctaatgatatcacgcacaccagaagttacatgcgttgtcgtagatgtttcccacgaagacccagaagttaaattcaactggtatgtagacggcgtcgaagtacataatgcaaaaaccaaacctagagaagaacaatacaactctacctacagagtcgtatcagtactcacagtactacaccaagattggcttaacggaaaggaatacaaatgcaaagtatcaaacaaagcactaccagcacctattgaaaaaacaatatccaaagccaaaggacaacccagagaaccacaagtatacaccctaccaccatcaagagaagaaatgacaaaaaaccaagtctcactcacatgcctagtaaaaggtttctatccatccgacatcgccgtagaatgggaatctaacggacaaccagaaaataactataaaacaactccaccagtattagactcagacggatccttcttcttatacagcaagttaaccgtagacaagtccaggtggcaacaaggaaatgtattttcatgttccgtaatgcatgaagcactacacaaccattatacacaaaaatcactatccctatcaccaggaaaa

SEQ ID NO: 51096 - RNA, 1332 nt, synthetic construct
  misc_feature 1..1332: note = derived and/or modified sequence opt6 from anti-influenza_Chain
  source 1..1332: mol_type = other RNA
aacgtcccggaatggtcatacatagttgaaaaagcaaacccagcaaacgacttatgctacccaggaaacttcaatgattacgaagaattaaaacacctactttcacgaatcaaccactttgaaaaaatacaaataatcccaaaatcatcatggtcagaccacgaagcatcatctggagtatcatccgcatgcccatatcaaggaacaccaagctttttccgtaacgtagtatggttaatcaaaaaaaacaacacatatcccacaataaaacgatcatacaacaacaccaatcaagaagaccttctaatattatggggaatccatcactcaaacgacgcagcagaacaaacaaaattatatcaaaacccaacaacctacatatcagttggaacaagcacattaaatcaaagactagtaccaaaaatagcaactagaagcaaagtaaacggacaaaacggacgaatggatttcttctggacaatattaaaaccaaacgacgcaataaactttgaatcaaacggaaattttatagcacctgaatatgcatacaaaatagtaaaaaaaggatacatacccgaagcaccaagagatggccaagcctacgtcagaaaagacggagaatgggtactcctctcaacatttttaagatcagacaaaactcacacttgcccaccatgcccggcaccagaactactaggcggcccatccgtattcctattcccaccaaaaccaaaagacacactaatgatatcaagaacaccagaagtaacatgtgtagtagtagacgtatctcacgaagacccagaagtaaaatttaactggtacgtagacggagttgaagtacataacgcaaaaaccaaacctcgagaagaacaatacaactctacatatagagtagtatctgtcctaacagtattacaccaagactggctaaacggaaaagaatacaaatgcaaagtatcaaacaaagcactaccagccccaatagaaaaaaccatatcaaaagccaaaggacaacctcgagaaccacaagtctacacactcccaccatccagagaagaaatgaccaaaaaccaagtctcactaacatgcctagtaaaaggattttacccatcagatatagcagttgaatgggaatccaacggacaacccgaaaacaattacaaaaccacaccaccagtattagattcagacggttcattcttcctctactccaaactaacagtagacaaatcaagatggcaacaaggaaacgtcttcagctgcagtgtcatgcacgaagcactacacaaccactatacacaaaaatccctatcactttcaccaggaaaa

SEQ ID NO: 51097 - RNA, 1341 nt, synthetic construct
  misc_feature 1..1341: note = derived and/or modified sequence opt6 from anti-influenza_Chain
  source 1..1341: mol_type = other RNA
caagtacaactacaagaatcaggcccaggattagtaaaaccatcagaaacactatctctaacttgcacggtatcaggaggtctaatcggaactggatcatactactggggatggattagacaaacccctggaaaaggaatggaatggataggatcaatatcctactcaggatccacttactaccatccatcattaaaatcaagagtaacaatatcagacgacacatccaaaaaccaattattcttaaaattaagatccgttacagccgcagatacagcacaatactactgcgcaagatacaactggggaataagatatttcgacttttggggtagaggtacactagtaactgtatcatctgcaagtacaaaaggaccatcagtatttcctctagcaccatgctcccgatcaacgtcagaatcaacagccgccctaggatgtctagtcaaagattactttcccgaacccgtaaccgtatcatggaattccggagccctaacaagcggagtacacacatttccagctgtattacaatcctccggactatactctttatcctccgtcgttacagtaccatcctcatctttaggtacaaaaacatacacatgcaatgtcgaccacaaaccatccaacacaaaagtagataaaacacgagaatcaaaatatggaccaccctgcccatcctgtccagccccagaattcttaggaggcccatctgtatttttattcccaccaaaaccaaaagacactttaatgatatcccgaacacctgaagtaacatgcgtagtcgtggacgtctcccaagaagacccagaagtacaatttaactggtacgtagacggagtagaagtacataacgctaaaactaaacctcgagaagaacaattcaactcaacataccgcgtagtatccgtcctaaccgtactacatcaagattggttaaacggaaaagaatataaatgtaaagtttccaataaaggattaccttcatcaattgaaaaaacaatatccaaagccaaaggacaaccacgagaaccacaagtatatacattaccaccagcacaagaagaaatgactaaaaatcaagtttcattaacatgcctagtaaaaggattctacccatcagatatagcagtagaatgggaatctaacggacaaccagaaaataactataaaactacaccaccagttttagattcagatggatccttttttttatattcacgtctaacagtagacaaatcaagatggcaagaaggtaacgtattttcatgttcagtaatgcatgaagccttacataaccattacacacagaaatctctctccttatccctaggaaaa

SEQ ID NO: 51098 - RNA, 1341 nt, synthetic construct
  misc_feature 1..1341: note = derived and/or modified sequence opt6 from anti-influenza_Chain
  source 1..1341: mol_type = other RNA
caagtacaattacaagaatcaggaccaggtttagtaaaaccatcagaaacattatccctaacatgtacagtatccggaggactaattggaacaggatcatactattggggatggatacgacaaacccctggaaaaggaatggaatggataggttctataagttattcaggttctacatattaccacccatcactcaaatcaagagtaacaatttcagacgacacaagcaaaaatcaattattcttaaaactaagatccgtaacagcagcagatacagcacaatattattgcgcaagatacaactggggcatcagatatttcgacttctggggaagaggcacattagtaaccgtaagtagtgcatccactaaaggaccatctgtatttccattagccccatgttcaagaagtacttcagaaagtacagcagccttaggatgcttagtaaaagattactttccagaacccgttacagtatcatggaattcaggcgccttaacatccggagtacacacatttccagccgtacttcaatcatctggtctatactcactaagctctgtagtcacagttccatcatcatcactaggaaccaaaacctatacatgtaacgtagaccacaaaccctcaaatacaaaagtcgacaaaacaagagaatccaaatacggtccaccttgcccatcatgtccagcaccagaattcctaggcggaccatctgtattcttattcccacctaaaccaaaagatacattaatgatcagtcgaacaccagaagtaacatgtgtagtcgtagacgtatcacaagaagatccagaagtacaattcaactggtacgttgacggagtagaagttcacaacgcaaaaacaaaaccaagagaagaacaattcaattcaacatacagagtagtatcagtattaacagtactccaccaagattggctaaacggaaaagaatacaaatgtaaagttagcaataaaggactaccatcatccatagaaaaaacaatatcaaaagcaaaaggacaacctagagaaccacaagtctacaccttaccaccagcccaagaagaaatgacaaaaaaccaagtttcattaacatgtcttgtcaaaggattttacccatcagacatagcagttgaatgggaatcaaatggacaaccagaaaacaactacaaaacaacaccaccagtactagacagtgacggatcattcttcttatatagcagactaacagtagataaatcacgatggcaagaaggaaacgtattctcctgtagtgtaatgcacgaagccctacataatcactacacacaaaaaagtttatcactaagcctaggaaaa

SEQ ID NO: 51099 - RNA, 1344 nt, synthetic construct
  misc_feature 1..1344: note = derived and/or modified sequence opt6 from anti-influenza_Chain
  source 1..1344: mol_type = other RNA
gaagtacaactccaagaatcaggtccaggcctagtaaaaccttcccaaacattatcattaacatgtaacgtatcaggtggatcaataactggtgactacaaatggtcatggatacgccaaccaccaggaaaaggattagaatggataggacacatacattcaactggaaccacatactacaatccaagtctaagatcaagaataacaataagcatggacacatcaaaaaacaacctatccctaagactaacatcagtcacagcagccgacaccgctgtctactattgcgcctcacacacactaacatcaggacactatccaagagacttcgatttctggggacaaggaacactagtcacagtatcatctgcctctacaaaaggaccatctgtctttccactagccccctgttcgagatcaacctcagaatcaaccgcagcactaggctgcctagtaaaagactacttcccagaacccgtaacagtatcttggaactcaggagcattaacaagcggagtacacacattcccagcagtactacaatcaagcggattatactcattaagctcggtagtaacagtaacatcatcaaactttggcacacaaacatacacatgcaacgtagaccataaaccttcaaacaccaaagtagataaaactgtcgaaagaaaatgctgtgtcgaatgtccaccatgccctgcaccaccagtcgcaggcccttcagtattcctattcccacctaaacctaaagatacattaatgatatccagaacaccagaagtaacttgtgtagtagtagacgtttctcacgaagaccccgaagtacaattcaattggtatgtcgatggaatggaagtacacaacgctaaaaccaaaccaagagaagaacaatttaactcaacctttcgtgtagtatctgtcctaactgtagttcatcaagactggctaaatggtaaagaatataaatgtaaagtatctaacaaaggactaccagcaccaatagaaaaaacaatatccaaaaccaaaggacaaccaagagaaccacaagtatatacactaccaccatcacgagaagaaatgaccaaaaaccaagtatctctaacctgccttgtaaaaggattttacccctccgacatagcagtagaatgggaaagtaacggccaacctgaaaacaactacaaaacaacacccccaatgctagactcagatggcagcttctttctatactcaaaactcaccgtagacaaatctagatggcaacaaggaaacgtattctcatgctcagtcatgcacgaagcactacacaaccactatacacaaaaatcactatcactatccggaaaa

SEQ ID NO: 51100 - RNA, 1350 nt, synthetic construct
  misc_feature 1..1350: note = derived and/or modified sequence opt6 from anti-influenza_Chain
  source 1..1350: mol_type = other RNA
caagttcaactacaacaatcaggcgcagaagtaaaaaaacctggatcctcagtaaaagtatcttgcaaagtatccggagtcatattctcaggatcagcaatatcctgggtcagacaagcaccaggacaaggacttgaatggatgggcggaatctcaccattattcggaaccacaaactacgcccaaaaattccaaggcagagtcacaataacagccgaccaatcaacaaacacaacatacatggaagtaaactcactaagatacgaagacacagcagtatacttttgcgcgagaggaccaaaatactactccgaatacatggacgtatggggaaaaggtacaacagttaccgtatcatcagcttcaacaaaaggaccatcggtattcccactagcaccttcctcaaaatcaacatcaggtggaacagcagcactaggctgtttagtgaaagactacttccccgaacccgtaacagtttcatggaacagtggcgcattaacatccggagtacacaccttccctgcagtattacaatcctcaggactatactcactatcatctgtagtcacagtaccatcatcatcattaggaacacaaacatatatatgtaacgtcaaccacaaaccctccaataccaaagtagacaaacgagtagaacccaaatcctgtgacaaaacacacacatgcccaccatgcccagcaccagaactactaggtggaccatcagtcttcctattccccccaaaacccaaagacacactcatgatatcaagaacaccagaagtcacatgcgttgtagtagacgtatcccacgaagaccctgaagtaaaattcaattggtacgtcgatggtgtagaagtacacaacgccaaaacaaaacccagagaagaacaatataactcaacatacagagttgtatccgtattaactgttctacaccaagattggctaaatggaaaagaatacaaatgcaaagtttcaaacaaagcactacccgcacccattgaaaaaactatctcaaaagctaaaggacaacccagagaaccacaagtttacacattaccaccatcaagagaagaaatgacaaaaaatcaagtatccttaacatgcctcgtaaaaggattttatccctcagacatagcagtagaatgggaatctaatggacagccagaaaataattataaaaccacaccaccagtactagactccgacggatctttcttcttatattcaaaattaacagtagataaaagtcgatggcaacaaggaaacgttttctcatgctcagtaatgcacgaagcattacacaaccattatacacaaaaatctttatcattatcaccaggtaaa

SEQ ID NO: 51101 - RNA, 1350 nt, synthetic construct
  misc_feature 1..1350: note = derived and/or modified sequence opt6 from anti-influenza_Chain
  source 1..1350: mol_type = other RNA
caagtccaacttgttcaatcaggagccgaagtaaagaaaccaggaagtagtgtgaaagtctcttgcaaagcatcgggaggaacattttcatcttacgcaatatcatgggtaagacaagcaccaggacaaggactagaatggatgggaggaataatgggaatgtttggaacaaccaactacgcacaaaaattccaaggaagagtaacaataacagcagatgaatttacatcagcagcttacatggaattaagatcattaagatcagaagacactgcagtttattactgcgcaagatcctcaggttactaccccgaatatttccaagattggggacaaggaacattagttaccgtatcatcagcttccaccaaaggcccttcagtatttccattagcaccctcaagcaaatctacatcaggcggaacagcagcactaggatgtcttgtcaaagattacttcccagaaccagtaactgtctcatggaactcaggagcattaaccagtggagtacacacatttccagcagtattacaaagttcaggactatactcattatcatcagtagtcaccgttccatcatcatccttaggaactcaaacatatatctgtaatgtcaatcacaaaccctcaaacacaaaagtagacaaacgagtagaaccaaaatcatgtgataaaacacatacatgtccaccatgcccagcccctgaattactaggaggaccctctgtattcttatttccacccaaaccaaaagacacattaatgatatcaagaacacctgaagtaacatgcgttgttgtagatgtctctcatgaagacccagaagtaaaattcaactggtatgtagatggagttgaagtacataatgcaaaaacaaaaccaagagaagaacaatataactctacatacagagtagtgtcagtcttaactgtactacaccaagattggttaaatggaaaagaatacaaatgcaaagtatccaacaaagctctaccagcaccaatagagaaaactatatcaaaagcaaaaggacaaccaagagaaccacaggtatatacactacctccctcacgcgaagaaatgaccaaaaaccaagtatcattaacatgcttagtcaaaggattctacccctctgatatagcagtagaatgggaaagtaacggacaaccagaaaataattacaaaaccacaccacccgtactagactcagatggaagtttcttcctatattcaaaattaacagtagacaaatctcgatggcaacaaggaaacgtattctcctgctcagtcatgcacgaagccttacacaaccactatacacaaaaatctttatccctatcaccaggtaaa

SEQ ID NO: 51102 - RNA, 1350 nt, synthetic construct
  misc_feature 1..1350: note = derived and/or modified sequence opt6 from anti-influenza_Chain
  source 1..1350: mol_type = other RNA
gaagtacaactagtagaatcaggagctgaagtaaaaaaacccggatcttcagtaaaagtatcttgcaaagccagcggaggtacattttcctcatatggaatatcatgggtacgacaagcaccaggacaaggactagaatggatgggcgacataataggaatgtttggaagtacaaactatgctcaaaatttccaaggaagactaacaataaccgcagacgaatcaacctcaacagcatacatggaattatcatcactaagatccgaagacaccgcagtatactattgcgcaagatcctcaggttattaccccgcctaccttcctcactggggccaaggaactttagtaacagtttcctccgcatctacaaaaggaccatctgtcttccccttagccccatcatcaaaatccacatcaggaggaacagccgccctaggatgtttagtaaaagactatttcccagaaccagtaacagtatcatggaattctggagcattaacatcaggagttcacacctttcccgcagtcctacaatctagcggactatactcattaagctcagtagtaacagtacctagctcatccttaggtacacaaacatatatctgcaacgtaaaccataaaccttcaaatacaaaagtagataaaagagttgaaccaaaatcatgcgacaaaacacatacatgtccaccatgcccagcaccagaactcctaggtggaccatccgtatttctcttccccccaaaaccaaaagacacacttatgatctcacgcactcccgaagttacatgtgtcgtagtcgacgtaagccacgaagatccagaagttaaattcaactggtacgtagacggtgtagaagtacacaatgcaaaaactaaaccaagagaagaacaatacaactcaacttaccgagtagtatcagtactaacagttttacaccaagattggctaaacggaaaagaatataaatgcaaagtctccaacaaagcactaccagcaccaatagaaaaaaccatatcaaaagcaaaaggacaaccaagagaaccacaagtatatacattaccaccctcacgagaagaaatgacaaaaaaccaagtatcacttacatgcctagtaaaaggtttctacccatcagacatcgcagtagaatgggaatcaaatggccaaccagaaaacaactacaaaacaacaccaccagtactagattcagacggatcattttttttatactcaaaactaacagtagacaaatctagatggcaacaaggaaacgtattctcatgctcagtaatgcatgaagcactccacaaccactacacccaaaaatcactttcactaagccccggcaaa

SEQ ID NO: 51103 - RNA, 1350 nt, synthetic construct
  misc_feature 1..1350: note = derived and/or modified sequence opt6 from anti-influenza_Chain
  source 1..1350: mol_type = other RNA
gaagtacaattagtagaatcgggcgcagaagtaaaaaaacccggctcatcagtaaaagtatcatgtaaagcatcaggcggaactttcagctcatatgcaatatcatgggtaagacaagccccaggacaaggcttagaatggatgggaggaataataggaatgttcggaacagcaaactatgcccaaaaattccaaggaagagtaacaatcaccgcagacgaattcacatcaacagcatatatggaactatcttcattacgatcagaagacacagcagtatattactgcgcaagaggaaactattattacgaatcatcattagactactggggacaaggtacactagtaaccgtctcttcagcatcaacaaaaggaccatctgtatttccactagcaccatcatcaaaatcaacaagtggaggaacagcagcactaggatgcctagtaaaagattattttccagaaccagtaaccgtctcatggaattcaggagcattaaccagcggagtacacaccttcccagcagtattacaatcatcaggactatattcattaagctcagtcgtaactgtaccctcatcatccttaggaacacaaacatatatatgcaatgtaaaccacaaaccctccaacacaaaagtagacaaaagagtagaaccaaaatcttgtgacaaaacacatacatgtccaccatgcccagcaccagaattattaggcggaccttcagtatttttattcccaccaaaaccaaaagatacactaatgatctcaagaacccctgaagtaacgtgtgtagtcgtagacgtaagccacgaagatccagaagtaaaatttaactggtacgtcgacggtgtagaagtacacaacgcaaaaactaaaccaagagaagaacaatataattctacatatagagtagtttcagtcttaacagtactacatcaagattggctcaatggaaaagaatacaaatgtaaagtatcgaataaagcattaccagcaccaatagaaaaaaccatatcaaaagcaaaaggccaaccaagagaaccccaagtatatacactacctccaagcagagaagaaatgacaaaaaaccaagtttcattaacttgcttggtcaaaggattttatccgtccgacatagcagtagaatgggaatcaaacggacaaccagaaaacaactacaaaacaacaccacccgtactagactcagatggatccttcttcttatattctaaactaacagtcgacaaatcaagatggcaacaaggcaacgtattctcttgctcagtaatgcacgaagcactacacaaccactatacacaaaaatcactaagcctatctccaggtaaa

SEQ ID NO: 51104 - RNA, 1350 nt, synthetic construct
  misc_feature 1..1350: note = derived and/or modified sequence opt6 from anti-influenza_Chain
  source 1..1350: mol_type = other RNA
gaagtccaactagtacaatctggagcagaagtcaaaaaaccaggctcatctatgaaagtctcttgcaaagcatccggctcaatattctcaaactacggaatatcatgggtaagacaagccccaggtcaaggactagaatggatgggaggtataatacccatatttggcgcagcaaattacgcacaaaaattccaaggaagagttacaattacagccgacgaatcaacatcaacagtatacatggaagtacgatcactcagatcagaagacactgcagtatactactgcgcaagaagacaacaactttacaaaggttactatcatcattggggacaaggaacactagtaacagtatcctcagcatcaacaaaaggtccatcagttttcccactagcaccatcatccaaatcaacatcaggaggcacagcagcactaggctgcctagtaaaagactactttccagaaccagtaacagtatcctggaactcaggagcattaactagtggcgtacatacattccctgcagtattacaatcatcaggcttatacagcctaagctccgtagtaacagtaccatctagctcactaggtacacaaacatacatctgtaacgtaaatcataaaccaagcaataccaaagtcgacaaaaaagtagaaccaaaatcatgcgacaaaacacatacatgtcccccatgccctgcaccagaattactaggaggaccaagcgtattcttattccccccaaaaccaaaagacacactaatgatctcaagaacaccagaagtaacttgcgtagtcgtagatgtttcacatgaagatccagaagtaaaattcaattggtacgtggacggagtcgaagtacacaatgcaaaaacaaaaccacgagaagaacaatataactcaacatacagagtagtatccgttctaacagttttacaccaagactggctaaacggaaaagaatacaaatgcaaagtatccaacaaagcattaccagcccccatagaaaaaacaatatcaaaagccaaaggccaaccccgagaaccacaagtatacacactaccaccatcaagagaagaaatgacaaaaaaccaagtatctcttacatgtctcgtaaaaggattctatccctcagacatagcagtcgaatgggaatcaaatggacaaccagaaaataactacaaaaccacaccaccagttctagactcagacggatccttcttcttatactcaaaattaacagtagataaatcacgttggcaacaaggtaacgtattctcatgttcagtaatgcacgaagcattacataaccactacactcaaaaatcactatcattatcaccaggaaaa

SEQ ID NO: 51105 - RNA, 1350 nt, synthetic construct
  misc_feature 1..1350: note = derived and/or modified sequence opt6 from anti-influenza_Chain
  source 1..1350: mol_type = other RNA
caagtccaacttgtacaatcaggagccggagtaaaaaaaccaggatcctcaatgaaagtatcatgcaaagcatcaggatcaatattttcaaattatggtatatcatgggtaagacaagcgcctggacaaggattagaatggatgggaggaattataccaatattcggcgcagcaaactacgcccaaaaatttcaaggaagagtaacaataactgccgatgaatccacatcaacagtatacatggaagtacgatcattaagatctgaagacactgccgtatactactgcgcacgaagacaacaactttataaaggatactatcaccattggggacaaggcacattagtaacagtatcatcagcaagcacaaaaggaccatcagtatttccactagctcccagttccaaaagtacatccggaggaaccgcagcactaggatgcctcgtaaaagattactttccagaaccagtaacagtctcatggaattcaggcgcattaacctcaggagtccacacattccccgcagttcttcaatcaagtggattatacagcctatcatcagtagtaacagtcccatcaagcagcctaggaacacaaacatacatatgcaacgtaaaccacaaaccatcaaacacaaaagtagacaaaaaagtagaacccaaatcatgtgataaaacacacacatgtccaccatgccctgcacccgaactattaggaggaccatcagtattcctatttccaccaaaaccaaaagacaccctaatgatatctagaacaccagaagtaacctgcgtcgtcgtagacgtatcacacgaagatccagaagtaaaatttaactggtacgtagacggagtcgaagtacacaacgcaaaaacaaaaccaagagaagaacaatataactcaacataccgcgtagtatctgttcttacagtcctccatcaagactggttaaacggaaaagaatataaatgtaaagtatcaaacaaagcactaccagcaccaatagaaaaaaccatatctaaagcaaaaggacaaccacgagaaccacaagtatacacactcccaccatcaagagaagaaatgacaaaaaaccaagtatcactcacatgtttagtaaaaggcttttatccatcagacatagcagttgaatgggaaagtaatggccaaccagaaaacaactataagacaaccccaccagtactcgacagtgacggatcattcttcctatactcaaaattaaccgtagacaaatcaaggtggcaacaaggaaacgtattctcatgttcagtaatgcatgaagcattacataatcactatacccaaaagtccctatcactttcaccaggaaaa

SEQ ID NO: 51106 - RNA, 1350 nt, synthetic construct
  misc_feature 1..1350: note = derived and/or modified sequence opt6 from anti-influenza_Chain
  source 1..1350: mol_type = other RNA
caagtacaattagtacaatcaggcgcagaagtacgaaaacctggttctagtgtaaaagtatcatgcaaagtatcaggaggcataataagaaaatacgcaataaactgggtaagacaagctcccggccaaggcctagaatggatgggaggaataatagccatcttcaacacagcaaattacgcacaaaaatttcaaggacgagtgactataacagcagacgaaagcacaagcacagtatatatggaactatcatctctacgatcagaagatacagccctatactactgcgcccgaggcatgaattactattcagattatttcgattactggggacaaggatcactcgtaaccgtatcaccagcatcaacaaaaggaccctcagtatttcccttagcaccatcaagtaaatccacatcaggaggtacagcagccttaggatgcctagtaaaagactacttcccagaaccagtaacagtatcctggaattcaggagcactaacatcaggagtacacacatttccagcagtactacaatcatcaggtctatactcattatctagcgtagtaacagtcccatcatcatcactaggaacccaaacatacatatgcaacgttaaccataaaccatcaaatacaaaagtagataaaaaagtcgaacccaaatcttgtgataaaacacatacatgtccaccgtgcccagcaccagaattactcggaggtccatcagtatttttattccctccaaaaccaaaagacacattaatgatatcaagaacaccagaagtaacatgtgtagtagtcgacgtatcacacgaagatccagaagtcaaatttaattggtacgtcgacggagtcgaagtacataatgcaaaaacaaaaccaagagaagaacaatataactcaacctatcgagtagtgtccgtattaacagtcttacatcaagattggctaaacggcaaagaatataaatgcaaagtctccaacaaagcactacccgccccaatagaaaaaactatatccaaagctaaaggccaacctagagaaccacaagtatatactctaccaccttcacgtgacgaacttaccaaaaaccaagtttcattaacatgcctagtaaaaggcttttacccatccgacatagcagtcgaatgggaatcaaacggacaacccgaaaataactacaaaacaactccaccagtactagattcagacggatcattctttctatactcaaaactcacagtagacaaatcacgctggcaacaaggaaacgtattctcctgctctgtaatgcatgaagcacttcataaccactacacacaaaaatcattatccctatcacccggaaaa

SEQ ID NO: 51107 - RNA, 1350 nt, synthetic construct
  misc_feature 1..1350: note = derived and/or modified sequence opt6 from anti-influenza_Chain
  source 1..1350: mol_type = other RNA
caagtacaactagttcaatcaggagccgaagtcagaaaaccaggatcatcagtaaaagtatcatgtaaagtcagcggaggcataatacgcaaatatgcaataaattgggtaagacaagcaccaggacaaggtttagaatggatgggcggcataatagcaatattcaatacagctaattatgcacaaaaattccaaggtagagtaacaatcacagcagacgaatcaacaagtactgtatacatggaactttcttcactcagatcagaagacacagccttatactactgcgcaagaggtatgaattattactcagattacttcgattactggggacagggatcactagttacagtatcaccagcatccaccaaaggcccatcagtattccccttagcaccaagctccaaatcaacatctggaggaacagcagcactaggatgtctagtaaaagactactttccagaaccagtaacagtatcatggaattcaggagcactaacatcaggcgttcacacattccctgcagtattacaatcttcaggcctatattcattatcatcagtcgtaacagtaccatcctcatcactcggaacacaaacatatatctgcaacgtaaaccacaaaccatccaacacaaaagtagacaaaaaagtagaaccaaaatcttgcgataaaacacatacttgcccaccatgtccagccccagaactactaggaggcccctcagtattcctattcccaccaaaacccaaagacactctcatgatctcacgaacacccgaagtaacatgtgtagtagtagatgtctcacacgaagacccagaagtcaaattcaactggtacgtagacggcgttgaagtacataatgccaaaacaaaaccaagagaagaacaatacaactcaacatacagagtagtatctgtattaacagtattacaccaagactggttaaacggaaaagaatacaaatgcaaagtatctaacaaagcactacccgcaccaattgaaaaaacaatatctaaagcaaaaggacaaccacgagaaccacaagtatatacactaccaccctccagagacgaactaaccaaaaatcaagtaagtttaacgtgcctagtaaaaggattctacccatccgatatagccgtagaatgggaatcaaatggacaacctgaaaataactataaaactacaccaccagtcttagactccgacggctcatttttcctctactcaaaattaacagtagacaaatcaagatggcaacaaggaaacgtattctcatgcagtgtaatgcacgaagccctacacaaccattatacacaaaaatcactctcactttcaccaggaaaa

SEQ ID NO: 51108 - RNA, 1350 nt, synthetic construct
  misc_feature 1..1350: note = derived and/or modified sequence opt6 from anti-influenza_Chain
  source 1..1350: mol_type = other RNA
gaagttcaactagtacaaagtggagcagaagtcaaaaaacccggatctagtatgaaagtaagctgcaaagcatctggatcaattttctcaaactacggaatatcatgggtaagacaagcaccaggacaaggactagaatggatgggaggaataatacccatattcggcgcagcaaactatgcacaaaaatttcaaggaagagtaacaataaccgctgatgaatccacatcaacagtatatatggaagtgagaagcctaagatcagaagacacagctgtatattactgtgctagaagacaacaactatataaaggatactatcaccactggggacaaggcacactagttacagtgagttctgcctcaacaaaaggcccatcagtctttccactagcaccctctagtaaatcaacaagtggtggaacagctgcattaggatgcttagtaaaagactacttccccgaacccgtcacagtatcttggaacagcggtgccttaacctcaggagtacacacattccctgcagtacttcaatcatcaggcttatattcactatcatcagtagtaactgtaccttcatcatcccttggaactcaaacatatatttgcaacgtaaatcacaaaccaagcaatacaaaagtagacaaaaaagtagaaccaaaatcatgtgacaaaacacacacatgcccaccatgcccagcccccgaattactaggaggaccatcagtattcctattcccaccaaaaccaaaagacacactcatgatatcaagaacacccgaagtaacatgtgtagtcgtagacgtatcccacgaagaccccgaagtaaaatttaactggtacgtagacggagtagaagtacacaatgccaaaacaaaacccagagaagaacaatacaatagtacatatcgagtagtatcagtactcacagtattacaccaagactggctaaacggcaaagaatacaaatgtaaagtatcaaataaagcattaccagcaccaatagaaaaaacaatatcaaaagcaaaaggccaaccaagagaaccccaagtatacacactacctccatcaagagaagaaatgacaaaaaaccaagtatcattaacctgcctagtgaaaggtttttacccatctgacatagccgtagaatgggaatcaaacggacaaccagaaaacaactacaaaacaacaccaccagtactagacagcgatggatcattctttttatactcaaaattaactgtagacaaatctagatggcaacaaggaaacgtattcagttgcagcgtcatgcacgaagcactccataatcactacacccaaaaatcattaagcttaagcccaggaaaa

SEQ ID NO: 51109 - RNA, 1350 nt, synthetic construct
  misc_feature 1..1350: note = derived and/or modified sequence opt6 from anti-influenza_Chain
  source 1..1350: mol_type = other RNA
caagtccaactagtgcaatctggcgcaggagttaaaaaaccaggatcatcaatgaaagtaagctgcaaagcatcaggctcaatcttctcaaactatggaatatcttgggtaagacaagcacccggacaaggattagaatggatgggcggtataatcccaatattcggagcagcaaactatgcccaaaaattccaaggaagagttacaataacagcagacgaatcaacatcaacagtatatatggaagtcagatcactaagatcagaagacaccgcagtatattactgcgcaagaagacaacaattatacaaaggatattatcaccactggggtcaaggaacattagtaacagtatcatcagcctcaactaaaggaccatccgtatttcccctagcaccctcatctaaatctacatcaggaggaacagctgcactcggttgtcttgtaaaagactattttccagaaccagtaacagtatcatggaactctggcgcattaacatcaggcgtccatacatttcctgcagtattacaatcatccggactatattcactatcaagtgttgttacagtaccatcatcttcattaggcacacaaacatacatatgtaacgtaaatcacaaaccaagcaacacaaaagtagataaaaaagttgaaccaaaatcatgcgataaaacccatacatgtcccccctgcccagcaccagaactactcggaggcccaagtgtattcctcttcccacccaaacccaaagacacactaatgatatcacgtactccagaagtaacatgtgtagtcgttgacgtatcacacgaagacccagaagtcaaatttaattggtatgtagacggtgtagaagttcacaacgcaaaaacaaaaccacgagaagaacaatacaactcaacttacagagtagtatcagtcctcacagtactccaccaagactggctaaacggaaaagaatacaaatgcaaagtatccaacaaagcattaccagcccccattgaaaaaacaatctcaaaagcaaaaggtcaaccaagagaaccacaagtatacactcttccaccatcacgggaagaaatgacaaaaaaccaggtatcactaacttgcctagtaaaaggattctatccatcagacatcgcagtagaatgggaatccaacggtcaacccgaaaacaattacaaaacaacaccaccagtcctagactcagatggatcattcttcttatattctaaactaaccgtagacaaatctagatggcaacaaggaaacgtattctcatgctctgtaatgcacgaagcactacataaccattacacacaaaaatccctctctctatcaccaggaaaa

SEQ ID NO: 51110 - RNA, 1350 nt, synthetic construct
  misc_feature 1..1350: note = derived and/or modified sequence opt6 from anti-influenza_Chain
  source 1..1350: mol_type = other RNA
caagtacaactccaacaaagcggagcagaagtaaaaaaacctggatcatctgtaaaagtttcatgcaaagtttcaggagtaatattctccggatccgcaatctcatgggtcagacaagcacctggacaaggactcgaatggatgggaggcatatccccactattcggaacaacaaattatgcacaaaaattccaaggaagggtcacaataacagcagaccaatctacaaatactacatacatggaagtaaactcattaagatacgaagataccgccgtatacttttgcgcacgtggaccaaaatactactcagaatacatggacgtctggggaaaaggaaccacagtcacagtttcctccgcctcaacaaaaggaccatccgtatttcctttagcaccatcatctaaatcaacatcaggaggcaccgcagcattaggatgtctcgtaaaagactacttcccagaacccgtaacagtatcatggaactctggagctctaacatcaggagtacatactttcccagcagtcttacaatcctcaggactctactcactaagttcagtagtaacagtaccctcatcatcattaggaacacaaacatacatatgtaacgtaaaccacaagccatccaatactaaagtagacaaaagagtagaaccaaaaagctgcgataaaactcacacatgtccaccatgtcccgccccagaactattaggaggaccatcagtattcctatttcctccaaaacccaaagatacactaatgatatcacgaactccagaagtaacctgtgtagtagttgacgtttcacacgaagacccagaagttaaattcaactggtatgtagatggagtcgaagtacataatgccaaaacaaaaccaagagaagaacaatacaattcaacatacagagtagtatccgtattaaccgtacttcaccaagattggctaaatggaaaagaatataaatgcaaagtatcaaacaaagccttacccgcacctatagaaaaaacaatatcaaaagctaaaggacaaccaagagaaccacaagtatatacactacccccttctagagaagaaatgacaaaaaaccaagtatcattaacatgtctagttaaaggattctatccctccgacatagcagtagaatgggaatcaaatggacaacccgaaaacaactacaaaacaacaccacctgtactcgactctgatggatccttcttcctatactccaaactaacagtagacaaatccagatggcaacaaggcaacgtattctcatgttcagtaatgcatgaagcattacacaaccactatacccaaaaatcactatctttatcaccaggaaaa

SEQ ID NO: 51111 - RNA, 1350 nt, synthetic construct
  misc_feature 1..1350: note = derived and/or modified sequence opt6 from anti-influenza_Chain
  source 1..1350: mol_type = other RNA
caagttcaattagtacaaagcggagcagaagtaaagaaaccaggatcatcagtcaaagtaagttgcaaagctagcggaggaacattttcatcatacgcaatatcatgggtaagacaagcaccaggacaaggattggaatggatgggaggaataatgggaatgtttggaacaacaaactacgcacaaaaatttcaaggacgagtaacaattacagcagacgaatttacatcagcagcatatatggaactgagatcattaagatctgaagatacagcagtttactattgcgcaagatcaagtggatactatcctgaatacttccaagactggggacaaggtaccctagtgacagtctcatcagcatcaactaaaggaccatcagttttccctctagcaccatcaagcaaatcaacatcaggtggaacagcagcactaggatgtctagtaaaagactacttcccagaaccagtaaccgtatcatggaatagtggtgcattaacatcaggagtccatacttttccagcagtattacaaagttcaggactatactctttaagctcagtagtcacagttcccagctcatcactagggacacaaacgtatatatgcaacgtaaaccacaaaccctcgaatactaaagtagataaaagagtagaacctaaaagttgcgacaaaacacacacatgcccaccatgcccagcacccgaactattaggaggaccaagtgtattcctcttcccaccaaaacccaaagatacattaatgatatcaagaacaccagaagtaacatgcgtagtcgtagacgtatcacacgaagaccccgaagtcaaattcaactggtacgtagacggagtagaagtacacaacgcaaaaacaaaaccccgcgaagaacaatataattccacataccgagtagtctcagtactgacagtactacatcaagattggcttaacggaaaagaatacaaatgtaaagtatcaaataaagcattaccagcaccaatagagaaaacaataagcaaagcaaaaggacaacccagagaaccacaagtatacacattaccaccatcaagggaagaaatgactaaaaaccaagtatcacttacatgcttagtaaaaggattttatccatcagatatagccgtagaatgggaatctaacggacaaccagaaaataactataaaacaacaccacccgtactagattcagatggatcattcttcttatactcaaaattaacagttgacaaatcccgatggcaacaaggaaatgtattctcatgttcagtaatgcacgaagcactacacaaccactacacacaaaaatcgttatcattaagtccaggaaaa

SEQ ID NO: 51112 - RNA, 1350 nt, synthetic construct
  misc_feature 1..1350: note = derived and/or modified sequence opt6 from anti-influenza_Chain
  source 1..1350: mol_type = other RNA
gaagtacaactcgtagaatcaggtgccgaagttaaaaaacccggatcttcagtcaaagtaagttgcaaagcttccggaggaacattcagctcatacggaataagctgggtaagacaagcaccaggacagggtcttgaatggatgggagatattataggaatgttcggatcaactaactatgcacaaaacttccaaggaagattaacaatcacagcagatgaaagtacatcaacagcatacatggaactatcctcattaagatcagaagacaccgcagtatactactgcgcgcgatctagcggttactatccagcatatttacctcactggggacaaggaacactagtaacagtatcatccgcatcaacaaaaggaccatcagtattcccattagctccatcctcaaaaagcacatcaggcggcacagccgcactaggttgtctagtaaaagactatttcccagaaccagtaacagtatcttggaactcaggtgcactcacctcaggagtacacacattccccgccgtcttacaatcatccggcctctactcactttcatcagttgtaacagtcccatccagttccctaggcacacaaacatacatatgcaacgtcaaccacaaaccatccaatactaaagttgataaaagagtagaaccaaaatcatgtgataaaacccacacatgtccaccatgcccagcaccagaattattaggaggtccatctgtattcctctttccaccaaaacccaaagacacactaatgataagtcgaaccccagaagttacatgcgtagtagtcgacgtatcacacgaagaccctgaagtaaaattcaattggtacgtagatggcgtagaagtacacaatgcaaaaactaaaccacgggaagaacaatacaattccacataccgcgtagtttcagtactaacagtcctacaccaagactggttaaacggaaaagaatataaatgcaaagtatcaaacaaagcactaccagcacccatcgaaaaaacaatatcaaaagcaaaaggccaaccacgagaaccccaagtatacacactaccaccatccagagaagaaatgactaaaaaccaagtatcactaacatgcctagttaaaggattttacccatccgacatagcagtagaatgggaatcaaatggacaaccagaaaacaactacaaaacaacacccccagtattagactccgacggatcattttttttatattcaaaactaacagtagacaaaagtagatggcaacaaggaaacgtattctcatgctcagttatgcatgaagcattacacaatcattatacacaaaaatcattatctttatcaccaggaaaa

SEQ ID NO: 51113 - RNA, 1350 nt, synthetic construct
  misc_feature 1..1350: note = derived and/or modified sequence opt6 from anti-influenza_Chain
  source 1..1350: mol_type = other RNA
gaagtacaactcgtagaaagcggagcagaagtaaaaaaacccggttcatctgttaaagtatcatgcaaagcctccggaggaacattcagctcctacgccatatcatgggtaagacaagcaccaggccaaggtttagaatggatgggtggaataataggcatgttcggaaccgcaaactacgctcaaaaattccaaggccgagtaaccataaccgcagatgaattcacaagcacagcctatatggaattatcatctctaagatcagaagacactgccgtctattactgtgcaagaggaaactattactacgaatcttcactagactattggggccaaggaaccttagtaacagtaagcagcgcttcaacaaaaggaccatcagtatttccactagcaccctcctctaaatccacatcaggaggaactgcagcattaggatgtttagttaaagattatttcccagaaccagttacagttagctggaactccggagcactaacttcaggagtacacaccttcccagcagtactacaatcatcaggcctatactcactttcttctgtcgtcacagtaccctcatcctcattaggcactcaaacctatatctgcaacgtgaatcataaaccatctaatactaaagtagataaaagagtagaaccaaaatcatgcgataaaacacacacatgtccaccatgccctgcaccagagttattaggaggaccatcagtattcctattcccaccaaaaccaaaagacacactaatgatatcacgaacaccagaagtcacttgtgtagtagtagacgtttcacacgaagatccagaagtaaaattcaattggtacgtcgacggagtagaagtacataacgcaaaaaccaaaccaagagaagaacaatataactctacataccgagtcgtttcagtacttacagtattacaccaagactggcttaacgggaaagaatacaaatgcaaagtatctaacaaagcattaccagcaccaatagaaaaaacaatatcaaaagctaaaggacaaccaagagaacctcaagtatacacattacctccatcaagagaagaaatgacaaaaaaccaagtctcattaacttgcctagtaaaaggattttacccatcagacatagcagtagaatgggaatcaaacggtcaaccagaaaacaactacaaaacaacaccaccagtactagactccgacggatcatttttcctatactcaaaactaacagtcgacaaatcacgatggcaacaaggcaatgtattttcatgctcagtaatgcacgaagctctccacaaccactacacacaaaaatcactatcattatcaccaggtaaa

SEQ ID NO: 51114 - RNA, 1353 nt, synthetic construct
  misc_feature 1..1353: note = derived and/or modified sequence opt6 from anti-influenza_Chain
  source 1..1353: mol_type = other RNA
gaagtacaattagtagaatctggagcagaagtaaaaaaaccaggatcatcagtaaaagtatcatgcaaagcatcaggaggtccattcagatcatacgcaatatcatgggtaaggcaagcaccaggacaaggaccagaatggatgggaggaataatcccaatattcggaacaacaaaatacgccccaaaattccaaggacgagtaacaataacagcagatgactttgcaggtacagtatatatggaattatcatctttaagatcagaagatacagcaatgtattactgtgccaaacatatgggatatcaagtaagagaaacaatggacgtgtggggaaaaggcaccacagtcacagtatcaagcgcaagtaccaaaggcccatcagtatttccactagcaccatcatctaaatctacatctggaggaacagccgcattaggatgtctagtaaaagactattttcctgaacccgttacagtatcctggaactccggtgcactaacatctggagtacataccttcccagcagtactacaaagctcaggactttatagtttaagttcagtagtaacagtaccatcatcttctttaggaactcagacctatatatgcaacgtcaaccataaaccttcaaatacaaaagtcgataaaagagtcgaaccaaaaagttgtgacaaaacacacacatgcccaccatgccccgcacctgaactacttggaggtccaagcgtattcctcttcccacctaaaccaaaagatacacttatgatatccagaacacctgaagtaacatgtgtagtagtagacgtatcacatgaagatccagaagtaaaattcaattggtacgtagatggcgtcgaagttcacaatgcaaaaactaaaccaagagaagaacaatataattcaacatatagagttgtctcagtattaacagtacttcaccaagactggttaaacggaaaagaatataaatgcaaagtttcaaataaagcattaccagcacccatagaaaaaacaatcagcaaagctaaaggacaaccacgagaaccacaagtatacacactaccaccatccagggaagaaatgacaaaaaaccaagtctcactcacatgcctagtaaaaggattttatccctcagatatcgcagtcgaatgggaatcaaatggacaacccgaaaacaattataaaacaacccccccagttctagactcagatggatcattttttctatacagtaaattaacagtagacaaaagccgatggcaacaaggaaacgtattttcatgctcagtcatgcatgaagcactacataatcactatacacaaaaatcattaagtttatcaccaggaaaa

SEQ ID NO: 51115 - RNA, 1353 nt, synthetic construct
  misc_feature 1..1353: note = derived and/or modified sequence opt6 from anti-influenza_Chain
  source 1..1353: mol_type = other RNA
caagtacaactcgtacaatcaggagccgaagtaaaaaaaccaggctcctcagtaaaagtatcctgcaaagcatctggaggaccattcagatcctatgcaatatcctgggtaagacaagcacctggacaaggaccagaatggatgggcggaataatacccatattcggaactaccaaatatgcaccaaaattccaaggaagagtaacaataacagcagacgacttcgccggaaccgtatacatggaactatctagtctaagatcagaagacaccgcaatgtactactgtgcaaaacatatgggctaccaagtaagagaaacaatggacgtatggggaaaaggaacaacagtaacagtatcaagtgcatcaacaaaaggaccatcagtattcccactagcaccctcaagtaaatctacatcaggcggaacagcagctctaggatgtttagtaaaagactactttccagaaccagtaacagtatcatggaactcaggcgcactaacaagcggtgttcacacatttccagcagtactacaatcctccggattatatagcctctcctcagtagttaccgtaccatcatcatcactaggaacacaaacttatatatgcaacgtaaaccataaaccatccaacacaaaagtagacaaaagagtcgaacccaaatcatgcgacaaaactcacacctgcccaccctgcccagcaccagaactactcggaggtccatcagtattcttattcccaccaaaacccaaagacacactaatgatatccagaacacctgaagtcacatgcgtagtagtagacgtatcacatgaagatccagaagtaaaatttaattggtacgtagatggcgtagaagtacacaacgcaaaaacaaaaccaagagaagaacaatacaactcaacatacagagtcgtatctgttcttaccgtactacaccaagactggttaaacggcaaagaatataaatgcaaagtatcaaacaaagcactacccgcaccaatcgaaaaaacaatatcaaaagccaaaggacaaccacgagaaccacaagtatacacattgccaccctcccgagaagaaatgacaaaaaaccaagtttccttaacctgtctagtaaaaggattctacccttcagacatagcagttgaatgggaatctaacggacaaccagaaaacaattataaaaccaccccaccagtattagactcagatggaagctttttcctatattcaaaactaacagtcgacaaatcccgatggcaacaaggaaacgtctttagctgctcagtaatgcatgaagcattacacaatcactacacacaaaaatctctctcattatctccaggaaaa

SEQ ID NO: 51116 - RNA, 1353 nt, synthetic construct
  misc_feature 1..1353: note = derived and/or modified sequence opt6 from anti-influenza_Chain
  source 1..1353: mol_type = other RNA
gaagttcaacttgtagaaagcggtgcagaagtcaagaaaccaggttcttcagtaaaagtctcatgtaaagctagcggaggcacatttagcttttattcaatgtcttgggtaagacaagcaccaggacaaggactagaatggatgggcggaataatcccaatgtttggtactacaaattatgctcaaaaattccaaggtcgagtaacaataacagctgtagaaagcacttcaaccgcatatatggaagtaagcagcttaagatcagaagatacagcagtatattattgcgccagaggagataaaggaatttattactattatatggatgtatggggaaaaggtacaacagtcacagtctctagtgcatcaacaaaaggaccatctgtcttcccattagcaccaagttcaaaatcaacatcaggaggaaccgctgcactaggctgccttgttaaagattacttcccagaaccagtaaccgtttcatggaactcaggagcactaacaagtggggtacatacatttccagcagtattacaatcatcaggactatattcattaagctctgtcgtaacagttccatcatcatcattaggcactcaaacatatatttgtaacgtaaaccataaaccatcaaatacaaaagtagataaaagagtagaacccaaaagctgtgacaaaacacacacatgtcctccatgtccagcaccagaactacttggaggaccatctgtattcttattcccaccaaaaccaaaagacacactaatgatatcaagaactcccgaagtcacatgcgtagtagtagatgtaagccatgaagatcccgaagtaaaattcaattggtacgtagacggagtcgaagtacacaatgcaaaaaccaaaccaagagaagaacaatacaactcaacatatcgagtcgtctcagttcttacagtattacatcaagattggctaaatggaaaagaatacaaatgtaaagtatcaaacaaagcactaccagctcccatagagaaaacaatatcaaaagcaaaaggacaaccaagagaaccacaagtttacacattaccaccatctagagaagaaatgactaaaaaccaagtatcactaacatgtttagtcaaaggcttctacccatcagatatagctgtagaatgggaatcaaatggacaaccagaaaacaattataaaacaacaccacccgtactagattcagacggcagcttctttttatattctaaattaacagtagacaaatcaagatggcaacaaggaaatgtattttcatgctcagtaatgcacgaagccctccacaatcactacacacaaaaatcactatcactcagtccaggaaaa

SEQ ID NO: 51117 - RNA, 1353 nt, synthetic construct
  misc_feature 1..1353: note = derived and/or modified sequence opt6 from anti-influenza_Chain
  source 1..1353: mol_type = other RNA
gaagtacaattagtcgaaagcggcgctgaagtaaaaaaacccggatcatcagtaaaagtatcatgtaaagcttcaggaggcccattcagaagttacgcaatatcttgggttagacaagcaccaggtcaaggaccagaatggatgggtggaataataccaatattcggaacaactaaatatgctccaaaatttcaaggtagagttacaataacagctgacgactttgcaggaaccgtttacatggaattatccagcctaagatcagaagacacagcaatgtactattgtgcaaaacacatgggatatcaagtaagagaaacaatggacgtatggggaaaaggcaccacagtaacagtatcttctgcaagcacaaaaggaccaagcgtatttccactagcaccatcttcaaaatcaacatcaggaggaacagcagcattaggttgcctagtaaaagattacttcccagaaccagttacagtttcgtggaactcaggagcactaactagtggagtacacacgtttccagcagttttacaatcaagtggactatacagtctttcctcagtagtaacagtaccctcctcatcattaggaacacaaacatacatatgcaacgtaaaccataaaccaagcaacacaaaagtcgataaaagagtcgaaccaaaaagctgcgacaaaacccatacatgtcccccatgcccagccccagaattactaggaggaccatcagtgttcttattcccaccaaaaccaaaagacacactaatgatatcacgaactccagaagtaacatgcgtagtagtagacgtatcccatgaagaccccgaagtaaaatttaactggtatgtcgacggagtagaagtacacaatgcaaaaactaaacccagagaagaacaatataactctacatatcgagtagtatcagtcctaacagtattacaccaagactggctaaacggaaaagaatacaaatgcaaggtaagtaataaagcattaccagcaccaatagaaaaaacaataagcaaagcaaaaggccaaccaagagaaccacaagtatatacactaccaccttcaagagaagaaatgactaaaaaccaagtaagcctaacatgcctagtaaaaggattttatccaagtgatatagcagtagaatgggaatcaaatggacaaccagaaaataactacaaaacaacacctccagtcttagactcagacggatcctttttcttatactcaaaactaaccgtagataaatccagatggcaacaaggaaatgtgttctcatgctcagtaatgcacgaagcactacacaaccactacacccaaaaatccctttcactatctcctggaaaa

SEQ ID NO: 51118 - RNA, 1353 nt, synthetic construct
  misc_feature 1..1353: note = derived and/or modified sequence opt6 from anti-influenza_Chain
  source 1..1353: mol_type = other RNA
caagtacaattagtacaatccggagcagaagtgaagaaaccaggatctagcgtaaaagtatcatgcaaagctagtggtggaccttttagatcatatgcaataagctgggtacgacaagctccaggacaaggcccagaatggatgggaggaataataccaatattcggtacaacaaaatatgcaccaaaatttcaaggacgcgttacaataacagcagatgatttcgcaggaacagtatacatggaactatcttcactacgctccgaagacacagcaatgtattactgtgcaaaacatatgggatatcaagtaagagaaacaatggacgtttggggaaaaggcacaacagtcacagtaagtagcgccagcactaaaggtccctcagtatttccacttgcaccttcatcaaaatcaacatcaggaggaacagcagcgctaggatgtctagtcaaagattactttccagaacccgtcacagtatcatggaactcaggagcactaacatcaggagtacatacattcccagctgtattacaatcttcgggcctctattcactatcatcagtagtaacagtaccatcctcctccttaggtacacaaacatacatatgcaatgtaaatcataaaccttcaaataccaaagtagataaaagagtagaaccaaaatcatgtgacaaaactcatacatgtcccccttgcccagcaccagaattattaggcggcccatcagtatttcttttcccaccaaaacccaaagatactctaatgatatctagaacccccgaagtaacatgcgtagtagttgacgtatcccatgaagacccagaagtaaaattcaattggtatgtagatggagtagaagtgcacaatgccaaaaccaaaccaagagaagaacaatacaactcaacatatagagtagtatcagtattaacagtactacatcaagattggctaaacggaaaagaatacaaatgtaaagtatcaaacaaagcactcccagcaccaatagagaaaaccatatccaaagcaaaaggacaaccaagagaaccccaagtatacacactaccaccatcaagagaagaaatgactaaaaaccaagtctcattaacatgcttagtaaaaggtttctacccctcagatattgctgtagaatgggaatctaatggccaacccgaaaacaactacaaaacaacacctcccgtattagattctgacggatccttctttttatattcaaaattaacagtagacaaatcaagatggcaacaaggtaacgtattttcatgttcagtaatgcatgaagcacttcacaatcactacacacaaaaatcactctcactatccccaggaaaa

SEQ ID NO: 51119 - RNA, 1353 nt, synthetic construct
  misc_feature 1..1353: note = derived and/or modified sequence opt6 from anti-influenza_Chain
  source 1..1353: mol_type = other RNA
gaagtacaactcgtagaatccggcgcagaagtcaaaaaacctggttcaagcgtaaaagtatcatgtaaagcatctggaggaacattctcattctattcaatgtcatgggtaagacaagcaccaggacaaggactagaatggatgggcggaatcataccaatgttcggaaccacaaactatgcacaaaaattccaaggaagagtaacaataacagcagttgaaagtacatcaacagcatacatggaagtatcttcattacgaagtgaagatacagcagtatattattgtgcaagaggagacaaaggaatatattattattacatggacgtttggggaaaaggaactacagtcacagtttcatcagcaagcactaaaggtccctctgtatttccattagcaccaagctcaaaatccacctcaggaggcacagcagctttaggctgcttagttaaagactactttcctgaaccagtaacagtatcctggaattcaggagcactaacctctggagtccataccttcccagcagtccttcaatcatccggattatactctttaagctcagtagtcacagtaccatcatcatctctaggcactcaaacatacatatgcaacgtcaaccacaaaccatcaaacacaaaagtagacaaaagagtagaacccaaatcatgcgacaaaacacacacatgcccaccatgcccagcaccagaattactaggcggaccatctgtattcttatttccaccaaaaccaaaagacacactcatgatatctagaacaccagaagtaacatgcgtagtagtcgacgtatcccatgaagatccagaagtcaaattcaattggtatgtagacggagtagaagtacacaatgcaaaaacaaaaccaagagaagaacaatataactcaacatacagagtagtatcagtactaacagtactacaccaagattggctaaacggaaaagaatacaaatgcaaagtatcaaacaaagcattaccagctccaatagaaaaaaccatatcaaaagcaaaaggacaaccaagagaacctcaagtatacacactcccaccatcaagagaagaaatgacaaaaaatcaagtatcactaacatgcctagtaaaaggattctacccatcagatattgcagttgaatgggaatcaaacggacaaccagaaaataattacaaaacaacaccacccgtactagactctgacggaagctttttcctatactcaaaactaacagttgataaaagtagatggcaacaaggaaatgtattttcatgcagtgtcatgcacgaagctctacacaatcattacacacaaaagtcattaagcctatcaccaggcaaa

SEQ ID NO: 51120 - RNA, 1356 nt, synthetic construct
  misc_feature 1..1356: note = derived and/or modified sequence opt6 from anti-influenza_Chain
  source 1..1356: mol_type = other RNA
caagtccaattggttcaatcaggcggaggattagtaaaacctggaggatcactaagactatcctgtgccgcatctggattcacattttcatcatattcaatgaattgggtaagacaagcacccggcaaaggtcttgaatgggtatcctcaatctcctcatcctcttcatatatctattatgtagactcagtaaaaggtcggttcacaatttcaagagacaatgccaaaaatagcctatacctacaaatgaatagtctaagagcagaagacacagcagtttactattgcgcaagaggtggaggttcatatggagcatacgaaggattcgactattggggccaaggtacattagtaacagtctcctcagcaagcacaaaaggaccatcagtattcccactagccccatcctcaaaatccacatcaggcggaacggctgcattaggatgcctagtaaaagattactttccagaaccagtaaccgtatcatggaactctggagctctaacatcaggtgtccatacttttccagcagtcttacaatcatcaggactatattcattatcatcggtcgtaacagtaccatcctcatcactaggcacacaaacatatatatgcaacgtaaaccacaaaccatcaaatacaaaagtagataaaagagtagaacctaaatcatgcgacaaaacccatacatgcccaccttgcccagccccagaattactaggcggtccatcagtttttctatttccaccaaaaccaaaagacacactaatgatatctagaacccccgaagtaacatgtgtagtagtagatgtatcacatgaagatccagaagtaaaatttaattggtatgtagatggagttgaagtacacaacgcaaagacaaaaccaagagaagaacaatataactccacatacagagtagtatcagtcttaacagtactacatcaagattggttaaatggtaaagaatacaaatgtaaagtatctaacaaagcattaccagcaccaatagagaaaacaatatcaaaagctaaaggtcaaccaagagaaccacaagtatacacactaccaccatctagagaagaaatgaccaaaaaccaagtatcacttacatgtctagtaaaaggattttatccaagtgatatagcagttgaatgggaatctaacggacaaccagaaaacaactataaaaccacaccaccagtacttgactcagatggatcgttctttttatattcaaaattaacagtcgacaaatcacgatggcagcaaggaaacgtattttcatgctcagtcatgcatgaagccctacacaatcactacacacaaaaatccctatcactcagtcccggaaaa

SEQ ID NO: 51121 - RNA, 1356 nt, synthetic construct
  misc_feature 1..1356: note = derived and/or modified sequence opt6 from anti-influenza_Chain
  source 1..1356: mol_type = other RNA
caagtacaattagtacagtcaggagcagaagtaaaacaaccaggagcttctgtaaaagtctcatgcaaagcatcaggatatacatttaacgcctattacatacactgggtcagacaagcaccaggccaaggactcgaatggatgggatggataaatccaaatttcggaggcacacactacgcaagaaaattccaaggtcgagttacaatgacaagagatgcttcaattaatacagcatacatggaactagaccgattaatatcagacgatacagcagtctattactgcgtaagatggagggcagcagcagtaatcatggaccaattctacaaaatggatgtctggggacaaggtaccttagttaccgtatcctcagcatcaacaaaaggaccctccgtattcccattagcaccatgttcaagatcaacatctgaatctacagcagcacttggatgcctcgtaaaagactattttccagaacctgtaactgtctcctggaactcaggtgcactaacttccggcgtacacacattcccagcagtactacaatcatcaggactatactcactatcatcagtcgtaacagtaccctcaagtagtcttggaacaaaaacatacacctgtaacgtagaccacaaaccaagcaacactaaagtagacaaaacaagagaatcaaaatatggaccaccttgtccatcatgcccagcacctgaattcttaggaggcccatctgtatttttatttccaccaaaacccaaagacacactaatgatctcaagaacaccagaagtcacatgcgtcgtagtcgacgtatcccaagaagacccagaagttcaatttaattggtacgtagacggagtagaagtacacaacgcaaaaacaaaacctagagaagaacaattcaactcaacatatcgagtagtatccgtactaacagtattacaccaagactggctaaatggtaaagaatacaaatgcaaagtatctaataaaggattaccatcctcaatagaaaaaacaatctcaaaagctaaaggacaaccaagagaaccacaagtatatactttacctccagcacaagaagaaatgaccaaaaaccaagtatcattaacttgcctagtaaaaggtttttacccatcagacatagctgtagaatgggaaagcaatggtcaaccagaaaataactacaaaaccacaccaccagtactagattccgatggatcatttttcctatattcaagattaacagtagacaaatcaagatggcaagaaggtaatgttttctcatgctcagtcatgcatgaagcactacataaccactacacacaaaaatccctatcactatcactcggaaaa

SEQ ID NO: 51122 - RNA, 1356 nt, synthetic construct
  misc_feature 1..1356: note = derived and/or modified sequence opt6 from anti-influenza_Chain
  source 1..1356: mol_type = other RNA
gaagtccaactagtacaatcaggagcagaagtaaaaaaaccaggagcatcagtaaaagtcagttgtaaagcttcaggatacatattcactggctattatatacactgggtacgacaagccccaggccaaggactagaatggatgggtcgcatagacccaaatggtgcaggaacaacatatgcacaaaaatttcaaggaagagtaacattaaccatggacactagtataacaacagcctacatggaactatcaagactaagattcgacgatacagcaatctattattgtgctcgttgggattggaacttcgatttatacctaggctggttcgacccatggggacaaggaacaccagtaactgtagcatcagcatcaacaaaaggaccatcagtctttccattagcaccttcatcaaaatctacatcaggaggaacagcagcgctaggctgtctagtaaaagattactttcctgaaccagtaacagtatcatggaattcaggagcactaacatcaggtgtacacacatttccagcagtattacaatcatcaggtctatattcattatcctcagtagtaacagttccgtcttcatctctaggcacccaaacttatatatgtaacgtaaaccacaaaccatcaaatacaaaagtagataaaaaagtagaaccaaaatcctgtgataaaacacatacatgtccaccttgcgcacccgaacttcttggaggaccctcagtcttcttatttccaccaaaacctaaagatacacttatgattagtagaacacctgaagtaacatgtgtcgtagttgacgtaagtcatgaagatcctgaagtaaaatttaattggtacgtagacggagtagaagtacacaacgcaaaaaccaaaccccgtgaagaacaatataattcaacatacagagtagtatcagtccttacagtactacaccaagattggttaaacggaaaagaatataaatgtaaagtatcaaataaagccctcccagcaccaatagaaaaaacaatcagtaaagcgaaaggccaacctcgagaaccacaagtttatacactacctccctcacgtgaagaaatgacaaaaaaccaagtttcactaacatgtcttgtaaaaggattttatccttcagatatagcagttgaatgggaatcaaatggacaaccagaaaataactataaaacaacaccaccagtactagatagcgatggttccttttttttatactccaaattaacagtagataaatcaagatggcaacaaggtaacgtattttcttgttcagtaatgcacgaagctttacataaccactacactcaaaaatcattatcattatcacctggtaaa

SEQ ID NO: 51123 - RNA, 1356 nt, synthetic construct
  misc_feature 1..1356: note = derived and/or modified sequence opt6 from anti-influenza_Chain
  source 1..1356: mol_type = other RNA
caagtacaactagtacaatcaggagccgaagttaaacaaccaggagcctcagtaaaagtatcatgtaaagccagtggttacacttttaatgcatattatatacactgggtcagacaagctccaggacaaggcttggaatggatgggatggataaatccaaactttggtggaactcactatgcaagaaaatttcaaggaagagtcacaatgacacgcgatgcatcaataaatacagcctatatggaactagacagactaatatctgacgatacagcagtatattattgcgtccgctggagagcagcagcagtaataatggaccaattctacaaaatggatgtatggggacaaggaacactagtaacagtatcctctgcatcaaccaaaggtccatcagtctttccactcgcaccatgctctagatccacaagcgaatccacagcagccttaggatgtctagtaaaagattactttccagaaccagtcacagtctcatggaactccggagcactcacttcaggagtgcataccttcccagcagtactacaatcatcaggactatattctctatcttcagtagttacagtcccctcttcatctctaggtaccaaaacatatacttgtaacgtagatcataaaccttcaaatacaaaagtagataaaactagagaatcaaaatacggaccaccatgcccatcttgtccagcaccagaattcttaggaggtccatccgtatttctatttccaccaaaaccaaaagatacattaatgatatcaagaacacctgaagtaacctgtgtagtcgtcgatgtatcacaagaagaccccgaagtccaatttaattggtatgtagatggagtagaagtccataacgcaaaaacaaaacctagagaagaacaattcaactcaacctacagagtagtatcagtattaacagtactacatcaagactggctcaatggtaaagaatataaatgtaaagtatctaacaaaggcctcccctcatcgatcgaaaaaacaatatcaaaagcaaaaggacaaccacgagaaccacaagtatatacattaccacccgcacaagaagaaatgactaaaaatcaagtttcactaacatgtcttgtcaaaggcttttatccatctgacatagcagttgaatgggaatcaaacggacaaccagaaaataactataaaactacacctccagtattagattcagatggaagtttttttttatattcaagattaacagtagataaatccagatggcaagaaggaaatgtattctcatgctcagtaatgcatgaagctctacataaccattatacacaaaaatctctatcattatcacttggaaaa

SEQ ID NO: 51124 - RNA, 1356 nt, synthetic construct
  misc_feature 1..1356: note = derived and/or modified sequence opt6 from anti-influenza_Chain
  source 1..1356: mol_type = other RNA
caagtccaattagtccaatcaggaggaggattagtaaaacctggtggatcattaagattatcctgcgcagcatctggctttacattctcatcatactcaatgaattgggttagacaagcaccaggcaaaggactagaatgggtatcatcaatatcatcatcatcatcatacatatattacgtagactccgtaaaaggaagattcactatatcaagagacaatgcaaaaaattcactatacctacaaatgaattccttaagagcagaagatacagcagtatactactgcgccagaggaggaggatcttatggtgcatacgaaggatttgactactggggtcaaggaacattagttacagtctcatcagcctcaacaaaaggaccctctgtattcccactagctccatcctcaaaatcaacctcaggaggaacagcagcacttggatgcctagtaaaagactacttccctgaaccagtcacagtatcatggaactcaggagcactaacttccggagtacacacattcccagcagtattacaatcatcaggactatactctctatcatcagtagtaacagtcccaagctcatcactaggcacccaaacatacatatgtaatgtcaaccacaaaccctcaaacacaaaagtagacaaaagagtcgaacctaaaagctgcgataaaacacacacatgtccaccctgtccagcaccagaattactaggaggaccctccgtttttctgtttccaccaaaaccaaaagacacccttatgatatcaagaactccagaagtaacttgcgtagtagtagacgtaagccatgaagatccagaagtaaaattcaattggtacgtagacggtgttgaagtacacaacgctaaaacaaaaccaagagaagaacaatacaattcaacttatagagtagtatcagtgttaacagtactacaccaagattggctcaatggtaaagaatacaaatgtaaagtatcaaacaaagcattaccagcaccaatagaaaaaacaatatcaaaagcaaaaggacaaccccgagaaccacaagtatacaccctacccccatctagagaagaaatgacaaaaaaccaagtctcactaacatgtctagtaaaaggcttttacccatccgacatagccgtcgaatgggaatcaaatggacaaccagaaaacaattataaaacaaccccacctgtcttagattcagacggatccttcttcttatacagcaaactaacagtcgataaatcaagatggcaacaaggcaatgtcttttcctgctcagtaatgcatgaagcattacacaaccattacacacaaaaatctttaagcctatcaccaggaaaa

SEQ ID NO: 51125 - RNA, 1356 nt, synthetic construct
  misc_feature 1..1356: note = derived and/or modified sequence opt6 from anti-influenza_Chain
  source 1..1356: mol_type = other RNA
gaagtacaattagtacaatcaggagcagaagtaaaaaaaccaggtgcaagcgttaaagtttcatgtaaagccagtggatatatatttacaggatattacatacactgggtaagacaagccccaggtcaaggattagagtggatgggaagaatagatccaaatggcgcaggaacaacatacgcccaaaaatttcaaggaagggtaacacttacaatggatacatctatcacaaccgcctatatggaattatcaagactacgatttgatgacacagcaatatattactgtgctagatgggattggaatttcgatttatatttaggttggtttgatccatggggacaaggaactccagtaacagtagcatcagcatcaaccaaaggtccatccgtatttccattagcaccatcaagcaaaagtacatccggaggcacagctgcattaggatgcctagtcaaagattactttccagaaccagtaacagtatcatggaattcaggagcattaacatcaggagtacatacatttccagctgtactacaatcaagcggcctatactcattatcatccgtagtaacagtacccagcagtagtctaggaacacaaacctatatatgtaacgtcaaccacaaaccctcaaataccaaagtagacaaaaaagtagaaccgaaatcatgtgacaaaactcatacatgtccaccatgcgcaccagaactcttaggaggcccatctgtctttttattcccgccaaaaccaaaagataccttaatgatttctagaacaccagaagttacatgtgtagtagtagatgtatcacatgaagacccagaagttaaatttaattggtatgtagatggagtagaagtacataatgcaaaaacaaaaccaagagaagaacaatacaacagcacatacagagtcgtttcagtactaactgtattacaccaagattggctaaatggaaaagaatacaaatgtaaagtatccaataaagcattaccagcaccaatagaaaaaactatatccaaagcaaaaggacaaccaagagaaccacaagtatacaccttaccaccgtcaagagaagaaatgacaaaaaatcaagtttcattaacatgtttagtaaaaggcttctatccatctgacatagcagtagaatgggagtctaacggacaaccagaaaataactataaaactacaccacccgttcttgattcagatggaagtttcttcctatattcaaaattaacagtagataaatcaagatggcaacaaggaaatgtcttttcatgctcagtaatgcatgaagcactacacaatcactacacacaaaaatctctaagcctttctccaggcaaa

SEQ ID NO: 51126 - RNA, 1359 nt, synthetic construct
  misc_feature 1..1359: note = derived and/or modified sequence opt6 from anti-influenza_Chain
  source 1..1359: mol_type = other RNA
caagtacaactcgtccaatcaggagcagaagtaaaaaaaccaggctcatcagtccgagtatcttgcaaagctagcggatcaatattccgaaactatgcaatgtcctgggtaagacaagctcccggacaaggactagaatggatgggaggtatcatcgcaatattcggaacaccaaaatacgcacaaaaattccaaggaagagttacaataaccgcagatgaatcaacatccaccgtatacatggaattatccggccttaggtcagaagatacagcaatgtactactgcgcacgaataccacactacaatttcggttccggctcatatttcgactactggggccaaggaactctagttactgtatcttcagcatctacaaaaggacccagcgtattccctctagcaccatcctcaaaatcaacctccggaggaacagcagcattaggctgtttagtcaaagattacttcccagaacccgtaaccgtatcatggaattcaggagcactaacctccggagtacacacatttcccgcagtcctacaatcatcaggactatactcattatcatcagtagtcactgtaccatcttcatctctaggaacacaaacatacatatgcaacgtaaatcataaaccttccaacacaaaagtagacaaacgagtcgaaccaaaatcatgtgacaaaacgcatacatgcccaccttgcccggcaccagaattattaggcggaccatcagtattcttatttccaccaaaaccaaaagatacactaatgatatctagaacacccgaagtaacatgcgtcgtagtagacgtctcacatgaagacccagaagtaaaatttaactggtatgtagatggagtagaagtccacaacgcaaaaacaaaaccaagagaagaacaatataattcaacataccgagtagtctccgtactaaccgtattacaccaagactggctaaacggaaaagaatacaaatgcaaagtatcaaacaaagcattaccagccccaatcgaaaaaacaatatccaaagcaaaaggacaaccccgggaaccacaagtatatacactaccaccttcacgtgaagaaatgacaaaaaaccaagtatcactcacttgccttgtaaaaggcttttatccatcagacatcgccgtagaatgggaatcaaacggccaacctgaaaacaactacaaaaccacaccacctgtactagactcagacggatccttttttttatactctaaattaacagtcgacaaatcacgatggcaacaaggaaacgtattctcttgttcagtaatgcacgaagcacttcacaaccattatacacaaaaatcactaagcttatctccaggtaaa

SEQ ID NO: 51127 - RNA, 1359 nt, synthetic construct
  misc_feature 1..1359: note = derived and/or modified sequence opt6 from anti-influenza_Chain
  source 1..1359: mol_type = other RNA
caagtacaactagtccaatcaggagccgaagtaaaaaaaccaggagcatccgtaaaagtaagctgcaaagcctccggctacatatttacaggctactacatacactgggttagacaagcaccaggacaaggtctagaatggatgggcagaatagaccctaacggaagcggtacaacttatgctcaaaaatttcaaggaagagtaaccttaacaatggatacttcaatcacaacagcctatatggaattatcaagactacgatttgacgatacagcaatatactactgcgcaagatgggactggaattttgacctatacctaggatggttcgacccatggggacaaggaaccccagtaacagtggcatcagcctctacaaaaggaccttcagtatttcccttagcaccatcatctaaatctacatcaggaggaacagcagcattaggatgtctagttaaagattactttccagaaccagtaacagtatcatggaactcaggagcactaacatctggagtacacacattcccagctgtactacaatcttctggactctacagcctatcaagtgtagtaaccgtaccatcatcatcactaggaactcaaacttatatatgcaacgtaaatcacaaaccatccaacacaaaagtagacaaaaaagtcgaaccaaaatcatgcgacaagacccatacttgccccccatgccctgcaccagaactattaggaggaccatcagtattcttattccctccaaaaccaaaagacacattaatgatatcaagaacccctgaagttacatgtgtagtagtagacgtatcacacgaagacccagaagtaaaattcaactggtacgtagacggagtagaagtacacaatgcaaaaacaaaaccaagagaagaacaatataattcaacataccgtgtagtctcagtactaacagtactacaccaagattggttaaatggaaaagaatacaaatgtaaagtatctaataaagcattaccagcacctatagaaaaaacaatatccaaagccaaaggacaaccaagagaaccacaagtatacacattaccaccatctagagaagaaatgacaaaaaaccaagtcagcctaacatgcctagtaaaaggattctacccatcagatatagccgtagaatgggaatctaacggccaaccagaaaacaactataaaaccacacctccagtactagattcagacggatcattctttctatactcaaaattaactgtagacaaaagcagatggcaacaaggcaacgttttctcctgctcagtaatgcacgaagcactacacaatcattatacacaaaaatcactctcattatcaccaggaaaa

SEQ ID NO: 51128 - RNA, 1359 nt, synthetic construct
  misc_feature 1..1359: note = derived and/or modified sequence opt6 from anti-influenza_Chain
  source 1..1359: mol_type = other RNA
gaagtacaacttgtccaatcaggagcagaagtaaaaaaaccaggagcatcagtaaaagtaagttgcaaagcatccggctacatattcactggatactacatacactgggtaagacaagcaccaggccaaggactagaatggatgggaagaatagacccaaatggcgctggaacaacttacgcacaaaaattccaaggacgagtaacattaactatggacacatctatcacaactgcatacatggaattatccagacttagattcgacgacacagcaatatattactgtgcccgatgggattggaacttcgatttatacctcggatggttcgacccatggggacaaggaaccccagtcacagtagcatcagcctccacaaaaggcccatcagtatttcccctagcaccatcatctaaatcaacatccggcggcacagcagcattaggatgcctagtaaaagactacttcccagaaccagtaaccgtatcttggaactccggagcactaacttccggagtacatacttttccagcagtattacaatcctcaggactatattcattatcctccgtagtaaccgtaccatcatcatcactcggtacacaaacttatatatgtaacgtaaaccacaaaccatcaaatacaaaagtcgataaaaaagtagaacccaaatcatgtgataaaacacatacatgtccaccgtgtcccgcacctgaacttctaggaggaccatccgtatttctatttccacctaaaccaaaagacactttaatgatatcaagaacacccgaagtaacatgcgtagtcgtagatgtatcacacgaagacccagaagtaaaattcaattggtatgtcgatggcgtagaagtccataatgccaaaactaaaccaagagaggaacaatacaactcaacatatagagtagtatcagtcttaacagtactccaccaagactggctcaacggaaaagaatataaatgcaaagtcagcaacaaagcactcccagcacctatagaaaaaacaatatcaaaagccaaaggacaaccacgagaacctcaagtatatacacttcccccatcaagagaagaaatgacaaaaaaccaggtttccctcacatgcctagtcaaaggattctatccttcagatatagcagttgaatgggaatcaaacggtcaacctgaaaacaattacaaaaccacaccaccagtactagattcagatggatccttcttcctctactctaaattaacagtagacaaatcaagatggcaacaaggcaacgtattctcatgctcagtaatgcatgaagcactacacaatcattatacccaaaaatctctatcactctcaccaggaaaa

SEQ ID NO: 51129 - RNA, 1359 nt, synthetic construct
  misc_feature 1..1359: note = derived and/or modified sequence opt6 from anti-influenza_Chain
  source 1..1359: mol_type = other RNA
caagtacaacttgtccaatcaggtgccgaagtaaaaaaaccaggcgcatcagtaaaagtaagttgtaaagcatctggatacaccttcaatgcacatcacatgcactgggtcagacaagcaccaggacaaggtctaggatggatgggatggatagacccaaacaacgacggaacaatatatgcccaaaaattccaaggaagagtaacactaacaatggacacatcaatacatacagcatatatggaactatcaggattacgctatgatgacacagcaatatactactgtgtacgatgggcatggaacttcgatttcttcctaggttggttcgacccctggggacaaggtaccctagtaacagtagcatccgcttctactaaaggaccatcagtattcccattagcaccatcttcaaaaagtacatctggaggcacagcagctctcggatgcctagtcaaagactacttccctgaacccgtaaccgtatcatggaactcaggggcactaacatcaggtgtacatacatttccagcagtccttcaatcatcaggattatattcactatcatctgtagtcactgtaccctcatcttcactaggcacccaaacatacatttgtaatgtaaaccataaaccatcaaacaccaaagtagataaaaaagtagaaccaaaatcttgtgacaaaacacatacctgccctccatgtccagcaccagaacttctaggaggcccctcagtattcctattcccacccaaaccaaaagacacactcatgatatcaagaacacccgaagtaacctgcgtagtagtagatgtctctcacgaagacccagaagtaaaattcaattggtacgtagatggagtagaagtacacaacgcaaaaacaaaaccaagagaagaacaatataactcaacctaccgagtagtatcagttctaaccgtattacatcaagattggctaaacggaaaagaatacaaatgtaaagtctccaataaagcactaccagcaccaatagaaaaaacaatatcaaaagcaaaaggacaaccaagagaaccccaagtctatacattgccaccatctagagaagaaatgacaaaaaaccaagtatcattaacatgcttggtaaaaggattctacccttcagatatagctgtagaatgggaatcaaatggccaacctgaaaacaattataaaacaacaccaccagtactagattcagatggatccttttttttatattcaaaactaactgtagacaaatctagatggcaacaaggcaacgtattctcatgctcagtcatgcacgaagctctacataatcattacacacaaaaatctctatctttatctcctggcaaa

SEQ ID NO: 51130 - RNA, 1359 nt, synthetic construct
  misc_feature 1..1359: note = derived and/or modified sequence opt6 from anti-influenza_Chain
  source 1..1359: mol_type = other RNA
gaagtacaattagtacaatcaggagcagaagtaaaaaaaccaggtgaaagtctaaaaatatcatgtaaagtatccggatactcattcacaagccaatggatcggatgggtaagacaaatgccaggaaaaggcctcgaatggataggtatgatgtatccaggagactccgacaccatatattcaccatccttccaaggacaagtaaccatatcagcagataattcaatatccacagcctacctacaatggtcatcacttaaagcctccgatacagcaatttactactgcgcatcaggaccaggatactcaggctatcactatggatggtttgacacatggggccaaggaacacttgttacagtttcatcagcatctacaaaaggaccaagtgtattcccattagcaccatcatcaaaatctacaagcggaggaacagcagcactaggatgcctagtcaaagattacttcccagaaccagtcacagtatcatggaattcaggtgcactaacatcaggcgtccacacatttcctgccgtattacaatcatcaggactatattcactttcaagcgtagtaaccgtcccatcctcttcccttggaacccaaacatacatttgtaacgtaaatcacaaaccatctaacacaaaagtagataaaaaagtagaaccaaaatcctgcgacaaaacacatacatgcccaccatgtcccgcacccgaactccttggaggaccatctgtatttcttttcccacctaaacccaaagacacactaatgataagtagaactcccgaagtaacatgcgtagttgtagacgtatcacatgaagacccagaagttaaattcaactggtacgtagacggagtagaagtacataacgcaaaaacaaaaccaagagaagaacaatataattcaacctacagagtagtatcagttctaacagtactacaccaagactggttaaacggaaaggaatacaaatgcaaagtctccaacaaagctttaccagctcctatagaaaaaacaatatctaaggcaaaaggacaacccagagaaccccaagtatataccctaccaccctcaagagaagaaatgacaaaaaaccaagtctcactaacatgtctcgtaaaaggattctacccatccgacatcgctgtcgaatgggaatctaacggccaaccagaaaataattataaaacaaccccaccagtcctagattcagacggatccttttttttatactcaaaactaacagttgacaaatcacgatggcaacaaggaaacgtattctcttgctctgtaatgcacgaagcccttcataaccactatactcaaaaaagcctctccttatccccaggaaaa

SEQ ID NO: 51131 - RNA, 1359 nt, synthetic construct
  misc_feature 1..1359: note = derived and/or modified sequence opt6 from anti-influenza_Chain
  source 1..1359: mol_type = other RNA
gaagtacaacttgttcaatccggagcagaagtaaaaaaaccaggagaatcattaaaaatttcatgcaaagtatcaggatactcatttacaagtcaatggataggatgggtaagacaaatgccaggcaaaggcctagaatggataggtatgatgtacccaggagatgctgacgcaatttactcaccatctttccaaggacaagtaacaatctcagcagataatagcatatcaacagcttacctacaatggtcttcactaaaagcatcagacacagcaatctattactgcgcatcaggacccggatattctggatatcactacggatggttcgacacctggggacaaggaaccctagtaacagtatcctctgcatccactaaaggaccatccgtattcccactagcaccatcaagcaaatcaacttcaggaggtaccgcagcactaggatgcctagttaaagactatttccccgaaccagttacagtatcatggaactccggagctctaacctctggtgtacacacatttcccgcagtacttcaaagcagtggtctatattcattatcatcagtagttacagtaccatcctcatcattaggtacacaaacatatatatgtaatgtaaatcacaaaccctcaaatacaaaagttgacaaaaaagtagaaccaaaatcatgcgacaaaacacacacatgccccccatgcccagcaccagaactactaggaggcccatctgtatttttatttccaccaaaaccaaaagacacattaatgatatcaagaacaccagaagtaacatgcgttgtagtagacgtatcacacgaagacccagaagttaaatttaattggtacgtagatggagtagaagtacacaacgccaaaacaaaacccagagaagaacaatacaactcaacctaccgagtagtttcagtattaactgtacttcaccaagattggctaaacggtaaagaatacaaatgtaaagttagtaataaagcactcccagcaccaatagaaaaaacaatatcaaaagccaaaggacaacctagagaaccacaagtatacacactaccaccttccagagaagaaatgaccaaaaaccaagtatcacttacatgtttagtcaaaggattctacccatcagacatcgcagtagaatgggaatcaaacggacaacctgaaaataactataaaacaacaccacccgtattagactcagatggatcattcttcctttattccaaattaacagtagacaaatcaagatggcaacaaggaaacgtattctcctgctcagtaatgcacgaagcactacacaaccattatacccaaaaaagtctcagtttatcaccaggcaaa

SEQ ID NO: 51132 - RNA, 1359 nt, synthetic construct
  misc_feature 1..1359: note = derived and/or modified sequence opt6 from anti-influenza_Chain
  source 1..1359: mol_type = other RNA
gaagtacaactagtacaatcaggagccgaagtaaaaaaaccaggagaaagtttaaaaatctcatgtaaagtttctggttactctttcacttcacaatggataggctgggttagacaaatgcccggaaaaggactagaatggataggaatgatgtatccaggcgaatcagaaacaatatattcaccatccttccaaggacaagtaacaatttccgctgataatagtatctctaccgcatatttacaatggtcatcacttaaagcatcagatacagccatatattattgcgcatccggaccaggctattcaggataccactatggatggttcgacacttggggacaaggaacacttgtaaccgtaagttccgcaagcacaaaaggaccatcagtatttccactagcaccatcttctaaatcaacaagtggcggaacagcagcactaggttgcctagtcaaagactacttcccagaacccgtaacagtatcctggaactcaggagccctaacatcaggagtacatacatttccagccgtattacaatcctcaggactatactcattatcatctgtagtaacagtcccctcatcctcactaggcacacaaacctatatctgcaacgttaaccataaaccttccaacacaaaagtggacaaaaaagtagaaccaaaatcatgtgataaaactcatacatgcccaccatgccccgccccagaactattaggtggaccatcagtattcctcttccctccaaaaccaaaagatactttaatgatatcacgcaccccggaagtaacatgcgtcgtagtagacgtttcccacgaagacccagaagtaaaattcaactggtatgtagacggcgtagaagtacacaacgcaaaaacaaaacctcgcgaagaacaatataattctacatacagagtagtctccgtcctaacagtattacatcaagactggcttaatggaaaagaatataaatgcaaagtctctaacaaagcactaccagccccaatagaaaaaacaatatccaaagcaaaaggccaaccaagagaaccacaagtatatacattacccccatcaagagaagaaatgaccaaaaaccaagtaagcctaacctgcctagtaaaaggattctatccgtccgatatcgcagtagaatgggaatccaatggacaaccagaaaacaattataaaacaaccccccctgtactcgattcagacggatcattcttcttatactcaaaattaacagtagacaaaagtagatggcaacaaggaaatgtattttcatgctcagtaatgcatgaagctcttcataaccactatacccaaaaatcactatcattatcaccaggaaaa

SEQ ID NO: 51133 - RNA, 1359 nt, synthetic construct
  misc_feature 1..1359: note = derived and/or modified sequence opt6 from anti-influenza_Chain
  source 1..1359: mol_type = other RNA
gaagtacaactagtacaaagcggcgctgaagtcaaaaaacctggagaatcactaaaaatatcctgtaaagttagtggatactccttcacatcccaatggataggatgggtaaggcaaatgccaggaaaaggattagaatggattggaatgatgtacccaggagatgcagacacaatatactcaccatcattccaaggacaagtaactatatcagcggacaacagcatatccacagcctacttacaatggtcatcactaaaagcatctgacactgcaatatactattgtgcatcaggtcccggatactcaggatatcactacggatggtttgacacatggggtcaaggaacattagtaacagtatcatccgcctccacaaaaggaccaagcgtatttccactagcaccatcaagcaaatctacatcaggaggaacagccgcattaggatgcttagtaaaagattatttcccagaaccagtcacagtatcctggaactcaggagcattaacatcaggtgtccacacatttccagcagttctacaaagctcaggattatattccctctcaagtgtagtaaccgtaccatcatcatccctaggaacacaaacttacatatgtaacgtaaatcacaaaccatcaaatacaaaagtggacaaaaaagttgaaccaaaatcatgtgacaaaacacacacctgcccaccatgtccagcaccagaactactaggaggaccctcagtcttcttattcccacctaaaccaaaagatacactaatgatctctagaaccccagaagtaacttgtgtagtagtcgacgtttcacatgaagacccagaagttaaattcaactggtacgttgacggagtagaagtacacaatgcaaaaacaaaaccaagagaagaacaatataactcaacatacagggtagtatcagttcttacagtactacatcaagactggctaaatggaaaagaatacaaatgcaaagtatcaaataaagcactaccagcaccaatagaaaaaaccatatccaaagcaaaaggacaacctagagaacctcaagtatacacactaccaccatcaagagaagaaatgaccaaaaaccaagtctcactaacatgcctagtaaaaggcttttaccctagcgatatagcagtcgaatgggaatcaaacggacaaccagaaaataattacaaaacaacacccccagtactagactctgatggatctttcttcttatattctaaactaactgtagacaaatcaaggtggcaacaaggaaacgtattctcttgttcagtaatgcacgaagcactacacaaccactacacacaaaaatcactatcattatccccaggtaaa

SEQ ID NO: 51134 - RNA, 1359 nt, synthetic construct
  misc_feature 1..1359: note = derived and/or modified sequence opt6 from anti-influenza_Chain
  source 1..1359: mol_type = other RNA
gaagtacaattagtacaatctggagccgaagtaaaaaaacccggagaatcacttaaaatatcttgcaaagtttcaggatactccttcacatcacaatggataggatgggtcagacaaatgccaggaaaaggcctagaatggataggaatgatgtacccaggatcatcagatacaatatactcaccatcattccaaggacaagtcaccatatccgcagataattcaatatctacagcatacttacaatggtcctcattaaaagcatcagacacagcaatatattactgcgcatctgggccaggatactcaggatatcattacggatggttcgatacatggggacaaggaactctagtaacagtatcatctgcatcaacaaaaggaccctccgtattcccactagcaccatcctcaaaatccacatccggaggtacagcagcattaggatgcctagtaaaagattacttcccagaaccagtaactgtaagctggaactcaggagcattaacttcaggcgtccatacttttcccgcagtactccaaagctcaggactctactcattatcatcagttgtaactgtaccctcatcatcactaggaacacaaacctacatatgtaacgtaaaccataaaccatcaaacacaaaagtagacaaaaaagtagaaccaaaatcatgcgacaaaactcatacttgccctccatgcccagcaccagaattactaggaggcccatcagtatttctattcccacctaaaccaaaagatacactaatgatttcaaggacccccgaagtaacatgtgtagttgtagacgtatcacacgaagacccagaagtaaaattcaattggtacgtagacggagtagaagtacataacgcaaaaactaaacccagagaagaacaatacaattcaacataccgagtagtatcagtattaactgtactacaccaagactggcttaacggtaaagaatataaatgcaaagtatcaaacaaagcactaccagcccccatagaaaaaacaatatcaaaagcaaaaggacaaccaagagaaccacaagtatatacactaccaccatccagagaagaaatgacaaaaaaccaagtatcactcacatgcctagtaaaaggcttctacccatcagatatagccgtagaatgggaaagtaatggacaacccgaaaacaactataaaacaacacctcctgtactcgattcagacggatccttcttcttatacagtaaattaacagtagataaatcaagatggcaacaaggaaacgtcttttcatgctctgtgatgcacgaagccctccacaaccactacacacaaaaatctctatcattaagcccaggaaaa

SEQ ID NO: 51135 - RNA, 1359 nt, synthetic construct
  misc_feature 1..1359: note = derived and/or modified sequence opt6 from anti-influenza_Chain
  source 1..1359: mol_type = other RNA
gaagtgcaactagtacaatctggagccgaagtaaaaaaaccaggtgaaagcctaaaaatatcatgtaaagtctccggatactcttttacatcacaatggataggatgggttagacaaatgccgggaaaagggttagaatggattggcatgatgtacccaggagactctgatgcaatttactcaccatcattccaaggacaagtaacaatatctgcagacaattcaatatctacagcataccttcaatggtcatcccttaaagcatctgatacagcaatttactactgcgcttcaggtcctggatattcaggataccactacgggtggtttgacacgtggggacaaggaacactagtaacagtatcatccgcatctaccaaaggaccttcagtattcccccttgcaccatcatcaaaatctacatcaggaggaacagcagcattaggatgtctcgttaaagattactttccagaaccagttacagtttcctggaactcaggagcattaacatcaggtgtacacacattcccagcagtattacaatcatctggactctattctctatcatcagtagtaacagtaccatcatcctcgctcggaactcaaacatacatatgtaacgtaaaccataaaccttcaaataccaaagtagacaaaaaagtagaaccaaaatcatgcgacaaaacacacacatgccccccatgcccagcaccagaattacttggaggaccctcagtattcttattcccaccaaaaccaaaagacacactcatgatatcaagaacaccagaagttacatgcgttgttgtagacgtttcacatgaagacccagaagtaaaattcaactggtacgtagatggagtcgaagtacataacgccaaaaccaaaccacgagaagaacaatataactcaacctatagagtagtatcagtactcaccgtcctacatcaagattggttaaacggcaaagaatataaatgtaaagtatcaaacaaagcattaccagcaccaattgaaaaaacaatatctaaagctaaaggacaacctagagaacctcaagtatacactttaccaccttccagagaggaaatgacaaaaaatcaagtctcacttacatgcctagtaaaaggattctatccaagcgatatagcagtagaatgggaatctaacggacaaccagaaaacaactacaaaaccacaccacccgtattagactctgacggctcttttttcttatactcaaaattaacagtcgataaatcccgatggcaacaaggaaacgtattctcatgttcagttatgcacgaagcattacacaatcattacactcaaaaatcgctatcactatcaccaggtaaa

SEQ ID NO: 51136 - RNA, 1359 nt, synthetic construct
  misc_feature 1..1359: note = derived and/or modified sequence opt6 from anti-influenza_Chain
  source 1..1359: mol_type = other RNA
gaagtccaactagtacaatcaggtgcagaagtaaaaaaacccggagaaagtttaaaaatatcttgtaaagtttcaggatattcattcacatcacaatggataggttgggtgagacaaatgccaggcaaaggattagaatggataggaatgatgtacccaggagacactgacacaatatactcaccatcattccaaggacaagtcacaatatctgcagacaactcaatatcaacagcatacctacaatggagttctttaaaagcatcagatacagccatatactactgtgcatcaggtcccggttactcaggataccactacggatggtttgatacttggggccaaggaacactagtcactgtatcatccgcatcaacaaaaggcccatcagtctttcctctagcaccatcttcaaaatcaacatcaggaggaacggcagctttaggctgtctagtaaaagattactttccagaacctgtaacagtatcatggaactcaggagctctcacaagcggagtacatacattccctgcagtcctacaatcatccggactatacagtttatcctcagtagtaacagtaccatcatcttcattaggaacacaaacatacatctgtaatgtaaatcataaaccatcaaacaccaaagtagacaaaaaagtagaaccaaaatcatgcgataaaacacatacatgcccaccatgccctgctcccgaactactaggaggaccctctgtatttctatttcccccaaaacccaaagacacactaatgatatcacgaacaccagaagtaacatgcgtagtagttgatgtctcacatgaagacccagaagttaaatttaactggtatgtagacggagtagaagttcataacgcaaaaaccaaaccaagagaagaacaatacaattctacatatagagtagtttcagtattaacagtattacatcaagactggctaaacggcaaagaatacaaatgcaaagtctcaaacaaagcactacccgcaccaatagaaaaaaccataagcaaagcaaaaggacaacctagagaaccacaagtatacacactcccaccaagcagagaagaaatgacaaaaaatcaagtatccctaacatgtctagtaaaaggattctatccatcagacatagcagtagaatgggaatctaatggccaaccagaaaataactacaaaacaacacccccagtattagactctgacggatccttcttcttatactcaaaactaacagtagataaatctagatggcaacaaggaaatgttttctcatgttccgtaatgcacgaagcactacacaaccattacacacaaaaatcattatcactatcacccggaaaa

SEQ ID NO: 51137 - RNA, 1359 nt, synthetic construct
  misc_feature 1..1359: note = derived and/or modified sequence opt6 from anti-influenza_Chain
  source 1..1359: mol_type = other RNA
gaagtacaactcgtccaatcaggagccgaagtaaaaaaacccggagaaagtctaaaaatttcatgtaaagtatcaggttatagtttcacatcacaatggataggatgggtccgtcaaatgccaggcaaaggtctagaatggataggaatgatgtatccaggagaatccgacacaatatactctccatcattccaaggacaagtcacaatatcagcagacaattcaatatcaactgcatatctacaatggtcctccttaaaagcatccgacactgctatatattactgcgcatctggaccaggatacagcggatatcattatggatggtttgacacatggggccaaggaacactagtaaccgtatcaagcgcatcaacaaaaggaccatcagtcttcccactagccccatcctcaaaatcaacttccggaggcacagcagccctaggatgcctcgtaaaagactacttcccagaaccagtaactgtatcttggaactctggagcccttacatcgggagtacacacattcccagccgtcttacaatcatcaggactatacagcttatcttccgtagtcactgtaccaagttcaagcttaggaactcaaacatatatctgcaacgtaaaccataaaccatcaaacacaaaagtagacaaaaaagtagaaccaaaatcatgtgacaaaacacatacctgtccaccatgtccagcccccgaacttttaggcggaccatccgtattcctattccctccaaaaccaaaagacacattaatgatatctagaacaccagaagtaacatgcgttgtcgtcgatgtatcacacgaagatccagaagttaaatttaactggtacgttgatggagtagaagtacacaacgcaaaaacaaaacccagagaagaacaatacaactcaacctatcgagtagtctcagtattaactgtactacaccaagattggctaaatggcaaagaatataaatgcaaagtatcaaacaaagctctacctgctccaatagaaaaaacaatttcaaaagcaaaaggccaaccaagagaaccacaagtatacacactccccccaagtcgagaagaaatgacaaaaaatcaagtatcactcacatgtttagtaaaaggattttacccctccgacatagctgtagaatgggaaagcaacggacaaccagaaaacaactacaaaaccactccaccagtcttagactcagacggatcattcttcttatactcaaaactaaccgtcgacaaatcaagatggcaacaaggaaacgtattctcatgctctgtcatgcacgaagccctacacaaccattacacacaaaaatcactatcattatcaccaggaaaa

SEQ ID NO: 51138 - RNA, 1359 nt, synthetic construct
  misc_feature 1..1359: note = derived and/or modified sequence opt6 from anti-influenza_Chain
  source 1..1359: mol_type = other RNA
caagtacaattagttcaatcaggagcggaagtcaagaaaccaggatcatccgtaagagtatcatgtaaagcatccggatcaattttccgaaactacgcaatgtcttgggttcgtcaagctccgggtcaaggattagaatggatgggtggaatcatagccatcttcggtactcctaaatacgctcaaaaattccaaggaagagtaactataacagcagacgaatcaacatcaacagtatatatggaactatcaggactaagaagtgaagacacagccatgtactattgcgcaagaatacctcattacaattttggatcaggatcatactttgactactggggacaaggcacacttgtaacagtatcatcagcatcaaccaaaggcccatcagtattccccttagccccatcatctaaatcaacatcaggaggaacagcagctttaggttgtttagtaaaagattattttccagaaccagtcaccgtatcatggaactcaggagccctaacctccggagtacacacatttccagcagtactacaatcctcaggattatattctctatcatcagtagtcacagtaccatcatcctcactaggaacacaaacatacatttgtaacgtaaaccacaaaccatcaaatacaaaagtcgataaaagagtagaaccaaaaagctgtgataaaactcatacttgtccaccatgcccagcacccgaattactcggaggtccaagcgtattcctttttccaccaaaaccaaaagacacactaatgatatcgagaactccagaagtaacttgcgtagtcgtagacgtctcacacgaagatccagaagtcaaatttaattggtacgtagatggcgtcgaagtacataatgccaaaaccaaaccaagagaagaacaatataactctacatacagagtagtatcagtactcaccgtactacatcaagactggttaaacggtaaagaatacaaatgtaaagtatccaacaaagcactaccagcaccaatagagaaaaccatatccaaagcaaaaggacaaccacgagaaccacaagtttacacattacccccttctcgcgaagaaatgactaaaaaccaagtttctctaacatgtttagtaaaaggattttacccatcagacatagcagtagaatgggaatcaaatggccaacctgaaaataattataaaacaactccacccgtactagactccgacggttcattcttcttatattccaaactcacagtagataaatccagatggcaacaaggaaacgtattctcatgctcagtaatgcacgaagcattacataaccactatacacaaaaatccttatctttatcaccaggaaaa

SEQ ID NO: 51139 - RNA, 1359 nt, synthetic construct
  misc_feature 1..1359: note = derived and/or modified sequence opt6 from anti-influenza_Chain
  source 1..1359: mol_type = other RNA
caagttcaactagtacagtctggagctgaagtaaaaaaaccaggtgcaagcgtcaaagtatcatgcaaagcatcaggatacatatttacaggatactacatacattgggttagacaagcaccaggacaaggactcgaatggatgggaagaatagacccaaacggatcaggaacaacatacgcacaaaaatttcaaggacgagtgacactaacaatggatacatccataacaacagcatacatggaattgagtcgactaagattcgacgacactgcaatatactactgtgctagatgggattggaacttcgatctatacctaggatggttcgacccatggggccaaggaacaccagtcaccgtagcatctgcatcaacaaaaggaccatcagtttttccattagcaccatcatcaaaatcaacatcaggaggaaccgccgctttaggctgcctagtaaaagattatttcccagaaccagtaacagtaagttggaactcaggagcattaacatcaggcgtacatacattcccagcagtactccaatcatctggtctatactcactatcatcagtcgtaactgttccatcatcctcactaggaactcaaacatatatctgtaatgtaaaccacaaaccatcaaatacaaaagtagacaaaaaagttgaaccaaaatcttgtgataaaacacacacttgcccaccatgcccagccccagaactattaggaggaccatccgtattccttttcccaccaaaaccaaaagacacactaatgatctctcgcacaccagaagtaacatgtgtagtagtagatgtatcacatgaagacccagaagtaaaatttaactggtacgtagatggagtcgaagtacacaacgcaaaaaccaaacccagagaagaacaatacaactcaacataccgagtagtttctgttctaaccgtactacatcaagactggttaaatggcaaagaatataaatgtaaagtatctaataaagcactaccagcaccaatcgaaaaaacaatctcaaaagcaaaaggacaaccaagagaaccccaagtctacacattaccaccatcacgagaagaaatgaccaaaaatcaagtaagtctcacatgcctagtcaaaggcttctacccatcagatattgcagtagaatgggaatcaaacggacaaccagaaaataattataaaacaacacccccagtactagattcagatggatctttttttctatattcaaaactaaccgtcgacaaatccagatggcaacaaggaaacgtattctcttgctcagtaatgcacgaagccctacacaatcactacacccaaaaatcactatcattatcaccaggaaaa

SEQ ID NO: 51140 - RNA, 1359 nt, synthetic construct
  misc_feature 1..1359: note = derived and/or modified sequence opt6 from anti-influenza_Chain
  source 1..1359: mol_type = other RNA
gaagtccaattagtacaatcaggagcagaagttaaaaaacctggagcatcagtaaaagttagctgtaaagcaagtggttacatatttacaggttattacatacactgggtacgtcaagctccaggccaaggtttagaatggatgggaagaattgatcctaatggagcaggtacaacctacgcccaaaaatttcaaggtagagtaacattaacaatggacacaagtataacaacagcctatatggaattatcaagattaagatttgacgacacagcaatatactactgtgcaagatgggattggaactttgatctatatttaggttggtttgacccatggggacaaggtacaccagtaacagtagcatccgcaagcacaaaaggaccatcagtatttccattagcaccaagctctaaatcaacatctggaggaacagcagcactaggctgtttagtaaaagattactttcctgaacccgtaaccgtaagttggaactcaggcgcactaacttcaggagtccataccttccccgcagtacttcaatcatcaggactatattccttaagcagtgtagtaacagtaccatcatcatcactcggcacacaaacctatatatgcaatgtaaaccacaaacctagtaatacaaaagtagataaaaaagtcgaaccaaaaagctgcgataaaactcatacttgtccaccctgtccagcccccgaattactcggaggcccatcagtattcctattcccaccaaaacccaaagacacactaatgatatctcgaacaccagaagtaacttgcgtagtagttgacgtatcacatgaagatccagaagtcaaattcaattggtacgtagacggagtagaagtacataatgccaaaactaaaccacgagaagaacaatacaattccacatatagagtagtatctgtcctaactgtactccatcaagactggctaaacggaaaagaatacaaatgtaaagtatctaataaagcattaccagctccaattgaaaaaacaatatcaaaagccaaaggacaaccaagagaaccacaagtatacacactcccacccagcagagaagaaatgacaaaaaaccaagtatctctaacatgtctagtaaaaggcttttacccaagtgatatagcagtcgaatgggaatcaaatggacaacctgaaaataattataaaacaacaccaccagtactagattccgacggaagcttttttctatactcaaaattaacagtagacaaaagcagatggcaacaaggaaacgtcttttcatgctcagtcatgcatgaagcactacacaatcattatacccaaaaatcactatcattatccccaggaaaa

SEQ ID NO: 51141 - RNA, 1359 nt, synthetic construct
  misc_feature 1..1359: note = derived and/or modified sequence opt6 from anti-influenza_Chain
  source 1..1359: mol_type = other RNA
caagttcaacttgtccaaagtggagccgaagttaaaaaaccaggcgcctctgtaaaagtatcatgcaaagcttcaggttacacattcaatgcccaccatatgcattgggtaagacaagcaccaggacaaggactaggatggatgggctggatcgatcccaataatgatggcacaatatacgcacaaaaatttcaaggaagagtaacattaactatggatacatcaattcacacagcatatatggaattatctggcttacgttatgacgatacagcaatatactactgtgtaagatgggcttggaattttgatttttttctaggctggtttgacccatggggacaaggaactttagtaacagtcgccagtgcaagcactaaaggtccctctgtatttccattagccccaagctcaaaatcgacaagtggaggaacagctgcactaggttgtctagtaaaagattactttccagaaccagtaacagtctcatggaatagcggagcactaacatcaggagtacacacctttcccgcagtattacaatcatcaggtctctatagtttatcatcagttgtaaccgtaccatcatcaagtctaggaacacaaacatatatatgtaatgtaaatcataaaccatcaaacacaaaagtagataaaaaagtagaaccaaaaagctgtgataaaacacatacatgtcccccttgccctgcaccagaactactaggtggaccaagcgtattcctattcccaccaaaacccaaagatacattaatgatctcaagaacaccagaagtaacttgcgtggtagtagacgtaagtcacgaagatccagaagtaaaattcaactggtatgtagatggtgtagaagtacataatgcaaaaacaaaacctagagaagaacaatataactcaacatatagagtagtatcagtactaaccgtactacaccaagattggcttaacggtaaagaatataaatgcaaagtctccaacaaagcacttccagcacccatagaaaaaaccatatccaaagcaaaaggacaacctagagaaccacaagtatacactctaccaccatcaagagaagaaatgacaaaaaatcaagtatcattaacatgcttagtaaaaggattctacccttcagatatagcagtagaatgggaaagcaatggacaaccagaaaacaattacaaaacaacaccaccagtattagactctgatggaagtttctttttatactcaaaacttacagtagacaaatcccgatggcaacaagggaacgttttttcatgctcagtaatgcacgaagcactccacaatcattatacacaaaaatcactatcattatcaccaggaaaa

SEQ ID NO: 51142 - RNA, 1359 nt, synthetic construct
  misc_feature 1..1359: note = derived and/or modified sequence opt6 from anti-influenza_Chain
  source 1..1359: mol_type = other RNA
gaagtacaacttgtccaatcaggtgccgaagtaaaaaaacctggagaatccttaaaaatatcttgcaaagtatccggatactcatttacatcacaatggatcggatgggtaagacaaatgccaggaaaaggcttagaatggataggaatgatgtatccaggagactccgatacaatttactcaccttcattccaaggacaagtaacaatatctgctgataattcaatatcaacagcctacctacaatggtcctcacttaaagcctcagacactgcaatatactattgcgcatcaggaccaggatactcaggataccattacggatggttcgatacatggggacaaggaacacttgtcacagtttcttcagcatccacaaaaggaccatctgtattcccactagccccatcctcaaaatccacatcaggaggaacagctgcacttggttgtctagtaaaagactatttcccagaacccgtaacagtatcatggaactccggagccttaacttcaggtgtccatacattcccagcagtcctacaatcttcaggtctttactccttatcttctgtagtaacagtcccaagctcatccttaggcacacaaacatatatatgcaacgtaaaccataaaccctcaaatacaaaagtcgataaaaaagtagaaccaaaatcatgcgacaaaacccatacctgtccaccatgccccgcaccagaactattaggtggaccaagtgtattcctattcccacccaaaccaaaagacaccctaatgatatcacgaacaccagaagtaacatgcgtcgtagtcgacgtatcccacgaagacccagaagtcaaatttaactggtacgtagacggagtagaagtacacaacgcaaaaaccaaaccaagagaagaacaatacaactcaacataccgagtagtaagcgttttaactgtattacaccaagattggctaaacggaaaagaatataaatgcaaagtatccaacaaagcattaccagcaccaatagaaaaaactatatcaaaagcaaaaggacaaccaagagaaccacaagtatatacactacccccatcacgtgaagaaatgactaaaaatcaagtaagtttaacatgcttagttaaaggattttacccttccgatatagcagttgaatgggaatcaaacggacaacccgaaaacaattacaaaacaacacccccagtattagattcagacggatctttcttcttatactcaaaattaacagtagataaatccagatggcaacaaggaaatgtattctcatgttccgtcatgcatgaagcattacacaaccattacactcaaaaatcactttcattatcaccagggaaa

SEQ ID NO: 51143 - RNA, 1359 nt, synthetic construct
  misc_feature 1..1359: note = derived and/or modified sequence opt6 from anti-influenza_Chain
  source 1..1359: mol_type = other RNA
gaagtccaactagtccaatcaggagccgaagttaaaaaacctggagaatcattaaaaatatcttgtaaagtaagtggatactcatttacatcccaatggataggatgggtaagacaaatgccaggaaaaggattagaatggataggaatgatgtaccctggcgatgcagacgcaatttactccccatcattccaaggccaagtaacaatatcagcagataatagcatatcaacagcctacttacaatggtcatccttaaaagcatcagacacagccatatattattgcgcctcaggaccaggatattcaggataccactatggatggttcgatacatggggccaaggaacactagtaacagtatcatcagcatcaacaaaaggaccttcagtattccctctggcaccatcatcaaaaagcacatctggaggaactgcagccctaggctgcttagtaaaagattacttccctgaaccagtaaccgtatcatggaacagcggagcattaacatcaggcgtacacaccttccctgcagtccttcaatcaagcggcttatactccctttcaagcgtcgtcactgttccatcctcatccctaggaacacaaacttacatatgcaatgtaaatcacaaaccatctaacacaaaagtagataaaaaagtcgaacctaaatcatgcgacaaaacacatacctgccccccttgtcccgctccagaactattaggaggaccctcagtatttctattcccaccaaaacctaaagacacattaatgatatcaagaacaccagaagtaacatgcgtagttgtagacgtatcacacgaagatccagaagtaaaattcaactggtatgtagatggtgtagaagtccacaatgcaaaaacaaaaccaagagaagaacagtacaattcaacatacagagttgtatctgttctaacagttttacatcaagattggttaaatggaaaagaatataaatgcaaagtatcaaataaagcactacccgcaccaatagaaaaaacaatatccaaagctaaaggtcaacctcgagaaccacaagtatatacactccccccatccagagaagaaatgacaaaaaaccaagtatcattaacgtgcttagtcaaaggcttctacccaagcgatattgccgtagaatgggaatcaaatggacaacccgaaaataattataaaactacaccacccgtccttgattcagatggatcattttttctatactcaaaactaactgttgataaatcacgatggcaacaaggcaatgtattcagttgttctgtcatgcacgaagcactacacaaccattacacacaaaaatcactatctctctcaccaggaaaa

SEQ ID NO: 51144 - RNA, 1359 nt, synthetic construct
  misc_feature 1..1359: note = derived and/or modified sequence opt6 from anti-influenza_Chain
  source 1..1359: mol_type = other RNA
gaagttcaattagtacaatccggagcagaagtaaagaaaccaggagaatcactaaaaatctcatgtaaagtatcaggatactcattcacatcacaatggataggatgggtaaggcaaatgccaggaaaaggactagaatggataggtatgatgtacccaggagaatccgaaacaatatattccccatcattccaaggacaagtaacaatatcagctgacaattcaatatcaacagcatacctacaatggtcctcactaaaagcatcagataccgcaatatactactgcgcatcaggacctggatattccggttatcactatggttggttcgacacttggggacaaggaacccttgtaacagtatcatcagcatcaacaaaaggaccctcagtttttcctttagcaccatcatctaaatcaacatcaggcggaacagcagcactaggatgcttagtaaaagactacttcccagaaccagtaacagtttcatggaactcaggtgcattaacatctggagtacacacattcccagcagtattacaaagctccggtttatactcactatcatcagtcgttacagtaccatcttcatctctaggaacacaaacatacatttgtaacgtaaaccataaaccatctaatacaaaagtagataagaaagtagaaccaaaatcatgtgacaaaacacacacatgcccaccatgccctgcaccagaattactaggaggaccctcagtctttctatttcccccaaaacccaaagatacattaatgatatcaagaacaccagaagtaacctgcgtagtagttgacgtatcacacgaagaccccgaagtcaaattcaactggtacgtggacggtgtagaagtacacaacgctaaaacaaaaccaagagaagaacaatacaacagcacatacagagtagtatcagtactcacagtactacatcaagattggctaaacggaaaagaatacaaatgtaaagtatccaacaaagcactaccagcacccattgaaaagacaatatcaaaagcaaaaggacaaccaagagaaccacaagtctacacattaccaccatcaagagaagaaatgaccaaaaaccaagtatcactaacatgtttagttaaaggattctacccatcagacatagcagtagaatgggaatctaacggacaacccgaaaataactacaaaacaacaccaccggtattagattccgacggctcattcttcctatactcaaaattaacagtagacaaaagcagatggcaacaaggaaacgtattctcatgttcagtgatgcacgaagcactccacaaccattacacccagaaaagtctatcactctcaccaggcaaa

SEQ ID NO: 51145 - RNA, 1359 nt, synthetic construct
  misc_feature 1..1359: note = derived and/or modified sequence opt6 from anti-influenza_Chain
  source 1..1359: mol_type = other RNA
gaagtacaactagtacaatcaggcgcagaagtcaaaaaaccaggagaatcactcaaaatatcatgcaaagtctcaggatactcatttacatcccaatggataggatgggttagacaaatgccaggaaaaggactcgaatggataggaatgatgtatccaggagatgcagacaccatttattctccaagttttcaaggccaagttacaatatccgcagacaacagtatatcaacagcttacctacaatggtcctccctaaaagcatcagacaccgcaatatactattgcgcatcaggaccaggatactcaggatatcactacggatggttcgacacttggggtcaaggaactttagtcactgtatcctcagcttcaaccaaaggaccatcagtctttccactagcaccatcatctaaatcaacatcaggaggtacagcagccttaggatgcttagtaaaagactacttccccgaaccagtaacagtatcatggaactcaggagcactaacatccggagtacacacctttccagctgtactacaatcatccggactctattcattatcatcagtagtaactgtaccatcatcttccttaggaacccaaacctacatatgtaacgtcaaccacaaaccctcaaacacaaaagtagacaaaaaagtagaaccaaaatcttgtgataaaacacacacatgcccaccatgtccagccccagaattattaggaggaccatccgtatttttattcccacccaaaccaaaagacaccttaatgatatcaagaacaccagaagtcacctgcgtagtagtagacgtatcacacgaagatccagaagtaaaatttaattggtacgtagacggagtagaagtacacaacgctaaaacaaaaccaagagaagaacaatataactccacttatagagtagtatcagtactaacagtattacaccaagactggcttaacggaaaagaatacaaatgtaaagtatccaacaaagcactcccagcaccaatagaaaaaacaatatcaaaagccaaaggacaacccagagaaccacaagtctatacactaccaccatctagagaagaaatgaccaaaaaccaagtctcactaacatgcttagtaaaaggattctacccttcagacatcgcagtagaatgggaatctaacggacaaccagaaaacaattacaaaaccacacccccagtcctagattccgatggatctttcttcctatactcaaaattaacagtcgataaatcaagatggcaacaaggaaacgtattctcctgctcagtaatgcacgaagcactccataaccactatacacaaaaatcactttccttatcacctggaaaa

SEQ ID NO: 51146 - RNA, 1359 nt, synthetic construct
  misc_feature 1..1359: note = derived and/or modified sequence opt6 from anti-influenza_Chain
  source 1..1359: mol_type = other RNA
gaagttcaactcgttcaatcaggtgcagaagtaaaaaaaccaggcgaatcactaaaaatatcatgcaaagtatctggatactcattcacatcccaatggataggatgggttagacaaatgcctggaaaaggattagaatggataggcatgatgtaccccggatctagcgacacaatatattcaccatcctttcaaggacaagtaacaatttcagcagacaactcaataagcaccgcctatctacaatggtcatcattaaaagcaagtgatacagcaatatactactgtgcatccggacctggatactcaggatatcactatggttggttcgatacatggggacaaggtacattagtaactgtatcatcagcctctacaaaaggaccttcagtattcccattagcaccatcctccaaatcaacatcaggaggcacagcagcactaggatgcctcgtaaaagattatttcccagaacctgtaacagtatcttggaactcaggagcattaacatcaggagtgcataccttcccagcagttctccaatcctccggattatattcactatcatcagtcgttactgtaccatcatcttcactaggaacacagacctacatatgtaacgtaaaccataaaccaagcaacacaaaagtagataaaaaagtcgagcccaaaagctgcgacaaaacccacacatgcccaccttgcccagcaccagaactcctaggtggaccttcagtattcctatttccaccaaaaccaaaagacacactaatgatttcaagaactccagaagtaacatgcgtagtagtagacgtctcacatgaagacccagaagtcaaatttaactggtatgtcgacggagtagaagtacacaatgcaaaaacaaaacccagagaagaacaatacaattcaacctatagagtagtctcagttctcactgtactacaccaagactggctaaacggaaaagaatataaatgcaaagtatctaacaaagcactaccagcacccatagaaaaaactatatcaaaagccaaaggccaacctagagaacctcaagtttacactctcccaccatcaagagaagaaatgacaaaaaatcaagtatctttaacatgcctagtaaaaggattctacccatcagacatagcagtcgaatgggaatccaacggacaaccagaaaacaactacaaaacaacaccaccagtactagactcagatggatcattcttcctatactctaaactcacagtagacaaatcaagatggcaacaaggaaacgtattctcatgctcagtaatgcatgaagcactacacaatcactacacacaaaaaagcttatccttatcaccaggtaaa

SEQ ID NO: 51147 - RNA, 1359 nt, synthetic construct
  misc_feature 1..1359: note = derived and/or modified sequence opt6 from anti-influenza_Chain
  source 1..1359: mol_type = other RNA
gaagtacaacttgtacaatcaggagccgaagtcaaaaaaccaggagaaagtttaaaaatatcttgcaaagtatccggatactccttcacatcacaatggataggatgggtaagacaaatgccaggaaaaggattagaatggatcggaatgatgtatccaggagactctgatgcaatatatagcccatcatttcaaggacaagtaacaatatcagcagacaattcaatatcaacagcatacctccaatggtcatctttaaaagcttcagatacagcaatatattattgcgcatcaggcccaggttatagcggctatcattacggatggttcgatacatggggacaaggtactctagtaacagtatcctctgcctcaacaaaaggaccttcagtatttccactagcaccatcatcaaaatcaacatcaggcggaaccgcagcattaggatgcttggtcaaagattacttcccagaaccagtaacagtatcctggaactcaggcgccctaacatcaggagtacacacattcccagcagtactccaatcgtctggactctactcattaagttctgttgtaacagttccctcatcttccctaggaacacaaacatatatatgcaacgtaaaccataaaccaagcaacaccaaagtagacaaaaaagtagaaccaaaatcatgtgacaaaacacacacatgcccaccatgtccagcacctgaactactagggggcccctctgtattcttattcccaccaaaaccaaaagatactttaatgatatctagaactccagaagtaacatgcgtagtagtcgacgtatcacacgaagatcccgaagtaaaatttaattggtacgtagacggagtggaagtacataatgccaaaacaaaacccagagaagaacaatataactcaacatacagagtagtttctgtattaacagttctacaccaagactggttaaacggaaaagaatacaaatgcaaagtatccaacaaagccttaccagcacctatagaaaaaacgatatcaaaagccaaaggacaaccaagagaaccacaagtatacactctaccaccatcacgagaagaaatgacaaaaaatcaagtatcactaacttgcttagtcaaaggcttctacccctccgatatagcagtagaatgggaatctaacggacaacccgaaaataactacaaaacaactcctccagtactagattctgacggatcattctttctatactcaaaactgaccgtcgataaatccagatggcaacaaggaaacgtattttcatgctcagtcatgcacgaagcactacataatcattatacacaaaaatcactaagcctatcgccaggaaaa

SEQ ID NO: 51148 - RNA, 1359 nt, synthetic construct
  misc_feature 1..1359: note = derived and/or modified sequence opt6 from anti-influenza_Chain
  source 1..1359: mol_type = other RNA
gaagtacaactagtacaatctggcgcagaagttaaaaaacccggagaatcattaaaaatttcttgtaaagtatccggatactcattcacaagtcaatggataggctgggtaagacaaatgccaggaaaaggccttgaatggataggtatgatgtaccctggagacacagataccatatactcaccttccttccaaggacaagtaacaatatcagcagacaactcaatatcaactgcttacttacaatggtcttcattaaaagcatcagacactgcaatatattactgcgcatcaggaccaggatactcaggttaccactatggttggtttgatacctggggccaaggaacattagtaaccgtatccagtgcatcaactaaaggaccatcagtattcccattagcaccatcatccaaatcaacatcaggtggaacagcagcattaggatgcctagtaaaagattactttccagaaccagtaacagtatcatggaactccggagccctaacctcaggagtacatacattccccgctgtacttcaaagctctggactatattcattatcttcagtagtaaccgtaccatcatcatcattaggaacacaaacatacatatgcaacgtaaatcacaagccatctaataccaaagtagacaaaaaagttgaaccaaaatcttgcgataaaacacacacatgcccaccatgcccagcgcccgaattattaggaggaccaagtgtatttctatttccaccaaaacctaaagatacactaatgatatcaagaacacctgaagtcacatgcgtagttgtagatgtaagccacgaagatccagaagtaaaatttaactggtacgtcgatggtgttgaagtacacaatgcaaaaaccaaaccaagagaagaacaatacaattcaacttaccgcgtagtttcagtattaactgtactacatcaagattggctaaacggaaaagaatacaaatgcaaagtatcaaacaaagctttacctgctccaatagaaaaaacaataagcaaagcaaaaggacaaccacgagaaccacaagtatataccctaccaccaagtagagaagaaatgacaaaaaaccaagtatcactaacatgcttagtaaaaggattttatccttctgacatagcagtcgaatgggaatccaacggacaaccagaaaacaactataaaacaaccccccctgttctagactcagacggatcattctttctatactcaaaactaacagtagataaatctagatggcaacaaggaaacgtcttctcctgctccgtcatgcacgaagcactacacaaccactatacacaaaaaagcctatcattatctccaggaaaa

SEQ ID NO: 51149 - RNA, 1359 nt, synthetic construct
  misc_feature 1..1359: note = derived and/or modified sequence opt6 from anti-influenza_Chain
  source 1..1359: mol_type = other RNA
gaagtacaacttgtacaatcaggagcagaagtaaagaaaccaggagaatctttaaaaatatcatgcaaagtatcaggatactcattcacaagtcaatggataggctgggtaagacaaatgccaggcaaaggactagaatggataggcatgatgtacccaggagaatcagacacaatatatagcccatcctttcaaggccaagtaacaatatcagcagacaactcaatttcaacagcatatctacaatggtcatcactaaaagcatccgataccgcaatctattactgtgcatcaggaccaggatattcaggataccattacggatggttcgacacatggggacaaggcactctagtaacagtatcatcagcaagcacaaaaggaccatcagtatttccattagcaccctcatcaaaatccacatctggaggaacagcagcactcggatgcttagtaaaagattacttcccagaacctgtcacagtttcatggaactcaggagcactaacatcaggagtacatacatttccagcagtattacaatcatccggactttactcactttcatctgtagtcacagtaccttcatcatcactcggaacacaaacctacatatgcaacgtaaaccacaaaccatcaaacacaaaagttgataagaaagttgaaccaaaaagttgtgataaaacacacacatgtcccccatgcccagcacccgaactactaggaggcccatcagtattcctatttcctcccaaaccaaaagacacactaatgataagtagaacaccagaagtaacctgcgtagtagtagacgtatcccacgaagacccagaagtaaaatttaactggtacgtagatggcgtagaagtacacaatgcaaaaacaaaaccacgagaagaacaatataatagtacataccgagtcgtatcagtattgacagtactacatcaagactggttaaacggaaaagaatataaatgtaaagtatcaaacaaagcattaccagcaccaatagagaaaacaatatcaaaagcaaaaggacaaccaagagaaccacaagtttatacactaccaccctcaagagaagaaatgaccaaaaaccaagtttcactcacatgcctagtaaaaggattctatccatccgatatagcagttgaatgggaatcaaatggacaaccagaaaacaattacaaaacaacacctcccgtcttggactcagacggatcatttttcctatattcaaaactaacagtagataaatcccgatggcaacaaggaaatgtattctcttgttcagtcatgcatgaagcattacataatcactacacacaaaaatccttatccttatctcccggaaaa

SEQ ID NO: 51150 - RNA, 1365 nt, synthetic construct
  misc_feature 1..1365: note = derived and/or modified sequence opt6 from anti-influenza_Chain
  source 1..1365: mol_type = other RNA
caagtacaattagtagaatcaggcggaggcgtagtacaaccaggaagaagcctacgattatcatgtgcagcctctggtttcgcattccacaatcgagcaatgcactgggtacgacaagcccccggaaaaggactagaatgggtagcattaatctatttcgacggaagtaaacaatactatgcagactcagttaaaggtagattcacaatatccagagacaattccaaaaacacagtattcctacaaatgaactctctacgaccagaagatacagcagtatactattgcgcagtaccaggacccatattcggcatattccctccttggtcctatttcgaccactggggccaaggtatattagtaactgtatcatcagcatccaccaaaggaccatcagtcttcccactcgcaccatcatcaaaatcaacctctggaggaacagcagccttaggatgtctagtaaaagattactttcctgaacccgtcacagtatcatggaactcaggagcattaacatctggagtacacacattcccagcagtactacaatcatcaggcttatactctctatcatcagtagtaacagtaccctcatcctcactcgggacacaaacatacatatgtaacgtaaatcacaaaccttccaatacaaaagtagataaaaaagttgaacccaaatcatgcgacaaaactcacacctgcccaccatgccctgcacctgaactactaggaggtccatcagtatttctattcccaccaaaaccaaaagacacattaatgatctcaagaacaccagaagtaacatgcgtcgttgtagacgtctcacatgaagacccagaagtaaaattcaattggtacgtagacggagttgaagtacacaacgccaaaactaaaccaagagaagaacaatataattcaacatatagagtagtatcagtactaaccgtattacaccaagactggctgaatggaaaagaatataaatgtaaagtatctaacaaagcactaccagctccaatagaaaaaacaatatcaaaagcaaaaggtcaaccaagagaaccccaagtatacacactacctccaagcagagaagaaatgaccaaaaaccaagtatcactaacatgcctcgtaaaaggtttttacccatcagatatagcagtagaatgggaatccaatggacaaccagaaaataattacaaaacaacaccaccagtattagactctgatggaagttttttcctatattcaaaactaacagtagataaatcacgatggcaacaaggaaacgtattctcatgctcagtcatgcacgaggcactacataaccactacacccaaaaatcactatcactatctccaggaaaa

SEQ ID NO: 51151 - RNA, 1365 nt, synthetic construct
  misc_feature 1..1365: note = derived and/or modified sequence opt6 from anti-influenza_Chain
  source 1..1365: mol_type = other RNA
gaagtacaactagtagaatctggcggaggagtagtacaaccaggaagatcactaagactgtcctgtgcagcatcaggctttgctttccacaatcgagcaatgcactgggttagacaagccccaggaaaaggactagaatgggtagcattaatatatttcgacggttcaaaacaatactatgcagactcagttaaaggtagatttacaatttcaagagataactcaaaaaacactgtattcctacaaatgaattcactacgtccagaagatacagccgtatattactgcgcagtaccaggaccaatatttggaatatttccaccatggtcatacttcgaccactggggacaaggaatattagtaacagtcagttccgcatcaacaaaaggaccatccgtatttccactagccccatcatcaaaatccacctcaggaggaactgcagctcttggttgcttagttaaagactattttccagaaccagtaacagtcagttggaactccggagcactaacatcaggagtacacacatttccagcagtattacaatcttcaggactatactcactatcatccgtcgttacagtaccatcatcatctttaggcacacaaacctacatatgcaatgtaaatcataaaccaagcaacaccaaagtagacaaaaaagtagaaccaaaatcatgcgacaaaacccacacctgtccaccatgcccagcaccagaactcctaggaggaccctcagtatttttattccctccaaaaccaaaagacactctaatgatttcccgaacaccagaagtaacttgcgttgtagtagatgtctcacacgaagatccagaagtaaaatttaactggtatgtagacggagtagaagtacacaatgcaaaaacaaaaccaagagaagaacaatacaactcaacatatcgagtagtatcagtattaaccgtattacatcaagattggttaaatggaaaagaatacaaatgcaaagtttcaaacaaagccttaccagcccccatagaaaaaacaatctctaaagcaaaaggccaaccaagagaaccacaagtatatacattacccccttcacgagaagaaatgactaaaaatcaagtatcactaacatgcttagtcaaaggattctatccttcagacatagccgtagaatgggaatcaaacggacaaccagaaaataattacaaaacaacaccaccagtccttgactcagatggatcattcttcctatatagtaaattgaccgtagataaaagtagatggcaacaaggaaacgttttctcgtgctcagtcatgcacgaagcactccacaatcactacacacaaaaatcactatctttatcaccaggcaaa

SEQ ID NO: 51152 - RNA, 1365 nt, synthetic construct
  misc_feature 1..1365: note = derived and/or modified sequence opt6 from anti-influenza_Chain
  source 1..1365: mol_type = other RNA
gaagtacaactagtacaatcaggaggcggagtagtacaacccggaaaatctctccgactatcatgcgcagcatctggattaactttctcatcatatgccgttcattgggtacgacaagcccctggtaaaggtctagaatgggtaacactcatatcatacgacggtgcaaaccaatactacgcagattccgtaaaaggtcgcttcacaatatctagagacaactcaaaaaacactgtatacctacaaatgaattcactaagaccagaagacacagctgtatattattgcgccgtaccaggcccagtattcggaatatttccaccatggtcatactttgacaattggggacaaggaatactcgtaacagtctcctccgcttctacaaaaggcccatccgtattcccattagcaccctcctcaaaatcaacatcaggcggtacagcagcactaggatgtctagtaaaagactacttcccagaacccgtcacagtatcatggaactcaggagcactaacatctggtgtccacacattcccagccgtcttacaatcttcaggactctattcattatcatcagtagtaacagtcccctcatcttcactaggaacacaaacttacatatgcaacgtaaatcataaaccatccaatacaaaagtagataaaaaagtagaaccaaaatcatgcgacaaaacccatacatgcccaccttgtccagcaccagaattactaggaggacctagtgtattcctattcccccctaaacctaaagacacactaatgatctcaagaacaccagaagtaacatgcgtagtagtagatgtctcacacgaagatccagaagtaaaattcaattggtacgtagacggagtagaagtacataacgcaaaaacaaaaccaagagaagaacaatacaactccacatatagagtcgtaagcgtattaaccgtacttcaccaagactggttaaacggaaaagaatacaaatgcaaagtatcaaacaaagccttacctgcccctatagaaaaaacaatatccaaagctaaaggacaacctagagaaccacaagtctataccctaccaccttcacgtgaagagatgacaaaaaatcaagtttccctaacttgcttagtaaaaggattctacccttcagacatagcagtcgaatgggaatccaacggacaaccagaaaacaactacaaaacaacacccccagtactagactcagacggttcattttttttatattcaaaactaacagttgacaaatcaagatggcaacaaggaaatgtattctcatgttccgtcatgcacgaagcactacacaatcactatacccaaaaatcattatcactatcacctggaaaa

SEQ ID NO: 51153 - RNA, 1365 nt, synthetic construct
  misc_feature 1..1365: note = derived and/or modified sequence opt6 from anti-influenza_Chain
  source 1..1365: mol_type = other RNA
caagtacaattagtagaatcaggcggaggagtagtccaaccaggaaaatcattaagactatcatgtgcagcatcaggactaacattttcttcttacgccgtacactgggttagacaagcaccaggaaaaggattagaatgggtcacattaatatcttacgacggagcaaaccaatactatgcagactcagtaaaaggtagattcacaatttctagagacaactcaaaaaacacagtatacttacaaatgaactctctacgacctgaagatacagctgtatattactgtgcagtaccaggaccagtattcggaatcttcccaccatggtcttatttcgacaattggggacaaggcatactagtaacagtctcctcagcatcaactaaaggaccatcagtatttccactagccccctcatccaaatctacatcaggaggaacagctgctctagggtgcttagtcaaagattactttccagaaccagtcaccgtttcatggaattcaggtgctctaacctccggagtacatacattcccagctgtactccaatcttcaggattatactcactcagttcagttgtaacagtaccatcatcaagtcttggtacacaaacatacatatgtaacgtaaaccacaaaccatccaatactaaagtagataaaaaagtcgaacctaaatcatgtgacaaaacacatacatgcccaccatgcccagcaccagaattattaggaggcccctcagtatttctattccccccaaaaccaaaagacacactaatgatttcaagaacaccagaagtaacatgtgtagtagtagatgtttctcatgaagacccagaagtaaaatttaattggtacgtcgatggcgttgaagtacacaacgcaaaaacaaaaccacgagaagaacaatacaactcaacttaccgagttgtatctgtattaaccgtattacatcaagactggctaaacggtaaagaatataaatgcaaagtttcaaataaagcactacccgcaccaatagaaaaaactatatctaaagccaaaggtcaaccaagagaaccacaagtatacacattaccaccaagcagagaagaaatgaccaaaaaccaagtttcattaacctgcctagtaaaaggattttatccttcagacatagcagtagaatgggaatcaaacggccaacccgaaaacaactataaaacaactccaccagtactagactctgacggaagcttttttctatacagcaaactcactgtcgacaaatcacgatggcaacaaggaaatgtattcagctgctccgtaatgcacgaagcgcttcacaatcattatacccaaaaatcactatcactatcccccggaaaa

SEQ ID NO: 51154 - RNA, 1365 nt, synthetic construct
  misc_feature 1..1365: note = derived and/or modified sequence opt6 from anti-influenza_Chain
  source 1..1365: mol_type = other RNA
caagtacaacttgtagaaagtggaggaggagtagttcaaccaggaaaatcaccaagattatcatgcgcagcatcaggacctactttttcatcatacgccgtccattgggtacgacaagctccaggaaaaggactagaatgggtcacactaatatcatacgatggagccaaccaatactacgcagactcagtcaaaggacgatttacaatatcacgcgacaactctaaaaataccgtttatttacaaatgaactcattaagaccagaagacaccgctgtatactactgcgcagtaccaggtccagtatttggtattttcccaccatggagctactttgataactggggacaaggaatattagtcacagtatcatcagcatcaacaaaaggaccatcagtattcccactagcaccatcatcaaaatccacatcaggaggcacagcagcattaggatgcttagtaaaagactattttcccgaaccagtaacagtatcatggaactctggcgctctaacctcaggtgtccatacatttccagcagtattacaatcaagcggtttatattcattatcatcagtagtaaccgtaccatcatcaagcctaggcacccaaacatacatctgcaatgttaaccacaaaccatcaaatacaaaagtagacaaaaaagtagaaccaaaatcctgtgacaaaacacacacatgtccaccctgtccagccccagaactactaggaggaccatcagtatttttattccccccaaaaccaaaagacacacttatgatatcacgcacacccgaagtcacatgtgttgtagtagacgtatcacacgaagatccagaagtaaaattcaactggtacgtcgacggtgtagaagttcataacgcaaaaacaaagccaagagaagaacaatataactcaacatacagagtcgtatcggtattaacagtattacatcaagactggttaaacggtaaagaatacaaatgtaaagtaagtaataaagccctacccgctcctatagaaaaaactatctccaaagccaaaggacaaccacgagaaccacaagtttatacactcccaccatcaagggaagaaatgactaaaaatcaagtatcactaacatgtttagtaaaaggattttacccatcagatatagcagttgaatgggaatctaatggacaacccgaaaacaactataaaacaacaccccccgtacttgactcagacggatcatttttcctatactcaaaattaactgtagataaatcacgatggcaacagggtaatgtcttttcatgttcagtaatgcacgaagcattacacaaccactatacacaaaaatcactatccttatcacccggaaaa

SEQ ID NO: 51155 - RNA, 1365 nt, synthetic construct
  misc_feature 1..1365: note = derived and/or modified sequence opt6 from anti-influenza_Chain
  source 1..1365: mol_type = other RNA
gaagtacaattagtcgaatctggtggaggcgtcgtacaaccaggaaaatccctcagactatcctgcgcagcatccggactaacattttcatcatatgcagtacactgggtaagacaagcacctggtaaagggctagaatgggtaacattaatatcgtacgatggtgcaaaccaatactacgcagactccgtaaaaggaagattcacaatatcacgagacaactcaaaaaacacagtatacctccaaatgaacagcctaagaccagaagatactgcagtatactactgtgcagttcctggaccagtattcggaatcttccctccgtggtcatacttcgataattggggacaaggtatattagtaacagtctcctcagcatcaacaaaaggaccctccgttttcccattagccccaagttcaaaatctacatcaggaggcacagcagctctaggatgtctcgtaaaagactatttcccagaaccagtaacagtaagttggaactccggtgcactaacctccggtgtacacacattccccgctgtactacaaagctcaggactatattccctatcatcagttgtaacagtaccatcctcatcccttggaacacaaacatacatttgtaacgtaaaccacaaaccatcaaacacaaaagttgataaaaaagttgaaccaaaaagctgcgacaaaacccatacttgccctccttgcccagccccagaactactaggaggaccatctgtatttctatttccaccaaaaccaaaagacacacttatgatttcaagaacaccagaagtaacctgcgttgtagttgacgtttcacatgaagacccagaagtaaaatttaactggtatgtagacggagttgaagtacacaacgcaaaaacaaaacctagagaagaacaatataactctacatatagagtagtaagcgtactaacagtactacaccaagattggcttaatggaaaagaatacaaatgtaaagtatcaaacaaagctctaccagcaccaatagaaaaaacaatatcaaaagctaaaggccaaccaagagaaccacaagtttacacactaccaccatctagagaagaaatgacaaaaaatcaagtatccctaacctgcctcgtaaaaggattctacccatccgacattgcagtagaatgggaatcaaacggtcaaccagaaaacaattacaaaaccacacctccagtactcgactcagacggctcattttttttatactcaaaactaaccgttgacaaatcacgatggcaacaaggaaacgtattcagctgctccgtaatgcacgaagcacttcataatcactatactcaaaaatcattatcattatcaccaggtaaa

SEQ ID NO: 51156 - RNA, 1365 nt, synthetic construct
  misc_feature 1..1365: note = derived and/or modified sequence opt6 from anti-influenza_Chain
  source 1..1365: mol_type = other RNA
caagtacaactcgtacaatcaggagcagaattaaaaagacccggagcatcagtaaaagtatcctgtaaaacatcaggctactcattcaataactacggtataaactgggtacgtcaagcccccggccaaggactagaatggatgggatggatatctgcatacacaggtaatacacactatgcaaaaaatttcgaaggaagagtaaccttaacaacagacacttcaacatcaaccgcatacatggaagtaagatcattaagatctgacgactcagcagtttatttttgcgccagagcaatgatacaaggcgtcgtaactttatacctaagacccggtgattactggggacaaggcacattagtaaccgtatcatcagcatcaacaaaaggaccatcagtatttcctctcgccccatccagcaaatcaacatcaggaggaacagcagcactaggatgcctagtaaaagattacttccccgaacccgtcacagtctcatggaactctggagccttaacctcaggagttcacacttttccagctgtattacaatcatctggtctatattctttatcatctgtcgtaacagtcccttcatcatccttaggaacacaaacttatatatgcaacgtcaaccataaacccagcaatacaaaagtagataaaaaagtagaaccaaaatcctgcgataaaacacacacatgtccaccatgcccagcaccagaattattaggaggtccctccgtatttctattcccccctaaaccaaaagacaccttaatgatttcaagaaccccagaagtaacatgtgttgtagtagacgtatcacatgaagatcctgaagtcaaattcaactggtatgtcgatggagtagaagtacacaatgccaaaaccaaaccacgagaagaacaatataattcaacatacagagtagtatcagtccttacagtactacaccaagattggcttaacggaaaagaatacaaatgcaaagtatcaaataaagcactccccgcaccaatagaaaaaacaatatcaaaagccaaaggacaaccaagagaaccacaagtctacacactaccaccctcaagagaagaaatgaccaaaaatcaagtatccttaacttgcctagtaaaaggcttttacccaagtgacatagcagtagaatgggaatcaaatggacaaccagaaaacaattacaaaactaccccacccgtcctcgattctgacggatcatttttcctctattccaaattaacagtagataaatcaagatggcaacaaggaaacgtattcagttgttcagtcatgcatgaagcattacacaaccactacacacaaaaaagcttatccttgtcaccaggaaaa

SEQ ID NO: 51157 - RNA, 1365 nt, synthetic construct
  misc_feature 1..1365: note = derived and/or modified sequence opt6 from anti-influenza_Chain
  source 1..1365: mol_type = other RNA
caagtacaactcgtagaatcaggtggaggagtagtacaaccaggaagatccctaagattatcctgcgccgcttctggattcgcatttcataaccgagccatgcactgggtaagacaagcacctggaaaaggcttagaatgggttgcgctaatatatttcgacggatctaaacaatattatgcagactctgttaaaggaagattcacaatatctcgcgacaactcaaaaaacacagtctttctacaaatgaactcattacgaccagaagacactgcagtatactactgtgccgtcccaggaccaatctttggaatcttccctccatggtcatacttcgaccattggggacaaggaatattagtaactgtaagctcagcatcaaccaaaggtccctcagtctttcccttagctccctcatcaaaatcaacatcaggtggaacagcagccttaggatgtttagtaaaagattattttccagaaccagtcacagtatcatggaactcaggagcattaacatctggcgtacacaccttccccgcagtactacaatcatccggactctactcactatcatcagtagtaaccgtaccttcatcaagtctgggaacacaaacatatatttgcaatgtaaatcacaaaccctctaatacaaaagtcgacaaaaaagtagaaccaaaatcatgcgacaaaacacacacttgcccaccatgcccagcaccagaactactaggaggcccatcagtattcctattcccacccaaaccaaaagacacattaatgatatcacgaacacccgaggtaacttgcgtagtagtagacgtaagccacgaagatccagaagtaaaattcaattggtacgtagacggagtagaagtacacaacgcaaaaacaaaacccagagaagaacaatacaactccacatacagagtagtatcagtactaactgtattacatcaagattggctaaacggaaaagaatataaatgtaaagtctccaataaagcactaccagcaccaattgaaaaaactatatcaaaagcaaaaggacaaccacgcgaaccacaagtatacacactaccaccatcaagagaagaaatgacaaaaaatcaagtatcactaacatgcctagtcaaaggtttctacccttcagacatagcagttgaatgggaaagcaacggacaaccagaaaacaactacaaaaccactccacctgtactagactcagacggctcattctttctatactcaaaactaacagtagacaaatccagatggcaacaaggaaatgtattctcatgctcagtaatgcacgaagcactacacaatcattacacccaaaaaagtctctcactatcaccaggtaaa

SEQ ID NO: 51158 - RNA, 1365 nt, synthetic construct
  misc_feature 1..1365: note = derived and/or modified sequence opt6 from anti-influenza_Chain
  source 1..1365: mol_type = other RNA
gaagtacaactagttgaatcaggaggcggagtagtacaacccggaagaagtctaagattatcctgcgcagcatcaggttttgcatttcacaatcgtgcaatgcactgggtccgtcaagcacccggaaaaggattagaatgggtagcactaatctacttcgatggatcaaaacaatactacgccgactccgtaaaaggaagattcacaatctcaagagacaactccaaaaacacagtattcttacaaatgaactcactacgcccagaagacacagcagtatattattgcgcagttcctggacccatattcggtatattcccaccatggtcttatttcgaccattggggccaaggaatattagtaacagtatcatcagcatcaacaaaaggaccatcagtattcccattagcaccctcatccaaatccacatccggaggtacagcagctctaggatgcctcgtaaaagattactttccagaaccagttacagtctcatggaactcaggcgctctaacctcaggcgtccacacattccccgcagtactacaatcctcaggtctttactcattatcgtcagtagttacagtaccctcatctagcttaggaacacaaacatacatctgtaatgtaaatcataaaccttcaaatacaaaagtagacaaaaaagtagaaccaaaatcttgcgacaaaacccatacatgcccaccatgcccagcaccagaacttttaggcggaccatcagtattcctattccctcccaaaccaaaagacacactaatgatttcaagaacaccagaagtaacttgtgtagtagtagacgtatcacatgaagatccagaagtaaaattcaattggtacgtagacggagtagaagtacacaacgcaaaaacaaaaccacgagaagaacaatacaactcaacatacagagtcgtatctgtattaacagtcctccaccaagactggctcaacggaaaagaatacaaatgcaaagtctcaaataaagcactacccgcaccaattgaaaaaacaatatctaaagcaaaaggacaaccacgtgaaccacaagtatatacacttccaccttccagagaagaaatgacaaaaaaccaagtatcattaacatgcttagtcaaaggcttttatcccagtgacatagcagtagaatgggaatcaaacggacaaccagaaaacaactacaaaacaaccccaccagttctcgattcagatggctcattcttcctatattccaaattaacagtagacaaatctagatggcaacaaggaaatgtattcagctgttcagtaatgcacgaagcactccacaaccattacacccaaaaatccctatcactatctccaggaaaa

SEQ ID NO: 51159 - RNA, 1365 nt, synthetic construct
  misc_feature 1..1365: note = derived and/or modified sequence opt6 from anti-influenza_Chain
  source 1..1365: mol_type = other RNA
gaagtacaattagtccaatccggaggaggagtagtacaaccaggaaaatcactacgcttatcatgcgcagcttccggcttaacattctcatcatacgctgtacattgggtacgacaggcacctggaaaaggacttgaatgggtaacattaatatcctacgatggcgctaaccaatactacgcagacagcgtaaaaggtagattcacaatatctagagataactctaaaaatacagtttacctacaaatgaatagtttaagacccgaagacacggcagtttattactgcgcagttccaggacctgtattcggaatattcccaccatggtcatactttgataactggggacaaggaatcctagtaacagtctcctcagcttcaacaaaaggaccatcagttttcccattagcaccatcctcaaaatcaacttcaggaggaacagcagcactcggatgcctagtaaaagactatttcccagaaccagttacagtaagctggaactctggagcactaacatcaggagtacatacctttccagccgtactacaatcatcaggactatactccctatcttccgttgtcacagtaccttcatcatcactaggcacacaaacatatatatgcaacgtaaaccacaaaccatcaaacacaaaagtagacaagaaagtagaacccaaatcctgcgacaaaacccatacctgcccaccatgcccagctccagaattactaggaggaccatcagtattcctattcccaccaaaacccaaagacaccttaatgatctcaagaacacctgaagtaacatgcgtagtagtagatgtttcacacgaagatcccgaagtaaaattcaactggtatgtagatggagtagaagtacacaatgccaaaactaaaccaagagaagaacagtataactcaacatacagagttgtatcagtccttaccgtattacaccaagactggttaaacggaaaagaatacaaatgcaaagtatcaaacaaagcacttcccgctccaatagaaaagacaatatcaaaagcaaaaggacaaccaagagaaccacaagtatacactttacctccatctagagaagaaatgactaaaaatcaagtatcattaacatgcttagtcaaaggattttacccatcagacatagcagtagaatgggaatcaaacggtcaacccgaaaataactacaaaacaacaccaccagtactagactcagacggttcattctttctatattcaaaattaacagtagataaatcaagatggcaacaaggcaacgtcttttcatgttcagtaatgcatgaagccttacacaaccactacacccaaaaatcattatcattaagcccaggaaaa

SEQ ID NO: 51160 - RNA, 1365 nt, synthetic construct
  misc_feature 1..1365: note = derived and/or modified sequence opt6 from anti-influenza_Chain
  source 1..1365: mol_type = other RNA
caagtacaactcgtagaaagcggcggaggagtagtacaaccaggcaaatccctacgcttatcatgtgctgcaagtggactcacattttcctcctacgcagtacactgggtacgacaagcacccggtaaaggactagaatgggtaactttaatctcctacgacggagcgaaccaatactatgccgattctgtaaaaggaagatttacaatatcaagagacaatagcaaaaacaccgtatacctacaaatgaattctctaagaccagaagacacagcagtatactactgcgcagtacccggaccagtctttggaatatttccaccctggtcatacttcgacaactggggacaaggaatactagtaacagtatcaagtgcatcaacaaaaggaccctcagtatttcctttagcaccatcttcaaaaagcacttcaggaggaacagcagcattaggatgtttagtaaaagactacttccctgaacccgtcacagtatcatggaattcaggagcactaactagtggagtccatacattcccagcagtactacaatcatcaggattatattccctatcatcagtcgtaacagtaccatccagttcattaggaacccaaacatatatctgcaacgtaaaccacaaaccctcaaatacaaaagtagataaaaaagttgaacccaaatcatgcgacaaaacacacacttgcccaccatgccccgccccagaattactaggtggcccatcagtattcctattccctccaaaaccaaaagacacccttatgataagcagaacaccagaagtaacttgtgtagtagtagacgtatcccatgaagacccagaagtcaaattcaactggtacgtagacggcgtagaagttcacaatgcaaaaaccaaaccaagagaagagcaatataacagcacatatcgagtagtatcagttctcaccgtactacaccaagactggctaaacggaaaagaatacaaatgtaaagtctcaaacaaagctctacctgcaccaatagaaaaaacaatctctaaagcaaaaggacaacctagagaaccacaagtatacacactaccaccatcaagagaagaaatgaccaaaaatcaagtttccctaacatgtctcgtaaaaggcttttaccctagtgacatagcagtcgaatgggaatcaaatggacaaccagaaaacaattacaaaacaacaccaccagtcctagactcagacggatccttttttttatactcaaaattaacagtagacaaatcacgatggcaacaaggaaacgtattctcttgctcagtaatgcacgaagcattacataatcattacactcaaaaatcactgtcactaagcccaggaaaa

SEQ ID NO: 51161 - RNA, 1365 nt, synthetic construct
  misc_feature 1..1365: note = derived and/or modified sequence opt6 from anti-influenza_Chain
  source 1..1365: mol_type = other RNA
caagtacaacttgtagaatcaggcggcggagtagtacaaccaggaaaaagccctcgattatcttgtgcagcatctggaccaaccttttcctcatatgcagtacactgggtaagacaagcaccaggaaaaggattagaatgggtaactctaatatcatacgacggtgccaaccaatactacgcagactcagttaaaggtcgttttactatatcaagagacaactccaaaaataccgtatacctacaaatgaactcattaagaccagaagacaccgcagtatactattgcgctgttccaggacccgtttttggcatattcccaccatggtcttactttgataattggggtcaaggaatattagttactgtaagctccgcatcaaccaaaggaccatcagtatttccactagccccatcatctaaaagcacaagcggaggaacagctgcactcggatgtctcgtaaaagactactttcccgaaccagttactgtttcatggaactccggagctctaacatcaggcgtacataccttcccagctgtattacaatcatcaggattatactctctctcatcagtggtcacagtaccttcttcatcactagggacacaaacatacatctgtaacgtaaaccataaaccatcaaatacaaaagtagacaagaaagttgaaccaaaaagctgtgacaaaacacatacatgtcccccatgcccagcacctgaactattaggaggaccctccgtattcctatttccaccaaaacccaaagatacactaatgatatctagaacaccagaagtaacatgcgttgtagtagacgtctcccatgaagaccccgaagtaaaattcaactggtatgtagatggcgttgaagtacacaacgcaaaaaccaaaccccgagaagaacaatacaatagcacatatagagtagtttcagtactcactgtattacaccaagattggctaaacggaaaagaatataaatgtaaagtctcaaacaaagcactaccagcaccaatagagaaaacaatatcaaaagccaaaggacaaccaagagaaccacaagtatatacattaccaccatccagagaagaaatgaccaaaaatcaagtatcattaacatgtttagtaaaaggattttacccatcagatattgcagtagaatgggaatccaacggacaaccagaaaacaactacaaaacaacaccccctgtattagactcagacggttctttctttttatactcaaaactaacagtagataaatcacgatggcaacaaggtaacgtatttagttgttcagtcatgcacgaagccttacacaatcattatacacaaaaatctttatcattatcaccaggaaaa

SEQ ID NO: 51162 - RNA, 1365 nt, synthetic construct
  misc_feature 1..1365: note = derived and/or modified sequence opt6 from anti-influenza_Chain
  source 1..1365: mol_type = other RNA
gaagtacaattagtagaatcaggaggaggagtcgtacaacccggaaaatcactacgcctaagctgtgcagcatcaggactaacattctcatcttatgcagtccattgggtaagacaagcaccaggaaaaggattagaatgggtaaccttaatatcatatgacggtgctaaccaatactacgccgactccgttaaaggacgattcacaatatcaagagataactcaaaaaatacagtctacttacaaatgaattcactacgtcccgaagatacagcagtttattattgcgcagtaccaggtcccgtattcggaatatttccaccatggtcatactttgacaattggggtcaaggaatactcgttacagtatctagcgcatcaacaaaaggaccttctgtattcccactagcaccatcatctaaatcaacctcaggaggtacagccgcactaggttgtttagtaaaagactatttcccagaacctgtaacagtatcttggaactccggagcattgacctctggagttcacacatttcccgctgtacttcaatcatctggactttattctttatcctctgtagttaccgtaccatcaagctcactaggaacacaaacatacatatgtaacgttaaccataaaccctcaaacacaaaagtagacaaaaaagtcgaacccaaatcatgtgacaaaacacatacatgcccaccatgcccagcaccagaactcttaggaggtccttccgtattcctttttcctccaaaacctaaagacacccttatgatttcaagaacaccagaagtaacctgcgtagtagttgacgtatctcacgaagacccagaagtaaaattcaactggtatgtcgacggagtagaagtccacaatgcaaaaactaaaccaagagaagaacaatacaatagcacataccgagtagtatctgtcttaacagtactacatcaagactggctaaacggaaaagaatacaaatgcaaagtatcaaacaaagcactaccagcaccaatagaaaaaacaatatccaaagccaaaggacaaccaagagaaccacaagtatacacactaccaccatcaagagaagaaatgacaaaaaatcaagtatcactcacatgtttagtaaaaggtttttacccatcagacatagcagtagaatgggaatctaatggtcaaccagaaaataattacaaaacaactcctcctgtcttagactcagacggatcttttttcctatactcaaaattaacagtagataaatcaagatggcaacaaggaaacgtattcagctgttcagtaatgcacgaagccctacacaatcactacacacaaaaaagtctctcactctcacccggaaaa

SEQ ID NO: 51163 - RNA, 1365 nt, synthetic construct
  misc_feature 1..1365: note = derived and/or modified sequence opt6 from anti-influenza_Chain
  source 1..1365: mol_type = other RNA
caagtacaactagtacaatccggagcagaattaaaacgaccaggtgcatccgtaaaagtatcatgtaaaacttcaggatacagtttcaataactacggaatcaattgggtcagacaagcaccaggacaaggattagaatggatgggctggatctccgcttacaccggaaatacacactatgcaaaaaactttgaaggaagagttacacttacaacagatacttcaacatcaactgcatacatggaagtacgctcactaagatcagatgactcagccgtatacttttgcgccagagcaatgatacaaggagtagtaaccctctacctaagaccaggagattattggggccaaggtacattagtaacagtatcctcagcatccacaaaaggcccatccgtattccccctagccccatcatctaaatccacatctggaggaacagcagcactcggatgcctagtaaaagattattttccagaacccgtaacagtatcatggaactcaggagctctcacatcaggcgtacacacatttcccgcagtactacaaagctccggattatactcattatcatctgtagtaacagtaccatcctcttcattaggaacacaaacctacatatgcaacgttaatcataaaccatcaaacacaaaagtagataaaaaagtagaaccaaaatcatgcgacaaaacacacacatgtccaccatgcccagccccagaacttttaggtggaccttccgtctttttatttccacccaaaccaaaagatacattaatgataagcagaacaccagaagtcacctgtgtagttgtagacgtatcacacgaagacccagaagtaaaatttaactggtacgtagatggagtagaagtacataacgcaaaaacaaaaccaagagaagaacaatataactcaacatacagagtagtaagtgtcctcacagttctacaccaagactggctcaatggtaaagaatataaatgcaaagtatcaaacaaagccctccctgcaccaatagaaaaaacaatttccaaagccaaaggacaaccaagagaaccacaagtatacacattacctccatcccgagaagaaatgaccaaaaatcaagtatcactaacctgcctagtaaaaggattctacccatcagacattgcagtcgaatgggaaagcaatggacaaccagaaaacaactacaaaacaacaccaccagtactagattcagacggaagtttctttctatactccaaattaaccgtagacaaatccagatggcaacaaggaaacgtattttcatgttcagtaatgcacgaagcattacacaaccactatacacaaaaatcactatcactcagcccaggaaaa

SEQ ID NO: 51164 - RNA, 1368 nt, synthetic construct
  misc_feature 1..1368: note = derived and/or modified sequence opt6 from anti-influenza_Chain
  source 1..1368: mol_type = other RNA
gaagtccaacttgtacaaagcggaggaggagtagtacaaccacgaagatcattaagactatcttgtgcagcttcaggattcacattctcttcatatgcaatgcattgggtaagacaagcacctggaaaaggccttgaatgggttgcagtaatatcctacgatggtagaaacaaatattatgcagattcagttaaaggacgatttacagtcagcagagacaactcaaaaaacactctttacctccaaatgaattcactacgcgcagaagatacatctgtatactactgcgcaagagaattactaatggattactatgaccatattggatactcacccggaccaacatggggacaaggtaccttagtcaccgtatcttccgcatccacaaaaggaccttctgtatttccactagccccatcatcaaaatcaacttctggaggaactgcagccctaggatgcctagtaaaagattatttccccgaaccagtaacagttagctggaattcaggagcattaacctccggagttcacacattcccagccgttttacaatcctcaggcctctattcattatcctcagtcgtaacagtaccttcatcatctttaggaacacaaacctacatatgcaacgtaaaccacaaaccctcaaatacaaaagtagacaaaagagtcgaacctaaatcatgtgataaaacacatacttgccctccatgcccagcaccagaattattaggaggaccctcagtatttctatttcccccaaaaccaaaagacacacttatgatcagcagaacaccagaagtaacatgcgtagtagtagatgtatctcacgaagacccagaagtaaaattcaattggtatgtcgacggagtagaagtacacaacgcaaaaacaaaacccagagaagaacaatataactccacctatcgagtagtctctgtattaacagtcttacaccaagattggttaaatggaaaagaatataaatgtaaagtaagtaacaaagcattacctgcaccaatagaaaaaacaatatcaaaagctaaaggacaaccaagagaaccacaagtatatacactacccccatcaagagaagaaatgacaaaaaatcaagtatcactaacatgtctagttaaaggattctacccctctgacatagctgtagaatgggaatcaaacggacaacctgaaaacaattacaaaacaacaccaccagtattagattcagatggatcatttttcttatattcaaaactaacagttgacaaatctagatggcaacaaggaaatgttttttcatgctcagtaatgcacgaagctctacataaccattacacacaaaaatcactttcactatcccccggaaaa

SEQ ID NO: 51165 - RNA, 1371 nt, synthetic construct
  misc_feature 1..1371: note = derived and/or modified sequence opt6 from anti-influenza_Chain
  source 1..1371: mol_type = other RNA
atggtaatacaaaggaacagtatactactactaatcatcatattcgcatcatcaatatcaacatgtcgatcaaacgtaatagatgacaacctatttaaacaagtatacgacaacatactagaacaagaatttgcccacgacttccaagcatatttaagctacctatcgaaaaacatagaaagtaataataacatagataaagtagataaaaatggaataaaagtaataaacgtactatcgttcggagcaaaaggagatggaaaaacctatgacaacatagcattcgaacaagcatggaacgaagcatgttccagtagaacccccgtacaattcgtagtacccaaaaacaaaaactacctattaaaacaaataacattttcaggaccatgtagatcctcaatatcagttaaaattttcggatctttagaagcaagctcaaaaatatcagactacaaagacagacgattatggatagcctttgactcagtacaaaatctagtagtcggcggaggtggaacaatcaacggaaacggccaagtatggtggccatcatcatgcaaaataaataaatctttaccttgcagagacgcaccaaccgccctaaccttctggaactgcaaaaacctaaaagtaaacaacctaaaaagtaaaaacgcacaacaaatacacataaaattcgaatcatgcacaaacgtagtagcatcaaacttaatgataaacgcatcagcaaaatcaccaaacacagatggagtacatgtatcaaacacacaatacatacaaatatcagacacaataataggaacaggagacgactgcataagcatagtaagcggatcacaaaacgtacaagcaaccaacataacatgtggcccaggacacggaatatctataggcagcctcggctcaggaaacagcgaagcatacgtatcaaacgtaacagtaaatgaagcaaaaataataggagcagaaaacggagtccgaataaaaacctggcaaggaggatcaggacaagcaagcaatattaaattcctgaacgtagaaatgcaagacgtaaaatacccaataataatagatcaaaattactgcgacagagtcgaaccctgcatccaacaattcagcgcagtccaagttaaaaacgtcgtatatgaaaatataaaaggaacttcagcaacaaaagtagcaataaaattcgactgcagtacaaattttccatgtgaaggaataataatggaaaacataaacctcgtaggagaaagcggaaaaccatcagaagcaacatgcaaaaatgtacactttaataacgccgaacacgtaacaccacactgtacatctctagaaatatcagaagacgaagcactactatacaattac

SEQ ID NO: 51166 - RNA, 1371 nt, synthetic construct
  misc_feature 1..1371: note = derived and/or modified sequence opt6 from anti-influenza_Chain
  source 1..1371: mol_type = other RNA
atggttatacaaagaaactcaatactactactaataataatattcgcatcatctatatcaacatgtagatcaaacgtaatagacgataatttatttaaacaagtatacgacaacatattagaacaagaatttgcacacgacttccaagcatacctatcatacctttctaaaaatatagaatcaaacaataatatagacaaagttgacaaaaacggtataaaagtaataaacgtactatcattcggagcaaaaggtgacggaaaaacatatgacaacatagcattcgaacaagcatggaacgaggcttgctcatcacgaactcctgtacaattcgtagtccctaaaaataaaaactacttattaaaacaaatcacattctcaggtccatgcagatcatcaatatcagtaaaaatcttcggatctttagaagcatcatcaaaaataagcgactacaaagaccgacgactatggatagccttcgactcagtacaaaatctagtagtaggaggaggaggaaccataaacggaaacggccaagtatggtggccatcaagctgtaaaattaacaaatcactaccatgcagagacgcaccaacagccctaactttctggaactgtaaaaacttaaaagtaaataacctaaaaagcaaaaacgcccaacaaatacacataaaattcgaatcatgcacaaatgtggtagcaagcaacctaatgataaacgcatctgcaaaaagcccaaacacagacggagtccacgtctccaatacacaatatatacaaatctcagacacaatcataggaacaggagacgactgtatatcaatagtctctggatcacaaaatgtacaagcaaccaacattacatgcggaccaggacacggaatatcaataggatcattaggatcaggaaattcagaagcatatgtatcaaacgttacagtaaacgaagcaaaaataataggagcagaaaacggagtaagaattaaaacttggcaaggaggtagcggacaagcctcaaacataaaatttctaaacgtagaaatgcaagatgtcaaatacccaatcataatcgatcaaaactattgtgacagggtagaaccatgtatacaacaattttcagcagtacaagtcaaaaacgtagtatatgaaaatatcaaaggtacaagtgcaactaaagtagcaattaaattcgattgctctaccaacttcccatgcgaaggaataatcatggaaaatataaacctagtaggagaatcaggaaaaccatccgaagccacatgcaaaaacgtacacttcaacaatgcagaacacgtaacaccacattgcacatcactagaaataagtgaagacgaagcactactatacaactac

SEQ ID NO: 51167 - RNA, 1380 nt, synthetic construct
  misc_feature 1..1380: note = derived and/or modified sequence opt6 from anti-influenza_Chain
  source 1..1380: mol_type = other RNA
atgaaattatggctaaattggatcttcttagtaacactcctaaacgatatacaatgcgaagtaaaacttgttgaatcaggtggaggattagtccaaccaggaggatctttaagattatcctgcgcaacctctggatttacattttcagactactatatgtcatgggtaagacaatcaccaggaaaagcactagaatggctaggatttacaagatctagagtactaggatacacaacagattattccgcatcagtaaaaggaagattcactatatcaagagataactcacaatcaatactttacttacaaatgaactcactaagaggagaagattcagcaacttactattgcgcgagagatagaccaatggattactggggacaaggaacttcagtaacagtctcatcagcaaaaacaaccccaccctcagtataccctctagcccccggatcagccgcacaaacaaattctatggtcacactaggctgcttagtcaaaggttatttcccagaaccagtaactgtaacatggaattcaggatccttaagcagtggagtacacacattccccgcagtcctacaatcagatctctatacactatcatcatccgtaacagtaccatcttccacatggccttccgaaacagttacatgcaacgtagcacatccagcatcatcaacaaaagtagacaaaaaaatagtacccagagactgcggatgtaaaccttgcatatgtacagtacctgaagtttcatccgtctttatattcccaccaaaaccaaaagacgtactaacaataacactaacaccaaaagtaacatgtgtagtagtagatatatcaaaagatgaccctgaagtacaattttcatggtttgtagatgacgtagaagtacatacagcacaaacacaaccaagagaagaacaattcaattcaactttcagaagtgtaagcgaactaccaattatgcatcaagattggttaaatggcaaagaatttaaatgtagagttaactcagcagcattcccagcacccatagaaaaaacaatatcaaaaacaaaaggaagaccaaaagcaccacaagtatacacaataccaccaccaaaagaacaaatggcaaaagataaagtttcattaacatgcatgataactgacttctttccagaagacattacagtagaatggcaatggaacggccaaccagcagaaaattataaaaatacacagccaatcatggacaccgacggaagttacttcgtatattcaaaattaaatgttcaaaaaagtaactgggaagccggcaatacctttacatgttcagtactacatgaaggtttacataatcatcacacagaaaaatcactgtcacactctccaggaaaa

SEQ ID NO: 51168 - RNA, 1380 nt, synthetic construct
  misc_feature 1..1380: note = derived and/or modified sequence opt6 from anti-influenza_Chain
  source 1..1380: mol_type = other RNA
atgaaactatggttaaattggatttttttagttacattattaaatgacatacaatgcgaagtaaaattagtagaaagtggaggaggactcgtccaaccaggaggatctctacgactatcttgcgcaacatccggattcaccttttccgactactacatgtcttgggtacgccaatcaccaggaaaagcattagaatggttaggatttaccaggtcaagagtattaggatatacaaccgactactcagcatcagtaaaaggcagattcacaatatcacgagacaattcccaatctatattatacttacaaatgaactcattaagaggagaagattctgcaacatattactgtgcacgagatagaccaatggattactggggtcaaggaacttcagtcaccgtatcaagcgcaaaaaccactccaccatcagtctaccccctagcaccaggatccgcagcacaaactaattcaatggtcactctaggatgcctagtaaaaggttacttcccagaacctgtaaccgtaacctggaattcaggatcattatcctccggcgtacacaccttccctgcagtactccaatccgatctatatacactatcttcatcagtaactgtaccatcatcaacatggccctcagaaacagtaacatgtaacgtagcacatccagcttcatcaaccaaagtagataaaaaaatagttccaagagactgtggatgtaaaccttgcatatgtacagtaccagaagtatcatcagtctttatatttccaccaaaacccaaagatgtcttaacaataactttaacacctaaagtaacatgtgtagtcgtagatatctcaaaagatgacccagaagtccaattttcatggttcgtagatgatgtagaagttcatacagcacaaactcaaccaagagaagaacaattcaactcaacctttagatccgttagtgaattaccaataatgcaccaagactggttaaacggaaaagaatttaaatgcagagtaaatagtgccgcattccctgcccctatcgaaaaaacaatatctaaaacaaaaggaagaccaaaagcaccacaagtctatacaataccaccacccaaagaacaaatggcaaaggacaaagtatcattaacctgtatgattacagacttctttccagaagacattaccgtagaatggcaatggaacggtcaacctgcagaaaactacaaaaacacacaaccaataatggatacagacggatcatatttcgtctactccaaactaaatgtccaaaaatctaactgggaagcaggaaataccttcacttgttcagttttacatgaaggcttacacaaccatcacactgaaaaatcactttcacactctcccggcaaa

SEQ ID NO: 51169 - RNA, 1386 nt, synthetic construct
  misc_feature 1..1386: note = derived and/or modified sequence opt6 from anti-influenza_Chain
  source 1..1386: mol_type = other RNA
atggaatggagctggatatttctatttctattatcaggaacagcaggagtacattcagaagttcaattacaacaatccggaccagaacttgtaaaaccaggagcaagcgtaaaaatgtcatgcaaagcttcaggatacacattcacatcatacgttatgcactgggtaaaacaaaaaccaggacaaggactcgaatggataggatatataaacccctataacgacggaaccagatacaatgaaaaattccgagtaaaagcaacactaacaagcgacaaatcatcatcaacagcatacatggaattatcatcactaacaagtgaagactccgccgtttattactgcgcaagaagaggactaataacaacaccaacattagattactggggtcaaggcactacattaacagtatcctcagcaaaaacaacacctccatccgtatatccattagccccaggatccgcagcacaaacaaattcaatggttactttaggctgcctcgtaaaaggatatttccccgaacctgttaccgtaacatggaattctggatcattatcatccggagtacacacttttccagcagtactacaaagcgacttatacacactaagctcatcagtaacagtaccatcctctacatggccatctgaaaccgtaacatgcaacgtagcacaccctgcatcatcgacaaaagtagacaaaaaaattgtaccaagagattgcggatgcaaaccctgtatatgcacagtcccagaagtatcatccgtctttatcttccccccaaaaccaaaagacgtattaaccataaccttaaccccaaaagtaacttgcgtagtagttgacatatcaaaagacgacccagaagtacaattctcatgggtagacgacgtagaagtacacactgcacaaacacaaccaagagaagaacaatttaactcaacattcagatcagtttcagaactaccaataatgcaccaagactggcttaatggaaaagaattcaaatgccgagtcaactcagcagcattcccagccccaatcgaaaaaacaataagcaaaacaaaaggaagaccaaaagcaccacaagtatacacaattccacccccaaaagaacaaatggcaaaagacaaagtatctctaacatgtatgattacagactttttcccagaagatatcacagtagaatggcaatggaacggacaaccagcagaaaattacaaaaacacccaaccaataatggacactgacggatcatacttcgtatactcaaaattgaatgtacaaaaatcaaactgggaagcaggaaacacattcacatgtagcgtcttacacgaaggattacacaaccatcatacagaaaaatctttatcacactcaccaggaaaa

SEQ ID NO: 51170 - RNA, 1386 nt, synthetic construct
  misc_feature 1..1386: note = derived and/or modified sequence opt6 from anti-influenza_Chain
  source 1..1386: mol_type = other RNA
caagtacaactcgtccaatccggcgcagaagtaaagaaaccaggcgcatcagtcaaagtctcatgcaaaacctcaggctacacattcacagcctacacaatccactgggtaagacaagcaccaggacaaagactagaatggatgggatggataaacgcaggaaacggacacacaaaatactcacaaagattcaaaggaagggtcacaatcaccagagatacatctgcaagaacaacatacatggaattaagatcactaacatcagaagatactgcattatacttctgcgcaagaggacccgaaacatactactatgacaaaaccaactggttaaactcacatcctgacgaatacttccaacattggggacacggcacacaagtaacagtctcatctgcatctacaaaaggaccatcagtattcccactcgcaccatcatccaaatcaacatcaggaggaactgcagccttaggctgccttgtaaaagattactttccagaaccagttacagtatcatggaactctggagcactaacctcaggagtacacactttcccagctgtacttcaatcctcaggcttatactcactatcatcagtagtaacagtaccctcctcatcactcggcacacaaacctatatatgtaacgtaaaccacaaaccatcaaacaccaaagtagacaagaaagtcgaacctaaatcatgtgacaaaacacatacatgccctccatgtccagcacccgaattattaggcggaccatcagtatttctattcccaccaaaacccaaagacacattaatgatatcaagaacaccagaagtaacatgcgtagtagtagacgtatcacacgaagatcccgaagtaaaatttaactggtatgtcgacggagtagaagtccataatgccaaaaccaaacccagagaggaacaatacaattctacttaccgagtcgtatcagtattaacagtcctacatcaagattggctaaacggtaaagaatacaaatgtaaagtaagtaataaagcactaccagcaccgatagagaaaaccatatccaaagcaaaaggacaaccaagagaaccacaagtatacacattaccaccatcaagagacgaattaaccaaaaatcaagttagcctaacatgcctcgttaaaggattctatccttcagatatagccgtagaatgggaatccaacggacaaccagaaaacaactacaaaacaacacctccagtactagactctgacggctccttcttcctatacagtaaattaaccgtagataaatcaagatggcaacaaggtaacgtattctcatgctccgtaatgcacgaagcattacacaaccattacacacaaaaatcattatcattatccccaggaaaa

SEQ ID NO: 51171 - RNA, 1386 nt, synthetic construct
  misc_feature 1..1386: note = derived and/or modified sequence opt6 from anti-influenza_Chain
  source 1..1386: mol_type = other RNA
caagttcaattagtacaatccggagccgaagtcaaaaaacctggagccagtgtaaaagtctcatgtaaaacaagtggatacacatttactgcatacacaatacactgggtaagacaagcacccggccaacgactagaatggatgggctggattaatgcaggaaatggtcacacaaaatattctcaaagattcaaaggaagagtcacaataacccgagacacatcagccagaacaacatacatggaattaagatccttaacatctgaagacacagctttatacttctgcgcaagaggacccgaaacatactactatgacaaaacaaactggctcaactcacatccagacgaatactttcaacattggggtcacggcacacaagtaacagtctcttcagcatcaacaaaaggaccttccgttttcccactagcaccatcatccaaatcaacctcaggaggaacagcagcattaggatgtttagtaaaagactacttccctgaaccagtaacagtatcatggaatagcggagcattaacatccggagttcacacatttccagcagtcttacaatcatcaggattatattctctctcaagcgtagttaccgtaccatcctcaagcctcggaacccaaacatatatatgcaatgtaaaccacaaaccatccaatacaaaagtagacaaaaaagtagaaccaaaatcttgcgacaaaacacacacctgcccaccatgtcccgcaccagaactattaggaggtccatcagtatttctatttccccctaaaccaaaagatactcttatgatatcaagaacaccagaagttacctgtgtagttgtagatgtatcacacgaagacccagaagtcaaatttaactggtacgtagacggagtagaagtccataacgcaaaaacaaaaccaagagaagaacaatacaattcaacatatagagtagtatcagtactaacagtcttacaccaagactggttaaacggaaaagaatacaaatgtaaagtatccaataaagctttaccagctccaatagaaaaaaccataagcaaagctaaaggacaaccacgagaaccacaagtctacacattaccaccctccagagatgaactaaccaaaaatcaagtctcattaacatgtcttgttaaaggcttctatccatcagacatagcagtagaatgggaatcaaacggtcaaccagaaaataattacaaaacaactccaccagtcttagactccgacggatcctttttcttatacagtaaactaacagtagacaaatcccgatggcaacaaggaaacgtattcagctgcagtgtcatgcacgaagctctccacaaccactacactcaaaaatccctatcattatcaccgggcaaa

SEQ ID NO: 51172 - RNA, 1386 nt, synthetic construct
  misc_feature 1..1386: note = derived and/or modified sequence opt6 from anti-influenza_Chain
  source 1..1386: mol_type = other RNA
atggaatggtcatggatcttcttatttctcctatcaggaactgcaggtgtacattcagaagtccaactacaacaatccggacctgaactagtaaaaccaggcgcctccgtaaaaatgtcttgcaaagcatccggttacacctttacaagctacgtaatgcactgggttaaacaaaaacccggacaaggtctagaatggatcggatacataaacccatataatgacggaacaagatacaatgaaaaattcagagttaaagcaacactaacaagcgataaatcatcatcaaccgcatacatggaattatcatccctaacatcagaagactcagcagtatactactgcgcacgacgaggactaataacaacacctactttagactactggggtcaaggaactacattaacagtatcctcagcaaaaacaacaccaccaagtgtatacccactagcacccggatcagcagcacaaaccaactctatggtaacattaggatgtttagtcaaaggctacttcccagaaccagtaacagtaacatggaattctggatcattatcctcaggagtacacacattccccgcagtcctacaatccgacttatatacattatcctcaagcgtaacagtaccatcatccacatggccaagcgaaacagtaacatgcaacgtagcccatccagcatcatctacaaaagtagacaaaaaaatagtcccaagagactgcggttgcaaaccttgcatatgcacagtaccagaagtatcaagcgtttttattttccccccaaaacctaaagacgtgctaaccattacattaacaccaaaagtaacatgtgtcgtagtagatatatcaaaagatgatcccgaagtacaattcagctgggtcgatgacgtagaagtccatacagcccaaactcaaccacgagaagaacaatttaactccacattcagatcagtatctgaactaccaataatgcaccaagactggcttaacggcaaagaattcaaatgtagagtaaactcagcagcattccccgcacccatagaaaaaacaataagcaaaacaaaaggccgaccaaaagcaccacaagtatacacaatcccaccaccaaaagaacaaatggcaaaagataaagtatccctaacatgtatgataaccgacttcttcccagaagatataacagtcgaatggcaatggaacggacaacccgcagaaaactacaaaaatacccaaccaataatggatacagacggatcctacttcgtatattccaaacttaacgtacaaaaatctaactgggaagccggaaatactttcacatgctccgtcctacacgaagggttacacaaccaccacacagaaaaatctctttcacattcaccaggaaaa

SEQ ID NO: 51173 - RNA, 1398 nt, synthetic construct
  misc_feature 1..1398: note = derived and/or modified sequence opt6 from anti-influenza_Chain
  source 1..1398: mol_type = other RNA
atgcttccgtcaaccgtacaaacattaacattattattaactagcggtggagtcttactatctctctatgtatcagccagcttaagctatttactatatagtgatgtcttactaaaatttagcagcacaaaaactactgcaccaacaatgtcattagaatgtactaacgcatcaaacgcacaaacagtaaaccattcagcgacaaaagaaatgacatttccaccacccgaacccgaatggacttatccaagattatcatgtcaaggttcaacatttcaaaaagctttattaatctcacctcatagattcggagaaataaaaggaaatagtgcaccactaataataagagaacccttcgttgcttgtggacctaaagaatgtagacatttcgcattaactcattatgcagcacaaccaggaggatattataatggaacgcgaaaagatcgaaataaactaagacatttagtatcagtaaaactcggaaaaataccaacagttgaaaactccatattccatatggctgcatggtcaggatcagcatgtcacgacggaagagaatggacatatataggagtagatggaccagacaacgatgctctagtaaaaataaaatacggagaagcatatacagacacataccacagctatgcacacaatatacttagaacacaagaatcagcatgtaattgtataggtggagattgttatctaatgataacagatggatcagcatcaggaatatcaaaatgcagattccttaaaatacgagaaggaagaataattaaagaaatattgccaacaggaagagtagaacatacagaagaatgcacatgcggatttgcatcaaataaaacaattgaatgtgcttgtagagacaactcatatacagcaaaacgaccatttgttaaactcaatgttgaaacagatacagcagaaataagactaatgtgcacaaaaacatatctagataccccacgaccagacgatggatcaatagccggaccctgtgaatcaaacggagacaaatggttaggaggaataaaaggcggattcgttcatcaaagaatggcatcaaaaattggaagatggtacagcagaacaatgagtaaaacaaatagaatgggaatggaattatacgtaaaatatgatggtgatccatggacagattcagatgcattaacattatcaggtgtaatggtaagcatagaagaaccaggatggtatagtttcggattcgaaataaaagataaaaaatgtgatgtaccatgtatcggaatagaaatggtacatgatggaggaaaagacacatggcacagtgcagcaacagcaatatactgtttaatgggatcaggacaactattatgggacacagtaaccggagtagacatggcactt

SEQ ID NO: 51174 - RNA, 1398 nt, synthetic construct
  misc_feature 1..1398: note = derived and/or modified sequence opt6 from anti-influenza_Chain
  source 1..1398: mol_type = other RNA
atgctaccaagcacagtacaaacattaacattactactaacatcaggaggagtattattatcattatatgtatcagcatccctatcatatttactatattcagatgtattattaaaattcagctctacaaaaactacagcaccaacaatgtcgctagaatgtaccaacgcatccaatgcacaaacagtaaaccacagcgcaacaaaagaaatgacctttcctcccccagaaccggaatggacatatccacgactatcatgccaaggttctacatttcaaaaagcattactaatttcaccacatagatttggcgaaataaaagggaatagtgcacctctaataataagagaaccatttgtagcgtgtggacctaaagaatgcagacatttcgcattaacacattatgccgcacaacctgggggttattataatggaacaagaaaagacaggaacaaattaagacatctagtatcagtaaaattaggtaaaatacctacagtagaaaacagcatatttcatatggcagcatggagcggatctgcatgtcatgacggacgagagtggacatacatcggtgtagatggcccagataatgatgccctagtaaaaataaaatacggagaagcatatacagatacttatcactcatatgcacataatatattaagaacacaagaaagtgcatgcaattgcataggaggagactgttatttaatgataactgacggaagcgcatcaggcatatccaaatgtagatttctaaaaataagagaaggtagaatcataaaagaaatactacctacaggacgagtagaacacacagaagaatgtacatgtggatttgctagtaataaaactatagaatgtgcatgtcgtgataatagttatacagccaaaagaccatttgtaaaattaaacgtagaaacagacacagccgaaataagattaatgtgtacaaaaacatatttagacacaccaagaccagacgatggaagcatagcaggaccatgcgaaagtaacggagacaaatggcttggaggaataaaagggggattcgtacatcaacgaatggcaagtaaaataggcagatggtattcaagaacaatgtcaaaaacaaatagaatgggaatggagttatatgtaaaatatgacggtgacccatggacagattcagacgcattaacattaagcggcgttatggtatcaatagaagaacctggttggtactcattcggatttgaaataaaagataaaaaatgtgatgtaccatgtataggaatagaaatggtacatgatggaggaaaagatacatggcatagcgcagcaacagcaatttattgtttaatgggatcaggacaactattatgggatacagttacaggagtagatatggcatta

SEQ ID NO: 51175 - RNA, 1407 nt, synthetic construct
  misc_feature 1..1407: note = derived and/or modified sequence opt6 from anti-influenza_Chain
  source 1..1407: mol_type = other RNA
atggattggacatggagattcttattcgtagtagcagcagcaacaggtgtacaaagtcaagtacaactagtacaatcaggagcagaagtaaaaaaacctggatcatcagtaaaagtatcttgcaaagcatcaggcggaacactaaacaattacgcaatatcctgggtaagacaggcaccaggtcaaggactagaatggatgggcggaatcagtcctatatttggaacattaaactatgctgaaagatttcaaggaagagtaacaataacagcagatgtatttaccaatacagtatatatggaactttcatcactaagatctgaagatacagccgtatatttctgcgcaagaggttgcggatacaactgttattattttgacggctggggacaaggaacactagtcaccgtatctagcgcatctacaaaaggaccatccgtctttccattagcaccatcatcaaaatccacatcaggaggcacagctgcattaggatgcttagtaaaagattactttcctgaaccagttaccgtatcatggaactctggagctctaacatcaggagtacatacttttcccgcagttttacaaagttcaggactttacagtctatcttcagtagtaacagtgccatcctcatcacttgggacacaaacatacatatgtaatgttaatcataaaccatcaaatactaaagtagataaaaaagtcgaaccaaaaagctgtgacaaaactcacacatgtcctccatgcccagcccccgaattacttggcggcccaagcgtatttctattcccacctaaaccaaaagatactttaatgatatcaagaactccagaagttacatgcgtagtagttgatgtaagccacgaagatccagaagtaaaattcaattggtatgtagatggagtagaagtacataatgccaaaactaaaccaagagaagaacaatataattcaacatacagagtagtctcagtacttacagtactacatcaagattggttaaatggaaaagaatacaaatgcaaagtctcaaataaagccttacctgctccaatagaaaaaactatatcaaaagctaaaggccaaccaagagaacctcaagtatatacactaccaccctcacgcgacgaactaacaaaaaaccaagtatcactaacctgtcttgtaaaaggattctacccatccgacatagcagtagaatgggaatcaaatggacaaccggaaaataattataaaactactccaccagtattagactcagacggatcatttttcctttattctaaattaacagtagacaaatccagatggcaacaaggaaacgtcttctcatgctcagtaatgcacgaaggactacataatcattatacacaaaaatcactatcactctcaccaggaaaa

SEQ ID NO: 51176 - RNA, 1407 nt, synthetic construct
  misc_feature 1..1407: note = derived and/or modified sequence opt6 from anti-influenza_Chain
  source 1..1407: mol_type = other RNA
atggattggacatggagattcctattcgttgtagccgcagctacaggagttcaatcacaagtacaattagtacaatcaggagccgaagtaaaaaaaccaggtagcagtgtaaaagtttcctgtaaagcatctggaggaacattaaataattacgccatatcatgggtaagacaagcaccgggacaaggactagaatggatgggaggaatatctccaatattcggtacacttaattacgctgaaagatttcaaggaagagtaacaataacagcagacgtattcacaaatactgtctatatggaattatcttcattacgatcagaagatacagcagtatatttctgtgcaagaggatgcggctacaattgctattatttcgacggatggggacagggaactttagtaacagtttcatctgcttcaacaaaaggaccatcagttttccccctagcaccatcttctaaaagcacatcaggaggaactgcagccttaggctgtttagtaaaagattatttccccgaacctgtcactgtatcttggaattcaggagctctaacatccggagtacacacattcccagcagttctgcaatcatctggactctatagtctatcatccgtagtaacagtaccaagctcatcattaggtacccaaacatacatctgcaatgttaaccacaaaccatcaaatacaaaagttgacaaaaaagtagaaccaaaatcatgtgacaaaactcacacttgtccaccatgcccagcaccagaactactaggtggaccatctgtattcttatttccaccaaaacctaaagatacactaatgatttcaagaacacctgaagtaacatgcgttgttgtagacgtatcacacgaagaccctgaagtaaaattcaactggtatgtagatggagtagaagtacataatgcaaaaaccaaaccacgagaagaacaatataattcaacttatagagtcgtttccgtactaactgtattacaccaggattggctaaatggaaaagaatataaatgcaaagtatccaataaagctttaccagcacccatagaaaaaacaatatctaaagctaaaggacaacctcgtgaacctcaagtatacacattaccaccatctcgtgacgaactaacaaaaaaccaagtatcgttaacttgtttagtaaaaggcttctatccttcagatattgcagtagaatgggaatcaaacggacaaccagaaaataattataaaactacacctccagtattagattcagacggctctttttttttatattcaaaattaacagttgataaatctagatggcaacaaggtaatgtattttcatgttcagtaatgcacgaaggattacacaatcattacacccaaaaaagcttatcactatccccaggaaaa

SEQ ID NO: 51177 - RNA, 1407 nt, synthetic construct
  misc_feature 1..1407: note = derived and/or modified sequence opt6 from anti-influenza_Chain
  source 1..1407: mol_type = other RNA
atggactggacatggagatttctcttcgtagtagccgcagcaactggagtacaatcacaagtccaattagtacaatcaggagcagaagtaaaaaaaccaggatcatcagtaaaagtatcatgtaaagcatcaggaggaacactcaacaattatgcaatatcctgggtaagacaagcaccaggacaaggtctagaatggatgggagggatatcaccaatattcggcacattaaattacgccgaaagattccaaggcagagtaacaataacagcagatgtattcacaaacacagtatacatggaactatcatcattaagatcagaagacaccgcagtatacttctgtgcaagaggttgcggatataattgttactactttgatggttggggacaaggtactttagttacagtctcatcagcatcaacaaaaggaccttccgtattcccattagcaccttcatccaaatctacctccggaggaacagctgcattaggctgcctagtaaaagactacttcccagaaccagtaacagtatcatggaattcaggagctctaactagcggtgtccacaccttcccagccgtcctacaatcatcaggactatattcattatcatctgtagtaacagtaccatcatcatcattaggaacacaaacatacatatgcaatgtaaaccacaaaccatctaataccaaagtagataaaaaagtagaaccaaaatcttgcgataaaacacacacatgcccaccttgcccagcaccagaactactaggaggcccatcagtattcttatttccaccaaaaccaaaagacactctaatgatatcaagaaccccagaagttacatgtgttgtagtagacgtatcacacgaagatcctgaagtaaaattcaactggtacgttgatggcgtagaagtccacaacgcaaaaaccaaacccagagaagaacaatataactcaacatacagagttgtctccgtcttaacagttttacaccaagactggctaaacggaaaagaatacaaatgcaaagtatccaataaagcattacctgcaccaattgaaaaaactataagtaaagccaaaggacaaccaagagaaccacaagtatatacactacctccatcacgtgacgaactaacaaaaaatcaagtatcattaacatgcctcgtaaaaggattttatccatcagatatagcagtagaatgggaatctaatggtcaaccagaaaacaactacaaaaccacacccccagtactagactccgacggatcatttttcctatacagcaaattaaccgtagacaaatccagatggcaacaaggtaatgtattttcttgctcagtaatgcatgaaggattacataatcattatacacaaaaatcactatcactatcaccaggaaaa

SEQ ID NO: 51178 - RNA, 1413 nt, synthetic construct
  misc_feature 1..1413: note = derived and/or modified sequence opt6 from anti-influenza_Chain
  source 1..1413: mol_type = other RNA
gatggagtaaaaccattaatactaagagactgctcagtcgccggatggctcttaggaaatccaatgtgcgatgaatttataaacgtaccagaatggtcctacatagtagaaaaagccaaccccgcaaacgacctatgttatcctggaaacttcaacgactacgaagaattaaaacatttactctcaagaataaatcacttcgaaaaaatacaaataataccaaaatcctcatggagcgatcatgaagcatcatcaggcgtatcatctgcatgcccatatcaaggaacaccttcattttttagaaatgtagtatggctaataaaaaaaaataatacttaccccactataaaaagaagttacaataacacaaaccaagaagacctactaatcctctggggtatacatcactccaacgacgcagcagaacaaacaaaattatatcaaaacccaacaacatacatatcagtaggtacatcaacactaaaccaacgacttgtacctaaaatagcaacaagatcaaaagtaaacggccaaaacggacgcatggactttttctggactatactcaaaccaaacgacgcaatcaacttcgaatcaaacggaaattttatagcaccagaatacgcttataaaatagtaaaaaaaggatacataccagaagcaccaagagacggacaagcctacgtacgaaaagatggagaatgggtacttctctcaaccttcctacgatcagataaaacacacacatgcccaccatgcccagcaccagaactactaggaggcccatcggtattcctctttccaccaaaaccaaaagacacactaatgatctcacgaaccccagaagtaacatgcgttgtagtagatgtaagccacgaagacccagaagtaaaatttaattggtatgtagatggagtcgaagttcacaacgctaaaaccaaaccacgagaagaacaatataattctacttacagagtagtctcagtattaacagtgctacaccaagactggctaaacggaaaagaatacaaatgcaaagtatcaaacaaagcactaccagcacccatagaaaaaaccatatcaaaagcaaaaggacaaccaagagaaccacaagtttacacactaccaccctcacgagaagaaatgacaaaaaaccaagtaagcttaacctgcctagtaaaaggcttctatccctccgacatcgcagttgaatgggaatcaaacggccaaccagaaaataactacaaaacaactcccccagtactagactccgatggctcattctttttatattcaaaattaacagtagataaatctagatggcaacaagggaatgtattctcatgctccgtaatgcatgaagccctacataaccattacacacaaaaatctctatcactttcacccggaaaa

SEQ ID NO: 51179 - RNA, 1413 nt, synthetic construct
  misc_feature 1..1413: note = derived and/or modified sequence opt6 from anti-influenza_Chain
  source 1..1413: mol_type = other RNA
gatggagttaaacctctaatactacgagactgttcagtagccggatggctactaggcaatccaatgtgcgacgaatttatcaatgtacctgaatggtcatatatagtcgaaaaagcaaatccagcaaacgacctatgttatccaggaaatttcaatgactacgaagaactcaaacatctactatcacgtataaatcactttgaaaaaatacaaataataccaaaatcatcatggtcagaccacgaagcatcctccggagtatcttcagcctgtccataccaaggcacaccatcattcttcagaaacgtagtatggttaataaaaaaaaacaatacatacccaactataaaaagatcatataacaacaccaatcaagaagacctactaattctctggggcatacaccattctaacgacgcagccgaacaaaccaaactttatcagaacccaacaacttacatttctgttggaacatcaacattaaatcaaagattagtaccaaaaatagcaacccgaagcaaagtaaatggacaaaatggccgaatggacttcttctggacaatattaaaaccaaacgacgccatcaactttgaaagcaacggaaatttcatagccccagaatacgcttacaaaatagtaaaaaaaggatatataccagaagctccaagagacggacaagcatacgtacgaaaagacggagaatgggtactactatccacattcttaagatctgacaaaacacatacatgcccaccatgtccagcaccagaactactaggtggcccatcagtcttcctcttcccacctaaaccaaaagatacactaatgatctcaaggacaccagaagtgacctgcgtagtagtagacgtatctcacgaagacccagaagtcaaattcaactggtacgtagacggagttgaagtccacaacgcaaaaacaaaaccaagagaagaacaatacaactcaacatacagagtagtatcagtactcacagtactacaccaagactggctaaatggaaaagaatacaaatgcaaagtatctaacaaagcacttccggcaccaatagaaaaaacaatatcaaaagcaaaaggacaacctagagaaccacaagtatacacactaccaccatcaagagaagaaatgaccaaaaatcaagtctcactaacttgcctagtaaaaggattttacccatcagacatcgccgtagaatgggaaagcaacggacaacccgaaaataattataaaaccacacctcccgtattagactccgacgggtcatttttcctatactcaaaactaactgtagacaaatcaagatggcaacaaggaaacgtattctcatgcagcgtaatgcatgaagcacttcataatcactatacacaaaaaagcctatcattatcaccaggaaaa

SEQ ID NO: 51180 - RNA, 1416 nt, synthetic construct
  misc_feature 1..1416: note = derived and/or modified sequence opt6 from anti-influenza_Chain
  source 1..1416: mol_type = other RNA
atggattggacttggagatttttattcgtagttgccgctgcaaccggagttcaatgtcaagtacaattagttcaatcaggagcagaagtcaaaatgcctggatcatcagtaaaagtatcatgcaaaacatctggcgtattcttctcatcacacgcgatcagctgggttagacaagccccaggacaaggacttgaatggatgggaggaatatccccaatgttcggcactacacattacgcacaaaaatttcaaggaagagtcaccattacagcagatcaatcaacaacaacagcatatatggaactaacttcattaacaagcgaagatacagcagtatactactgcgcacgtgatggagcaggatcttattacccattaaattggtttgatccatggggccagggaacactcgtaactgtatcaagtgcttctacaaaaggcccaagtgtattccccttagcaccatcaagcaaatcaaccagcggaggaacagcagcactgggatgcctagtaaaagactattttccagaaccagtcacagtttcttggaatagcggtgcattaacctccggagtacacacattccctgcagtacttcaatcatccggactatactcattatcaagcgtagtaacagttccaagctcttcactaggaacacaaacatatatctgcaacgtaaatcataaaccctcaaatacaaaagtagataaacgagtagaacctaaatcttgcgataaaacacatacgtgccctccatgtcctgctccagaattactaggtggaccatcagtatttctatttccaccaaaaccaaaagatacattaatgatctctagaacaccagaagtaacatgtgtagttgtagacgtatcacatgaagatccagaagtaaaatttaactggtatgtagacggagtagaagtacacaacgcaaaaacaaaaccccgtgaagaacaatataactcaacttacagagttgtaagcgtactaacagtattacatcaagactggctcaatggcaaagaatataaatgcaaagtatcaaacaaagcgttaccagctccaatagaaaaaactatatcaaaagcaaaaggacaaccacgtgaaccccaagtttacactttaccaccatcacgagacgaactaacaaaaaatcaagtatcactaacatgcctagtaaaaggattctatccatcagacatagcagtagaatgggaatcaaatggacaaccagaaaataactataaaacaacaccaccagtccttgacagtgatggatctttctttctatatagcaaactaacagtcgataaatcgagatggcaacaaggaaatgtattttcatgtagtgttatgcatgaaggtctacacaatcattacacacaaaaatcattatcattatcaccaggtaaa

SEQ ID NO: 51181 - RNA, 1416 nt, synthetic construct
  misc_feature 1..1416: note = derived and/or modified sequence opt6 from anti-influenza_Chain
  source 1..1416: mol_type = other RNA
atggattggacctggaggttcttatttgtagtagcagcagcaacaggagtccaatgccaagtacaactagtacaatcaggtgccgaagtaaaaatgccaggatcatcagtaaaagtatcatgcaaaacatcaggtgtctttttttccagtcacgcaatttcatgggtaagacaagcaccaggtcaaggattagaatggatgggaggaatatcacctatgttcggaactactcattacgcacaaaaatttcaaggaagagtaaccataacagccgaccaaagtactacaacagcttatatggaactaacatccttaacatcagaagacacagcagtatattactgtgcaagagatggagcaggatcatactaccctttaaactggttcgatccatggggacaaggaacactcgttaccgtaagctctgcatctacaaaaggaccatcagtattcccattagccccatccagtaaatcaacttcaggaggtacagcagcactaggatgcttagtaaaagattatttcccagaaccggtgacagtaagttggaattcaggcgcattaacatcaggcgtacacacattcccagcagtattacaaagttcaggcctatattcactatctagtgtagtaaccgtacccagttcaagtctcggcacacaaacatacatatgtaatgtcaatcataaaccaagtaacacaaaagtagataaaagagtagaacccaaatcatgtgacaaaacacacacatgcccaccatgtccagcaccagaactactaggtggcccatcagtatttctattcccaccgaaaccaaaagatacattaatgatatcaagaactccagaagtaacatgtgtcgtagtagacgtttcacatgaagacccagaagtcaaatttaactggtatgtagatggagtagaagtacataatgcaaaaacaaaaccaagagaagaacaatataattcaacatatagagtcgtatcagtcttaacagtattacaccaggactggttaaacggaaaagaatataaatgcaaagtttctaacaaagccttaccagcaccaatagaaaaaactataagcaaagcaaaaggtcaaccaagagaaccacaagtctatactttaccaccatcaagagatgaattaacaaaaaatcaagtatctttaacatgcctagttaaaggtttttatccatcagacatagccgtagaatgggaatcaaatggacaacctgaaaacaactacaaaacaacaccaccagtactagacagtgatggaagtttcttcctatactctaaattaacagtagataaatcacgatggcaacaaggaaatgtatttagctgtagtgtaatgcacgaaggactccataaccactacacacaaaaatcattatcattatcaccaggaaaa

SEQ ID NO: 51182 - RNA, 1416 nt, synthetic construct
  misc_feature 1..1416: note = derived and/or modified sequence opt6 from anti-influenza_Chain
  source 1..1416: mol_type = other RNA
atggattggacttggcgatttctattcgtagtcgcagcagcaacaggcgtacaatgtcaagtacaattagtccaatcaggtgctgaagtcaaaatgccaggatcatcagtaaaagtatcatgtaaaacttcaggagtattcttctcatctcatgcaatatcatgggtcagacaagcaccaggacaaggactagaatggatgggcggaattagcccaatgttcgggacaacacactacgcacaaaaattccaaggaagagtgaccatcacagcagaccaatcaacaacaacagcatacatggaacttacttcactaacctcagaagatactgcagtatactattgcgcaagagatggtgcaggatcctactacccactaaattggtttgacccttggggtcaaggcaccctagtaacagtctcatctgcatctacaaaaggaccctccgtattccctctagcaccatcatccaaatcaacatctggaggcacagcagccctaggatgtcttgtaaaagactattttccagaaccagtaacagtatcatggaactcaggagcacttacttctggagtacacacattcccagctgtattacaatcttccggattatactcactctcatcagtagtaacagtaccatcctcatcactaggaacacaaacatacatatgcaacgtcaatcacaaaccatcaaataccaaagtagacaaaagagtagaaccaaaaagctgcgacaaaacccacacctgtccaccctgccctgcgcctgaattactcggaggacccagtgtattcctattccctccaaaaccaaaagacacactcatgatctctagaacaccagaagtaacatgcgtagtagtcgacgtatcccatgaagacccagaagtaaaatttaactggtacgtagatggagttgaagtccacaatgctaaaaccaaaccacgcgaagaacaatataattcaacttatcgagtagtatctgtattaactgtattacatcaagattggctaaacggaaaagaatataaatgtaaagtctcaaacaaagcactcccagcaccaatagaaaagacaatatcaaaagcaaaaggacaaccaagagaacctcaagtttacacattacctccctctagagacgaattaaccaaaaatcaagtatcattaacatgtttagtaaaaggattctacccatccgatatagccgtagaatgggaaagcaacggacaaccagaaaataattacaaaaccacacctccagttctagattcagatggttcattctttctctactcaaaattaacagtagataaatcacgttggcaacaaggaaatgtattttcatgctcagtaatgcatgaaggtctccataatcactatacacaaaaatcattatcactgtcaccaggtaaa

SEQ ID NO: 51183 - RNA, 1419 nt, synthetic construct
  misc_feature 1..1419: note = derived and/or modified sequence opt6 from anti-influenza_Chain
  source 1..1419: mol_type = other RNA
atgacagaaagtgcaatgacttcaagggctggaaggggaagaggagccgatttagtagcagcggtagttcaaggacatgcagcagcatcagatgcagcaggagatttaagttttccagatggattcatctggggagcagcaacagcagcatatcaaatagaaggggcatggcgagaagatggaagaggtttatgggatgtatttagtcatacaccaggaaaagtagcaagtggacatactggagacatagcatgtgatcattatcacagatatgcagatgacgtaagattaatggccggactaggagacagagtatacagattttcggtagcatggccaaggatagtaccagatggttcaggaccagtaaatccggcaggcctagatttttatgataggttagtagatgaattattgggtcatggaataacaccatatccgacattataccattgggatttaccccaaacattagaagacagaggaggttgggcagcacgagatacagcatatcgattcgctgaatatgcattagcagtacatagacgattaggagatagagttagatgttggataacattaaatgaaccatgggtagcagcatttttagcgactcacagaggagctccaggagcagccgatgtacctagatttagggcggtacatcatttactattaggacatggattaggtttaagattgagatcagcgggagccggacaattaggattaacattaagtttatcaccagtaatagaagcaagaccaggagtgagaggtggaggtagaagagtagatgcactagcaaatagacaattcctagacccagcactaagaggtagatatccagaagaagtattaaaaataatggcagggcatgcaagattaggacatcctggaagggacttagaaacgatacatcaaccggtagatttactaggagtaaattattatagtcatgtaagacttgctgcagaaggagaaccagcaaataggctacctggctcagaaggaataagatttgaaagaccaacggcagttactgcttggcctggagacagaccagatgggttaagaacactattattaagactatcaagggattatcctggagtaggattaataataacagaaaatggagcggcatttgacgacagagcagatggggatagagttcatgatccagaaagaataaggtacttaacagcaactttaagagcagtacatgatgcaataatggcaggagctgacttgcgaggatatttcgtttggagcgtgttggacaattttgaatgggcgtatggctatcataaaagaggaatagtatatgtagattatactactatgagaagaataccacgtgagagtgcattatggtatagagatgttgtaagaaggaacggattaagaaacggagaa

SEQ ID NO: 51184 - RNA, 1419 nt, synthetic construct
  misc_feature 1..1419: note = derived and/or modified sequence opt6 from anti-influenza_Chain
  source 1..1419: mol_type = other RNA
atgactgaaagtgcaatgacaagtagagcaggaaggggaaggggagctgatttggtagcagctgtagtacaaggacacgcagcagcaagtgatgcagcaggagatttaagttttcctgacggattcatctggggagcagctacagcagcatatcaaatagaaggagcttggagagaagatggaagaggattatgggacgtattcagccatacacctggaaaagtagcatcagggcatacaggggatattgcatgtgaccattatcacagatatgctgatgatgtaagattgatggcaggacttggcgaccgagtttatagattttctgtagcatggccaagaatcgtaccagatggaagtggaccagtaaacccagcaggcctagacttttatgatcgattagtagatgaactactaggacatggaataacaccatatccaacattatatcattgggacttaccacaaacattagaagatagaggaggatgggcagctagagatactgcatatagatttgcggaatatgcattagcagtacacagaagattaggagatagagtaaggtgttggattacattaaacgaaccatgggttgctgcatttctagcaacacacagaggagcaccaggagcagcggatgttccaagatttagagcagtccatcatttattactgggtcatggtttaggtttaagactaagatcagcaggagcgggtcaattaggtttaacgttaagtttaagtccagttatagaagcaagaccaggagtaagaggaggtggaagaagagttgacgctttagcaaatagacaatttttagatccagcattaagaggaagatatccagaagaagtattaaaaataatggctggacatgcaagattaggacatccaggaagagacctagaaacaatacatcaaccagttgatctattaggagtgaactattatagtcatgtaagacttgcagcagaaggagaaccagcaaatagattaccgggatccgaaggaataagatttgaaaggccgacagcagtgactgcatggccgggtgatagacctgatggattaaggaccctattattaaggctaagtagagattacccaggcgtaggattaataataacagaaaatggagcagcgtttgatgatagagctgatggggatagagtacatgatccagaaagaattagatatttaacagcaacactaagagcagtacacgatgcaataatggcaggagcagatttaagaggttacttcgtctggagtgtcctagataattttgaatgggcatatgggtatcataaaaggggaatagtgtatgtagattatacaacgatgagaagaataccacgtgaatcagcactatggtatagagatgtagtacgaagaaatggattgagaaatggggaa

SEQ ID NO: 51185 - RNA, 1422 nt, synthetic construct
  misc_feature 1..1422: note = derived and/or modified sequence opt6 from anti-influenza_Chain
  source 1..1422: mol_type = other RNA
ctttccagaataaaccatttcgaaaaaattcaaataataccaaaatcatcctggtccgatcacgaagcctcttccggagtatcatcagcatgtccataccaaggcacaccatccttcttcagaaacgtagtatggctaataaaaaaaaacaacacatacccaacaataaaaagatcatataataatacaaaccaagaagacttactaatactctggggaatacatcactccaacgacgcagctgaacaaactaaattataccaaaatccaaccacatatatatccgtaggaacctcaacactaaaccaacgcttagtcccaaaaatagcaaccagatctaaagtaaatggacaaaatggaagaatggacttcttttggaccatcctaaaaccaaacgatgcaataaactttgaatccaacggaaactttatcgctccagaatacgcatacaaaatagtaaaaaaaggcgattcagctatagtaaaaagtgaagtagaatatggcaattgcaacacaaaatgtcaaacccccattggcgcaataaattcatcaatgccattccacaatatacacccactaaccataggagaatgcccaaaatacgtaaaatcaaataaacttgtattagcaacaggattaagaaactcaccattaggttacataccagaagcaccaagagacggacaagcatatgtacgtaaagacggagaatgggtcttactaagtacattcctaagaagcgacaaaacacacacatgtccaccatgcccagcgcccgaattactcggaggcccatccgtcttcctattcccacccaaacctaaagacaccttaatgatatctcgaacaccagaagtaacatgcgtagtcgtagacgtatcacatgaagatccagaagtcaaattcaattggtacgtagacggagttgaagtacataacgctaaaacaaaacccagagaagaacaatataatagcacatatcgagtagtttccgtattaacagtactacaccaagattggttaaacggaaaagaatacaaatgcaaagtatccaacaaagctctacctgcaccaattgaaaaaacaatctcaaaagcaaaaggacaacccagagaaccacaagtatacacacttccaccatccagagaagaaatgaccaaaaatcaagtatcattaacatgcctagtcaaaggattctacccatcagacatagcagtagaatgggaatcgaacggacaacccgaaaacaactacaaaacaacacctcccgtcctagacagtgacggatctttcttcctttactcaaaactaacagtagacaaatccagatggcaacaaggcaacgtattctcctgctctgtgatgcacgaagcattacacaatcactatactcaaaaatcattatcactaagccccggaaaa

SEQ ID NO: 51186 - RNA, 1422 nt, synthetic construct
  misc_feature 1..1422: note = derived and/or modified sequence opt6 from anti-influenza_Chain
  source 1..1422: mol_type = other RNA
ctatcacgaattaaccatttcgaaaaaatacaaataatcccaaaatcaagctggtcagatcacgaagcctcttcaggagtctcttcagcatgcccataccaaggaacaccatcattctttagaaacgtagtatggctaataaaaaaaaataacacatacccaacaatcaaaagatcctacaacaacacaaaccaagaagatctcctaatactctggggtatacaccattcaaatgacgcagcagaacagacaaaactttatcaaaatccaacaacttatatatcagtcggaacatcaaccctcaaccaaagattagtcccaaaaatagcaacaagatcaaaagtaaacggacaaaatggacgtatggatttcttctggactatattaaaaccaaatgacgcaataaatttcgaatcaaacggaaatttcatcgcacccgaatatgcatacaaaatagtaaaaaaaggagactccgcaatagtaaaatcagaagtagaatacggaaactgtaatacaaaatgtcaaacaccaataggtgcaataaattcatccatgccattccataatatacacccattaactataggtgaatgcccaaaatacgttaaatcaaacaaactagttcttgccaccggactcagaaactccccactaggctacatacccgaagcaccaagagatggccaagcctacgtaagaaaagacggagaatgggtattattaagcacatttctcagatcagacaaaacacacacctgccccccatgccctgcccccgaactcctaggcggtccaagcgtattcctattcccaccaaaacctaaagacacactaatgatatcaagaacaccagaagttacatgcgtagtagtagacgtttcacatgaagacccagaagtaaaattcaactggtacgtcgatggagtagaagtacataacgcaaaaacaaaacccagagaagaacaatataattcaacatacagagtagtctccgtactcacagtcttacaccaagattggttaaacggaaaagaatataaatgcaaagtaagcaacaaagcattaccagcaccaatagaaaaaacaatatcaaaagctaaaggccaaccaagagaaccacaagtatacacattaccaccatcacgagaagaaatgacaaaaaaccaagtatctcttacctgtctagtaaaaggtttctacccttcagacatcgccgtagaatgggaatcaaacggacaaccagaaaataattacaaaacaactcccccagttttagacagcgacggatcattttttctatactcaaaattaacagtagacaaatcacgatggcaacaaggaaacgttttctcatgctccgtcatgcatgaagcactacacaatcactacacccaaaaatccctatccctatcaccaggtaaa

SEQ ID NO: 51187 - RNA, 1428 nt, synthetic construct
  misc_feature 1..1428: note = derived and/or modified sequence opt6 from anti-influenza_Chain
  source 1..1428: mol_type = other RNA
atggaatttggcttaagctgggtatttcttgtagctctactcagaggagttcaatgtcaagtacaactggtagaaagtggaggtggagtagtacaaccaggaagatctcttagactttcatgcgcagcatcaggattcacattctccagatttggaatacattgggtaagacaagcaccaggaaaaggcctagaatggatggcggtaatatggtatgacggatctaacaaattctatgctgattcagtaaagggaagatttacaatatctagagataactctaaaaacaccgtttatttacaaatgaactcattacgagcagaagatacagccgtatattattgtgcaaaagattctagaggatattgttcatctataatatgctttgaaggaggattagacaattggggacaaggaaccctagtaacagtatcatctgctagcacaaaaggaccatctgtatttcctctcgcaccatcatcaaaatcaacatcaggtggaacagccgcactaggatgtttagttaaagactactttccggaaccagtcactgtctcttggaactcaggagccttaacatcaggtgttcatacttttcctgccgtccttcaatcatcaggtttatattccctatcctcagttgtaacagttccttcctcatcactaggaacacaaacatacatttgtaatgtaaatcataaaccatcaaatacaaaagttgataaacgagtagaacctaaatcatgtgacaaaacccatacctgtccaccatgtcccgcaccagaattactaggaggcccatctgtatttctatttcccccaaaacctaaagatacactaatgataagccgaacaccagaagtaacctgtgtagtagttgatgtttcacatgaagacccagaagtaaaatttaattggtacgtagatggagttgaagtacataatgctaaaacaaaacccagagaagaacaatataattcaacatatagagtagtatctgtacttacagtactacatcaagactggctcaacggaaaagaatataaatgtaaagttagcaataaagcattaccagccccaatagagaaaacaatttcaaaagcaaaaggccaaccaagagaacctcaagtatatactctacccccatccagagatgaattaactaaaaatcaagtctctctaacatgtttagttaagggtttctacccatccgatatagcagtagaatgggaatcaaacggacaaccagaaaacaattacaaaacaacaccaccagtacttgattcagacggttcattctttttatattcaaaattaacagtagataaatccagatggcaacaaggaaatgttttctcatgctcagttatgcatgaaggattacataatcattatacacaaaaatctttatcattatcacctggcaaa

SEQ ID NO: 51188 - RNA, 1428 nt, synthetic construct
  misc_feature 1..1428: note = derived and/or modified sequence opt6 from anti-influenza_Chain
  source 1..1428: mol_type = other RNA
atggaatttggcctatcatgggtatttttagtagcactactacgaggagtacaatgtcaagtacaattagtagaatctggaggtggagtagtccaaccaggccgatccctccgactatcatgtgcagcatccggatttacattttcaagattcggaatacattgggttcgacaagcaccaggaaaaggactagaatggatggccgtaatatggtatgatggatcaaataaattttatgcagactctgtaaaaggaagattcacaatatctagagataacagtaaaaatacagtatatttacaaatgaactcacttagagcagaagatacagctgtatactattgtgcaaaagattccagaggttattgcagttcaataatttgtttcgaaggtggattagacaactggggacaaggaacactcgtaactgtttcttcagcatctacaaaaggaccaagtgttttcccattagcaccttcatcaaaaagcacatcaggcggtacagcagcattaggatgcttagttaaagactacttcccggaaccagtaacagtttcatggaactcaggtgcattaacttccggagtacatacttttccagcagtcctacaatcatcaggactatactctttatcttcagtagttactgttcccagctccagtttaggcacacaaacttatatatgtaatgtcaatcacaaaccatcaaataccaaagtagacaagagagtagaaccaaaaagttgcgataaaactcatacatgtccaccatgtcccgctccagaattattaggcggaccatcagtatttctctttccaccaaaacccaaggatacattaatgatatcaagaacaccagaagttacttgcgtagtagtagacgtttcacatgaagacccagaagtcaaatttaactggtacgtagacggagtagaagtacacaacgcaaaaactaaacctagagaggaacaatacaattccacttaccgagtcgtttcagtactaactgtattacaccaagactggctaaatggcaaagaatataaatgtaaagtatcaaataaagcacttccagcaccaattgagaaaacaatatcaaaagcaaaaggacaaccaagagaacctcaagtttatacattaccacccagtagagatgaactaactaaaaaccaagtatcattaacctgtctagtaaaaggattttatccctcagacatagcagtagaatgggaatccaatggacaaccagaaaataattataaaacaacccctccagtactagattcagacggctcattctttttatattcaaaactaacagtagataaatcaagatggcaacaaggaaatgtattttcatgctcagtaatgcatgaaggcctccataatcattatacacaaaaatcactaagcctttcaccaggaaaa

SEQ ID NO: 51189 - RNA, 1428 nt, synthetic construct
  misc_feature 1..1428: note = derived and/or modified sequence opt6 from anti-influenza_Chain
  source 1..1428: mol_type = other RNA
atggaatttggactaagctgggtctttttagtagcattattaagaggagtacaatgccaagtacaattagtagaaagcggaggaggagttgtacaaccaggaagatctttaagactttcatgtgctgcaagtggctttacattttccagattcggaatacactgggtcagacaagcacccgggaaaggactagaatggatggcagtaatatggtacgatggtagcaacaaattttacgcagatagtgtaaaaggaagatttacaataagtagagacaactccaaaaatacagtatatttacaaatgaactcactacgggcagaagatacagcagtatattattgtgcaaaagattctagaggctattgttcaagtataatatgctttgaaggaggactagataattggggacagggaacacttgttacagtaagttcagcatcaacaaaaggaccatcagtatttccactagcacctagttcaaaatcaacaagtggtggaacagcagcattaggctgcttagtcaaagattactttccagaaccagttacagtttcgtggaactcaggcgcactaacatcaggcgtacatacatttccagctgtattacaatcatcaggcctatattcattatcatcagtagtaacagttcctagttcatctttaggaactcaaacatatatatgtaatgttaatcataaaccaagtaatacaaaagtagataaacgagtagaaccaaaatcatgtgataaaactcacacatgcccaccttgccctgccccagaactcctaggaggaccaagcgtatttctatttccaccaaaaccaaaagatacactaatgatatcaagaaccccagaagttacatgcgtcgtagtcgacgtttctcatgaagacccagaagtaaaatttaactggtacgtggatggtgtagaagtacacaatgcaaaaacaaaaccaagagaagaacaatataacagtacatacagagtagtatcagtattaacggtattacaccaagattggttaaacggcaaagaatataaatgtaaagtaagtaataaagcactaccagccccaatagaaaagacaatatcaaaagcaaaaggacaacccagagaaccacaagtctacactctaccaccatcaagagatgaattaaccaaaaatcaagtaagcctaacatgtttagtaaaaggattttacccatcagatattgcagtagaatgggaatcaaatggacaaccagaaaataattacaaaacaacaccaccagtattagattcagatggatccttctttttatacagtaaattaacagtggacaaatcaaggtggcaacaaggaaatgtttttagctgttcagtaatgcacgaaggattacacaatcattacacacaaaaatcactaagtctatcaccaggaaaa

SEQ ID NO: 51190 - RNA, 1440 nt, synthetic construct
  misc_feature 1..1440: note = derived and/or modified sequence opt6 from anti-influenza_Chain
  source 1..1440: mol_type = other RNA
atgccatcagtaaaaatcggaataataggagccggtagcgcagtattttcacttagattagtaagcgacctatgcaaaacaccaggattatcgggtagcacggtaactctaatggatattgatgaagaaagactagatgccatcctaacaatagcaaaaaaatacgtagaggaagtgggagctgatcttaaatttgaaaagacaatgaacttggatgatgtaataattgacgcagatttcgtaataaacacagcaatggtaggaggacatacatatctagaaaaagtaagacaaataggagagaaatatggatactacagaggaatagatgctcaagaatttaacatggtaagcgattactacactttttcaaactacaatcaattaaaatacttcgtagatatagcaagaaaaatagaaaaactatcaccaaaagcatggtatctacaagcagcaaatccaatatttgaaggaacaacactagtaacacgtacagtaccaattaaagcagtaggattttgtcacggacactacggagtaatggaaatagtagaaaaactaggattagaagaagaaaaagtcgactggcaagtagcaggagtaaaccatggaatatggctaaatagatttagatataacggtggaaatgcatatccactactagacaaatggatagaagaaaaatcaaaagactggaaacctgaaaatcctttcaatgaccaactatcaccagcagcaatagatatgtacagattttacggagtaatgccaataggtgacacagtaagaaactcaagctggagatatcatagagacctagaaacaaaaaaaaaatggtacggcgaaccatggggaggtgcagactcagaaataggatggaaatggtaccaagatacactaggaaaagtaacagaaataaccaaaaaagtcgcaaaattcataaaagaaaatccatctgtgagactatcagacctaggaagcgtactaggtaaagatttaagcgaaaaacaatttgtgttagaagttgagaaaatactcgacccagaaagaaagagtggggaacaacacataccctttatagacgcgttactaaatgacaataaagcaagattcgttgtaaatataccaaacaaaggaataatccatggaatagatgacgacgtagtcgtagaagtaccggcactagtagacaaaaatggaattcatccagaaaaaatagaaccaccgctacctgatagagtagtaaaatactatcttagaccaagaataatgagaatggaaatggcattagaagcattcttaacaggagacataagaattataaaagaactattatacagagacccaagaacaaaaagtgacgaacaagtggaaaaagtaatagaagaaatactagcattaccagaaaatgaagaaatgagaaaacactacttaaaaaga

SEQ ID NO: 51191 - RNA, 1440 nt, synthetic construct
  misc_feature 1..1440: note = derived and/or modified sequence opt6 from anti-influenza_Chain
  source 1..1440: mol_type = other RNA
atgcctagtgtgaaaataggaataataggagcaggaagcgcggtatttagcctacgattagtaagtgacttatgcaaaacaccaggcttaagtggaagtactgtaactctaatggatatagacgaagaaagactagatgcaattctaacaatagcaaaaaaatacgtggaagaagtaggagcagatctaaaattcgaaaaaacaatgaatttagatgacgtaatcatagacgcagactttgtaataaacacagcaatggtaggaggacacacatacctagaaaaagtaagacaaataggggaaaaatacggatattatagaggaatagacgcacaagaattcaacatggtaagtgattactacacattcagtaattataaccaactaaaatactttgtagatatagcaagaaaaatagaaaaattaagtccgaaagcgtggtacctacaagccgcaaacccgatatttgaaggaacaacattagtaaccagaacagtaccaataaaagcggtaggattctgtcacggacactatggagtaatggagatagtagaaaaattaggattagaagaagaaaaggtagactggcaggtagctggagtaaatcatggaatatggttaaatagatttagatacaacggaggaaatgcatatccgctacttgataaatggattgaagaaaaaagcaaagattggaaaccagaaaatccatttaacgatcaattatcacctgcagcaatagatatgtatagattttacggagtgatgccaataggagataccgtgagaaacagctcatggagatatcacagagatctagaaacaaaaaaaaaatggtatggagaaccatggggaggagcagacagtgaaataggatggaaatggtatcaagatacattaggaaaagtaacagaaataacaaaaaaagtagcaaaatttataaaagaaaacccgagcgtaagactaagcgatctcggtagtgtattagggaaagatctaagcgaaaagcaatttgtactagaagtagaaaaaatactggatccggaaagaaaaagtggagaacaacatataccattcatagatgcactattgaatgataacaaagcaagatttgtagtaaatataccaaacaaaggcataatacacggaatagatgatgacgttgtagttgaagtgccagcgctagtagacaaaaacggaatccatccagaaaaaatagaaccaccactacctgacagagtggtaaaatattatttaagaccaagaataatgagaatggagatggcactagaagcgtttttgacaggagatataagaataataaaagaattattatatagagatcccaggacaaaaagtgacgaacaagtagaaaaagtaatagaggaaatattagcactaccggaaaatgaagagatgagaaaacattacttaaaaaga

SEQ ID NO: 51192 - RNA, 1443 nt, synthetic construct
  misc_feature 1..1443: note = derived and/or modified sequence opt6 from anti-influenza_Chain
  source 1..1443: mol_type = other RNA
atgaaattccctaaagactttatgattggatactcatcctcccctttccaatttgaagcaggaataccaggaagtgaagacccaaattcagactggtgggtatgggtacatgatccagaaaatacagcagcaggactcgtatcaggagactttccagaaaatggacccggttattggaatttaaaccaaaatgatcatgatttagcagaaaaactaggagtaaatactataagggtcggagtagaatggagtcgtatattcccaaaaccaacttttaatgttaaagttccagtcgaaagagatgaaaatggaagcatagtacatgtcgatgtagatgacaaagcagtagaaaggctcgatgaattagcaaataaagaagcagtgaatcattatgtagaaatgtataaagattgggtagaaagaggaagaaaactaatattaaacttataccattggccattacctttatggctgcataatccaataatggtaagaagaatgggaccagatagagcaccttcaggatggctaaatgaagaatcagtagtagaatttgcaaaatacgcagcatatatagcatggaaaatgggcgaattaccagtaatgtggtcaacaatgaatgaaccaaatgtagtatatgaacaagggtatatgtttgtaaaaggaggttttccaccaggatatttatcactagaagcagcagacaaagctagaagaaatatgatacaagcacatgcaagagcatacgataatataaaaaggttctcaaaaaaaccagtcggattaatatatgcatttcaatggtttgaactattggaagggcccgctgaagtattcgataaatttaaaagtagcaaattatattactttacagatatagtatcaaagggtagctctataattaatgtagaatatagaagagacttagctaacagacttgattggttaggagtaaattactactctcgattagtatataaaattgtagatgataaacctataatattacacggatatggattcttatgtacacctggaggaatttcaccagcagaaaatccatgttctgattttggatgggaagtatacccagaaggtctttatctattgctaaaagaactttataatagatatggagttgatctcatagtaaccgaaaatggtgtttcggatagtagagacgcattaagaccagcatatctagtaagtcatgtatatagtgtatggaaagcagcaaacgagggtatacccgtaaaaggatatctacactggagtttaaccgataattatgaatgggcacaaggatttagacagaaatttggattagtaatggtggattttaaaacaaaaaaaagatatttacgacctagtgcactagtatttagagaaatagcaacacataatggaatacccgatgaacttcaacacttgacattaatacaa

SEQ ID NO: 51193 - RNA, 1443 nt, synthetic construct
  misc_feature 1..1443: note = derived and/or modified sequence opt6 from anti-influenza_Chain
  source 1..1443: mol_type = other RNA
atgaaatttcccaaagattttatgataggatacagctccagcccattccaatttgaagcaggtatacctggatctgaagatccgaattcagactggtgggtatgggtgcatgatcctgaaaacacagcagcaggacttgtttcaggagattttccagaaaatggtccaggatattggaacttaaaccaaaacgatcatgacctagcagaaaaattaggagtaaataccataagagtaggagtagaatggtctagaatttttccaaaaccaacatttaatgttaaagtgccagtagaacgagatgaaaatggatcaatagtacatgtagatgttgatgataaagcagttgaaagacttgatgaattagcaaataaagaagcagtaaatcattacgtagaaatgtataaggattgggtagaaagaggtagaaaacttatattaaacctatatcattggccattaccattatggttacataaccccataatggttagaagaatgggaccagatagagcaccttctggatggttaaatgaagaaagcgtagtagaattcgcaaaatatgcagcatacatagcatggaaaatgggagaattaccagtcatgtggagtacaatgaatgaacctaatgtcgtatacgaacaaggttatatgtttgttaaaggcggattccccccaggatatttaagtctagaagcagcagacaaagcccgtagaaatatgatacaagcacatgcaagagcatatgataatattaaaagatttagtaaaaaaccagtaggtttaatatacgcatttcaatggtttgaactcctggaaggaccagcagaagtatttgataaatttaaaagtagtaaattatattattttactgatatcgtcagtaaaggatctagcataatcaatgtagaatatagaagagacctagcaaatagactagattggttaggagtaaactattatagtagactagtctataaaatagttgatgacaaaccaataattttacatggatatggattcttatgtacaccaggtggaataagtccagcagaaaatccatgctcagattttggttgggaagtatatccagaaggtttatatttattattaaaagaactttataatagatatggagtagatttaatagtaaccgaaaatggagtttcagattcaagagatgctttacgccccgcctacttagtaagtcacgtatatagtgtatggaaagcagcaaatgaaggaattccagtaaaaggatatttacattggagcttaacagataactacgaatgggcccaaggatttagacaaaaatttggactagtaatggtagattttaaaactaaaaaaagatacttaagaccttccgcacttgtattcagagaaattgctactcataatggaataccagatgaattacaacatttaacacttatccaa

SEQ ID NO: 51194 - RNA, 1464 nt, synthetic construct
  misc_feature 1..1464: note = derived and/or modified sequence opt6 from anti-influenza_Chain
  source 1..1464: mol_type = other RNA
cacgcacaagatatattagaaaaaacacacaatggaaaattatgcgacctagatggagtaaaacccctaatattacgcgactgctcagtagccggatggctactgggaaacccaatgtgtgacgaatttataaatgtaccagaatggagctatatcgtagaaaaagcaaacccagcaaacgacctatgctacccaggtaacttcaacgactacgaagaactgaaacatctactctcaagaatcaatcacttcgaaaaaattcaaataatacctaaatcctcctggagtgaccacgaagcatcaagtggagtcagttcagcatgcccataccaaggaacaccatcatttttcagaaacgttgtctggttaataaaaaaaaacaatacatatccaaccataaaacgatcatacaacaacacaaatcaagaagatttacttatactatggggcatacaccactccaacgacgcagcagaacaaaccaaattatatcaaaacccaacaacttacatatccgtaggaacatcaaccttaaatcaaagactagtacccaaaattgcaacaagatccaaagtaaacggtcaaaatggacgaatggacttcttctggacaatactaaaacccaacgatgcaataaattttgaatctaacggaaactttatagcaccagaatacgcatataaaatagtaaaaaaaggctacatcccagaagccccaagagatggacaagcctacgtaagaaaagacggcgaatgggtactactatcaacattcctaagatcagacaaaacccacacatgcccaccatgtccagcaccagaactactaggaggaccatccgtattcctattcccaccaaaaccaaaagatacattaatgatatctagaacacctgaagtcacctgtgtagtagtagacgtatcacatgaagatcctgaagttaaattcaattggtacgtcgacggagtagaagttcataacgccaaaaccaaacccagagaagaacaatataattcaacatatagagtagtatcggtactaacagtactacaccaagactggctaaacggaaaagaatataaatgtaaagtatcaaacaaagctctaccagcaccaatcgaaaaaaccatatccaaagcaaaaggacaacccagagaaccccaagtttatacattaccaccatcaagagaagaaatgacaaaaaatcaagtatcattaacctgcctcgtaaaaggattctacccatcagacatagcagtagaatgggaatcaaacggccaaccagaaaacaactacaaaacaacaccaccagtactagattcagacggatccttcttcttatactcaaaactaacagttgacaaatctagatggcaacaaggtaacgtattttcatgttctgtaatgcacgaagcattacacaaccactatacccaaaaatcactctcactcagtcctggaaaa

SEQ ID NO: 51195 - RNA, 1464 nt, synthetic construct
  misc_feature 1..1464: note = derived and/or modified sequence opt6 from anti-influenza_Chain
  source 1..1464: mol_type = other RNA
cacgcacaagacatactagaaaaaacacacaatggaaaactatgtgatttagatggagtaaaacccctaatactacgtgattgctcagtagcaggatggcttttaggaaaccccatgtgtgatgagttcattaacgtaccagaatggtcatatatcgtagaaaaagcaaaccccgcaaacgacctatgttatccaggcaacttcaacgactacgaagaactaaaacacttactatcaagaataaaccactttgaaaaaatacaaataataccaaaatcatcatggtcagaccacgaagcctcatcaggtgtatcatcagcatgtccataccaaggaacaccatcattcttcagaaacgtcgtatggttaataaaaaaaaataacacttatccaacaataaaaagatcatacaacaacactaaccaagaagatttattaatactttggggaatacatcacagcaacgatgcagccgaacaaacgaaattatatcaaaacccaacaacatacatatccgtaggaacatctacactcaaccaacgtttagtaccaaaaatagcaacacgaagtaaagtaaatggacaaaacggaagaatggactttttttggacaatactaaaaccaaacgatgctataaattttgaatccaacggaaacttcatagcaccagaatatgcctacaaaatagtcaaaaaaggatacataccagaagcaccacgagacggacaagcatacgtaaggaaagacggcgaatgggtactactatcaacattcctaagatcagacaaaactcacacatgtcccccttgtccagcaccagaattactcggtggcccatcagtatttctattccccccaaaacccaaagatacactaatgatctcaagaacaccagaagttacatgcgtcgtagtagacgtttcacacgaagatccagaagtaaaatttaactggtacgttgatggagtagaagtacacaacgcaaaaacaaaaccaagagaagaacaatacaactcaacataccgagtagtttctgtcctaacagtactccaccaagactggctcaatggaaaagaatataaatgcaaagtatccaacaaagcattaccagctcccatagaaaaaacaatatcaaaagccaaaggacaaccacgtgaaccccaagtatatacccttcccccctctagagaagaaatgaccaaaaaccaagtatcattaacatgcttagtaaaaggcttttatccatcagacatagcagtagaatgggaatcaaacggacaaccagaaaacaactacaaaacaactcctccagtattagattctgacggtagtttctttctatacagtaaactaacagtagacaaatcaagatggcaacaaggcaatgtgttttcatgttcagtaatgcatgaagcactacacaaccattacacacaaaaatcattatcactatcacctggaaaa
